United States Patent 9,487,797 (GENOMIC PLANT SEQUENCES AND USES THEREOF) - sequence listing, part 33

SEQ ID NO: 60409 - DNA, 9212 bp, Oryza sativa
gaaaatttttaaacgtgaacgagaacgacaatgaacgtgaacgagaacgaacgtgaatgagaacgagcgaacgaacgtgaacgagctagggaacatgaacgagcgaacgaacgtgaacgtgaaatgcaatatatatatgttacttcgcatttatcctaatacatattttttgtatcttgtagaaaagacgtgttgtcggagtcgtccctcaagccggagtggaagagctagccctagaagtaattcgtgcagacaagtgacgtaataatataaatgattgttatatttgtaatgcaattaagaatattagacttgtaattagacttagcatataagattgtgtagtgttctaatattatttgagttttaatataagattattttattgcaaattagacttagtatgtaattattgagtacggaattggtgcgactcctagcaattgactattgtagtcttaattagacttagcatatacgcacgaaacacttagcatacatggctattttagtcttagcatgtaatattatttgagttttaatataagattattttatttgtaattagacttactatataattattgactacggaattggtgcgactcctagcaattgacaattttagtcttaattagacttagcatatacgacagttacacttagcatgcatgactctttcagtcttagcatgtaatattatttgagttttaatataagattactttatttgtaattagacttagtatgtaattattgactacggaattggtgcgactcctagcaattgactattgtagtcttaattagacttagcatatacgcacgaaacacttagcatatagatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccagccgaagccgccaagaactatgtacgtcacagcggttgggttgtgcgggataacgtgcctgtcagtacggtgtactggcgaagaacaagggcacgcggagatcatgagagctttgtcccatattcggagaaagagatgctgtggaccacaatgctcgagacattcacccttcctgctggtacagaggacaaagtgaaaaggtggactctgaagaaaatggcagaacagtttcagagcttcaagggagatctgtaccagaagtatatcctgaaggggcagacaccgaacttcgacacattcccaaagctaagggatcactgggacgagttcgttgcatataagacaggtgaacaagggcaggcgatgatggaaagaaacaaagaaaatgccgtcaaaaagaagtaccatcaccacttggggtcaggaggctatagcgtcgcgatgccgaagtgggaggagatggaggctagcttgattgagaggggtatcgaaccggcaaccgccaattggccggaacgatcgaagttttggtactatgctcacagtggaacgctcaacccagctgatggctcactggtcttcggcgatcagatacgagaggctgcgcgacgactaacagatgcagtggaagcctcctctcagggcacgttccgaccggacagagatagggacgagctgacactcgccctgcagactccagagcatccaggacgaacacgagggaaaggggtgattccttggaagattggtttcaaggaggacatctacacgtacaggagtcggatgaggagcaagaaagataccgaggcgaagattgcagatctagagttccgggtatcgagctacgaactcagaatgcaagaggaggtggcaaggaaggttgatgaacgcatggccgcacatcggtcccatgatccccagccgaccattcctcttgcaatggtgagcccgtcaggaaaacgtagcagttgcgcctcaacggggcaggtaggatcacagagcatggacgccatgcaaacacaggacgaatcgacctgttccgttgatgacatcactcagcggacaccatatgagctgcatattccttacaagaacttatcaataaaggtaagctcgtagtttatatattttagatttagcaattccgctagttgctgcttatatatgttgattactaataaataatctctcacaacatgaaggtggcgtcgggcatggccatcccaacggacccttcaggtacttaccactgcaggcagattccagcaggatactcgaaggtcgaagttgagttggtcgaaggcgcgtacaaggacctcgagctggattaccctggaggagacagtgagacgcatctacgagacacaagccatgccattattctatggcgcaggtggtacatcatcctccctgggcgaaaagcggcgtctcgtgcaccatctcctcctcaggatcctgcaccgtctcctcctcatgctctgccagcaccgtctccacctcaggctccagaactaactcctcctcaggatcctgcaccgactcctcctcgggctcctacacctactcctccgcaagctcctctttcggcaccttcaaagtcaagggcatccccagctccaccgcctacccacacaagggcaacgaagaaggcgaaagttgacgccgccaagaacaaggacccggggtacgattgcacgcaagaggagcttgacgcttacattgcatcagaagtcaagagacaattcaagcctcgaagtctagaaaagaagattcctatagaccccagtgtcaggaacttcttcaggggtatgtctgcacctgtcaaggaggccatcaagctatcggactatgagcgaacgctgaagaaagcatcttctggaaagtccaaaccagtccctcagcttggagagcaaccaaaccaggagattgagccgttggtgaccggggaagacatgacgatagaagaatttattattgacaccggtctaactacggatcaattgctaggagttgaaccaatagaaaaggcggaattgaaatacatgtacgaactcggtaaaccgcttgtcaagcccgagctggtgcagtccctacccacacaaatgtacaagttacatcagctgtacatggagatgagcgccaccggtagagagatgatcggagcgaggatcagggacccggacttcttgcaaggagatgatattctctggatcaatttcaagggaatctacgaagtataccagctggacgccctcgacgtctctattatgagttgctggattttgtaagtatatcattcagttatatttcttaattactacgtctcctttaattaattaggtccttgtatataagtaaactatataaaataaaatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcaacattacaagacgttcatactgttgccgtacaacacagagttagtttaattttactgtcttcctacataccaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgtatgacaaggttttcgaacttatagacaggtactagtataagttcctctgttaattaagaaattcttgttatgttaattatttctactacgaatcatatctttacactccatgtagggcttggtatcggttccgtcatttggtccgcggcaactggagagaaagacttaggcgtaggttcaaatttcctgtgagtacacatgctctacatttatatttctccgattcaaattaatacatacaagtgtatattaattagatctcacgccgttaatttgtcatttatttgtagtgcgcaaagcaaaagcagggaactaacttgtgcggctactacgtgtgcgagtattgccactgccttgcagaccaaatcatcaccacaagagagctcgatgtacgtacaaataaattcaaaatttcattatgtaacgatttcttgtttaattactaatcaatttcatacattcatatagtttattcgcatgagggataacctgaccacacacaaggaatttatcacggcggttcaagaacaactcatgggattcatcaacgaagaaatccttgatcccaatggtgaattctactacgacggaaacacaattcaccggtccttagcttctgagctagcagcgagtactactactacgtcgaaatcgtagctagctaggacatataatggattgtaattaatacatgactacatatgtttctatatgcatgtgtacacattttctataatgtaaatatattttggtcatatatatatatatatatatatatatatatatatatatatgtatatgtatacatatatatatgtatatgtatacatatatatatgtatatgtatacatatatatatgtatatgtatacatatatatatatgtatatgtatacatatatatatatatatatgtatacatatatatatatatatatatatacatatatatatatatatatgtatacatatatatatatatatgtatgtatacatatatatagatatatgtatacatatatacatatatatgtatatatacatatatatatatatatatatatatgatatatatgtatacatatatatgtatatatatatatgtatttacatatatatatgcatggtttatatatatatatataaaccatgtagcaacagggccatgcaaaaaaaaaaggtcaactcgatctttagtcccggttggtagggactaaagatggctcagccggccacgtggctgagccaaagatcgatctttagtcccggttatttcacccgggactaaagataaaccgggactaaaggggggttacaaaccgggactacaaagggtttctctaccagtgccgtgtccttgtccaaaacgacaagtattatcaacccggagagagtaattaactactcctctatctcaatataagtgtaacttaatacagaagtggcatattctaataacggtctagatagatttatagtactaagatatatatccgtactatattgtacttatattgaaatggaaagaatagaatgtaagtttgagcagactataaaaaaagcaaggcataaaccacagctacagcatatagggtaaattcaatgtgattgttccgtctacaattgattttaagccgtaacacttgtaactgaacaaaagtaattgcggttaaattttttatatatgtgttcttagttacttaaagccaatgctaaaaagtaaattacaacaaaattaaaaacatcaaaatcaactcgtatttacatttaagattttggttgttataagttatatagagcatgcagtaaaatatgtagtagtagtggtgaattaccaagtaccaaagaacctcgtttttggtagaagaaaccacattggtgccatgaacccactgttcaacatctatgtccctcaccctcttggtcggtctatgttcggtgccaacctttacccttgtcctctttacgaccaagtattcatcgccgtccgtcgcctttgtcctccttaacaccaagaattcctcaccatccttctcgttgatctttgtctttgctgacttcgttacatgctttgtcttgcaatgttgtcgtacctatgaaagatatgatattaccgtgttaattagtaaccaagaaaatacttaaaggacattgtcttgtaattgctcagactgttgtttggagtgtgtaacattttccctctaaggtttgtcattgacggttgatgagatgaattggttgatttatgtgaacaaccggtggttcaccacttgaattgacaaaagtactgggtactgccagctcaaaaactggtatattgcttatgccagtgatgttacttttgaatagctgttagcaatattggtttttttagcagtgttatagctggtgaaatatttattctagtactattttacaaatatgatattagtagttaattacttgttgctcagctatcacagcctgacaaccgctttggctagcgacgattcgtgtctctgatccaacttgtccacgtagggttactagtggcaaggctccttctgagtccagggccgcagctgtcaaaaggcatacacgtttctttaggagatttttggtcagctaagatattagcgtgcaatgcatcaaacgagcaaatcaaaagtgatttccgcaaattaattagtacatccattttaatatacgatacaattcatgttttaaagtttatttgactattcgtcttttctagagaaaatatttatgtaaatagaaaaatattccagacatgcttggatgagtggctctcttttttactttaatagcatagtaattaaataaatattatatatatatatatatatatatatatatatatatatatatatatattaattataagtattcattttggttaagtggttaacttttgaatacacatttgattatgccatattatttaaaaattttatatgtaaattaaatatacaaaatataaattaagtttaaaatgtcattagggataaatgaaatcataataaaataaatcataactatagattaaacatgtgtttaaaaattaaccgcattatctatgaaaataaaccagtaataaggttatactatacttacacaggtcggagatgcgggtgaacctgcgcgccatacgcagctcggtcgcgcccctgcatccattagtcaccattagccaccattaggcaaagagaattaaggacgagaaacaacaataagtagtattaattaataattcgattaatcgagtcagggcgagacggacacgaagtagaaggccgcggcggcgcagcagcacgcgatgccgctcagcaggcagccaaccccgccgccgccgccgcagtcgcactcgccgccggcggtggcggtggcggtggcggcggcggcggcggctgcggcggccgtcgtcacttgttgcatgctgtcctccatatcgatctcgatcgctttgctagcgtagctgcaggtacgttgcgcgcttaatccggaggaacaagacgatattaattacctctgtcttcgatggcggaggttataattactgatcaaccaaatgcttctcctacaagaaattataagtatatatatgtgacctgatatgatacgtatgggaaatacgcaaggtaatctgttatcttaattagctctatatatctacctatggccggtttgtgcggcgtgcttaattagaggcatcaccaagggatgtacgccagtttatagtttgttagcgtgcgactgcaggactgtctcaagactaactaaagccgatatcttcatgtgtttcacgttataagagctaagtctactactagctccaatttatctatagccaatctaatagccaatttaatatatggtcccacgtgtcatacacacagtgtatcttggagtccgtgctgcagctgctacatatctgtagcctgatgttcttctctctcatcgtttatcttattaaaatatatttatagctggctaatagtctgctattatacctgctctaagatattttccgtttcagtaaagtacacgtcccttgtctaaatttactcgtttgtgtcaattaggtccctgaactcttaaaaattttattttcgaataattgaactggttaaagtatgttattcgatctcaaattgtcacgacacctctggaatcccatgtaggagtaacatgacatgccatatataaatattccgatcgcagattttattctttcttttcttttccttttttttttgccatatgaataagaaaggaagaaaagaagaaaaatggagaaaagaaagagttaacacccgtgggacatgccacgtcaacatcacgtaggatccaaaaatgttataataatttaggacaagaatatcatactttaataaattcggagacccgaaaatacaacttgagagtttagagaccaaataagaacatatttagagactgacgccgcactttactcttttgggttttgattagatccatacataaacccattacccatgcatatgtttaataaatgtgtccaaattcacaaatatatgctaacctttcagcacttgatctgatgatataagttgcttcaaaaccatttttacttttttttttcactgctcgttcgctggattaagtgttagcatttttttcaaaaaaaaaactcatgcatttattcaatataagaggtttacatacaacatacatgagtggacaccacatctttcaaataaagagagattaagttgcctatggtaggacagacatatacacatgcagtatgatttacataaagacccctcaaagataaacaagtaacacacactactaaaaaacaattttcctatacaagaacccacttagattataggcagaccataattggtcacgtctggaaaaatagtcccattttcgtatgcggtccatttaagaggaccgcacggaaaataaatggaccgcaacgaaaatgagcctattttcacgtgtggatctattaaaagggccgcacgcaaaatacccactccctcttt

SEQ ID NO: 60410 - DNA, 620 bp, Oryza sativa
ttattggttgctacgtgctgattgtctgtaaacttatatggatgtcgtgcagttgctggaaacacaggattatctcctctatttccatgcttatacggtctgtttggttggagagagtttctaggagggattgggagtttaaaaggatgaggctattaactgttttgtttggttgggggacatgggaattttggtgggatggggatggggaattgaggaatgaactccctccttttcaatacctgggtaggggcaggtaattaggagggaattcctcctttacttcgcctaaacaaatctcaaccatccattttcattaatgatctaatctccaactaaactccctatcaatttccaccacctctaccaaacaagagactgagatgaaaaatcaaattcccatcttaatctcaccatcaattttctcgtgtaaactcccaatcctcttccctcaagttgccaaacaagccgataaggttatgtaccattaccaactgtggtacacctgtcaatgcaacctttctaagtatctacctctgctctggttctggccagaatttggcccttaaatttggggtttcccatatttaaaaaattttttgggggaaaaaaaaaaaaaa

SEQ ID NO: 60411 - DNA, 14212 bp, Oryza sativa
ctcggtgtggtttggtttggattgtattgggttggatcggatcggattagccgcgctatagcgtcaggggatcagctcggctcactgtggtttttgaggtgttagggtttgagtgctaggttgtttgcttgatggatggtcattcctgtggtgatctcgggagagtgtcggaagtgatatccgacggcacctcatcgggtagcgcagacggcggcaagagcctgcctgagaagcattctgcgctggctgatgctacttctggagtggcggcggagaatgccgataatttgtcacaagctgggaagtacatggatttctccagtaccaccagcttgggggtgaagaaaggcttccagaagtgcatgacgtttccgccctctagcggcgaggcacaacagcagcagggttcatgctgtgatgcagataagaatcccaaggatgtgccaacctatgagcgctccgtgtcactgcccgtgagtatctaatcttcataaacagcatatcatatataagaaattggttatatgttcggactaatagttatcttcttaaccttcattaagtgtatttgaactcaattctaggatgttgttcttatagtgatagttgctgcaaaatggtttccagctgctgtctgggagtagcttatgtctactttaacttaccaaatttatgtttgatttatattcattctgaacacatggtttgatcgaaacgcttcaatatcgttaatatccatacattattatcttttggttttattctcctgtcatctaaaagcaacaatatattgaaccacttgaaaaaattattggaaaaagctctggttgtttttgcactatccgtagagtgtctcaagtccaagacttggaattgcatagctggtctatattagcaaatgccttctttaaatgacaccaataacagtaggattgatgttaacactgatcaatttgttgcatgtcataataatataaatttggacttaattgcctgagttgatatttcttgtggtaatgtaaatttatcgcttattatttatgctatatttagaaagcgtgcatcagatatgaatgctatgatattcttccattctttcctgttgctcttattataggtaagagatcaaataagcataatgttattggtatattgctgagatgaataaattgctatgcttgtccttttgatgttaccacatccatagtactgctgaaggcatgcgtggtatacatctctatgcatatatatggttatagttgggatttgatggtgcaagcaaccaaaccaacatttcttttgcatttgaaattgattagtatattcttctcctcacgttggcctatttctatttgtctcgtggaaccttgtggctattaggaacgcttttgttgttattctgttattaacgttgcctcattttccttcgcaacagccaactttgaagatcatatctgctatgaaaggaagccgccaaaagaatgggatggcttcatcaactgaaagtcgccacgtcaaatgggcccctgacgtgtatgaccccccagtgacatctgtatgtcattcagtgaataacagctaccagcgtcggtccaaatcccggaagaaggacaagaataagcagaagcagaaacaaaagcaaaagggtaggtccaagaaaaaccaccagaatgctatccagagttcagcagtgctccaagctcctgggtaaaattgctttcttcactgctattttgtcatcatcacaaaacatgcaagtaaattctaactgattcatgcacagcgaatttgataggctcaaggatgctgaaaccacaagtagtaattcagcaccagacgatctcaacaaacatgagaccgatatattggattatggcatcagcagtcaagacgccaaatgtggaagcagctttttgcgtgaatcggctgctaaaatgcatttctccactgctgaggcttcctgaaagaaaggaaaatgagtcctgcggattctcccttggtatgtaaatatgatggatgtgtagataaataaaatccagtttgttgttgtgtttcctgctgtgtgaggcgttaagagaacttctggcgtgctttgatttggagcagttaccatgactgttggactggtttttgtatgtattgatggacaaagctagtaagcattaatctatgagctgcagttgttttccttgatcaatgattatatatcagctgctgttgtattggttatagtggattctgactttctgataccatttcagtcttcaccaaaacagcaggctcaactacacttctcctgccatttcatcatcagaggaaaaagggggaactatattctccctgctttatcgttacaattgacccacaaggttggcacgcttccgagttctcgttgatgatcagacaaaattatctcaaatagatccgtatgttcaaagaggatccgtactccaatttaaatttgatactagagatatttcggtaaaggcggaatcttacagaagaattgcatcattcaacataacagacgccagcgagaaagaatcgaacagcgatgagatgtcatgatcaaacgcagaaaggatagccttatcattgcaccgcacatagattacagccttacaccgtcccttagataggagtagtactaagatgataacaaagtcataacccattgcctcaggggagctctctaaattctcatctgaagctcatacttttataggtagcagcatcaaaacaatgctcagtttgcacggcctctgatcacgtcgaggccaacctcagttggatcggtcgcctggagctccacctgaatgccgtcgagctccctcttgaacctgtccttggagctcgcgtagatcatcttgcttctcacgcgcgatgtatcaggagacctttgcattggcatataaaatcaatcagcgagagtttctactacatttcaggtgatgttgtaatattgtgagaagccgataagagagatgcggaagtagtaccatgcaatgaagaatatcttgctcttctggcagttctcctcggtcacgaaatcgtagtcgaatatggcgtatctgcattcgttggcagggaggctagcggcaaaatcgtcgtagttcagtacgggctcgccaaccttctccacgacaaccatcttcttcttctcgtctatcttgtaaatgatgaagcggtaggtcctctttgccttcagctccaggaacttgagcttgcactcatcgtccacagccatcccagatgctgcattcgcctacaggtaacaacaaggcagacagtcaagctaaataaattcaacattgctcgttacatatattaatattgcagttgatacatttgtggaagtacatgatgtgagagcaactaattaaaaacaggggaggatgcagaaagcagtaaatgatttgtccatgactatttatagtaagattggctgtaattggttggctgaaatattcaatctgaattaaaacacaattcactgcaaatgcctggcaggataaaggctgtctaacaaactgaattccgtgacaggatctactatgttgatcgcaagctcggctggcgagatgtccatatatcacagcctgataagtaatgaacacttcacaggtccacatcagacaatgataataatgcttatggagaacaaaaggttgataacgtgactgaggaccaaacatcagggtgaaaatcgcataaatagttaataacaacatgatgactggtcatgcatattccctttcacacatctcgtcatcagttaattaagcaagcctttttaggcatgtcgtatgagcaacaatcaatagagacatgcgattcacatacgactagtaggcaagatcccgattcttgcttgtggactttccatacctgattactagagcaatgctgtgtgacaaaacaaacataactccttcaaataaaaccaataagcttttcaagaatgttaggtgccctgacacctacggcccgtttggttggggggagtttttagaagggattgggagtttagagggatgaggctattaactgttttgtttgattgggagacatgggaattttggtgggatggggatggggaattgaggaaggaactccctccttttcaattcctgggtaggggcaggtaattgggagggaattcctcctttacttcgcctaaacaaatctcagccatccgttttcactaatgacctaatctccaactaaactccctgtcaatttccaccacctctaccaaacaagagactgggatgaaaaatcaaatttccatcttaatctcaccatcaattccctcgtgtaaactcccaatcccctttcctcaagatgccaaacaagccactaagggtttcctgaagaagcaatgggagccacaagccaggtagtcgccaactacggccgccccccatatacaaaatctttgaaggaccagctaaaggttaggctcagctaaggctggatataatccaactatatactctacccaacaaaaataataatcaagaactctagctgtacggcctgtaccatccatggcaaaattgaaggcacctgcttacaactccacatgttcattcatcactatgacaccgaatcgatactaaacttcgcgcatttggaacagatctttgttgctagggaaaaactgccaacactctagccgaatagtagcactaaacggatgcaaggaaagtacccaggcagcaataatttttcttttttttttgaaaaaaaagcaagaacacttgtggtattgtgaatatctcaccaacgaacacacactaagatctacaacaaacgtgtgacgaacagattacgaatctaagatagaaactactgtgcgcatacgcatcaagaaccagcaggcgggcaaacagtcctactatgtacaagatgactagctggtagatgagatgagatgagatgaggccggagggggtataccattgcgggcggcgcgaaggggacggattcgccggcgacgaaggaatctaagcaaagcgctcgcgcgtcgatggatcccttctctctctctggagctctgcgcttggtgtgggtgtgggaggtggtggtggtatttgtgttggggagtcgcgtggaatggacgctcgcttgctcgccgcatctccttttctttctcctcttctattattttcttttcggtggcaccgaccgaccgcgggcccacctgtcatccactcaccacataacctacccgtgtgttgggccccaccgcatcttttcatgggccgccctttcttccatcgggcctccccaatacaatccactcatttcggcccatggtggtggtctcatgttacatactatacgagtatgagagtatcccaatttcaaaagcaaagtacacagttcaaattaatttttgaaagtaatttgaagaacgttatatacaaattacaaacgtgtaaagtacttaagcttgcatgatactactagcaaatctggcttattttaaatttttttctgccattcgattacaagctagctaattaaacaggagtaatttatctttatcaccatcgtcgtcatcatcctagctagtgaatgatttttctgtgtttttatggctcggccatgtccttgttgccgccgagctcgccgtcgtcgtgggcgtggccgtcgacgacgatggacaccggcagctcgtcggcgttgctcatgtcatgctgctgcaccaccagcaccgacgacgtcaccccgtgccccgccgacgccagcgcgtcgccgatgggccccagctccgggtgctccgccgcccggacggccagctccgccaccatcgccgacggcagccgccccttgccgaccaccaccaggccgtactcccggctcttcccgatcgacaccacctcctcgatcacgttccccaccaccaccctctcctcgtacctcaccatggcccccatcctctgccggaattccgccaccgccgcctcgtccagctcctgcaccgccgtgtaatttcatcaacctcattagctgttcatgatcatggctgcgccatggatgatgatgggatgtacctaccttctccttgtgggtgtcgacgatggccgttgagaaggtgtagctcttgtcggcgttcttggtgttcgacgggcgcagcgtcacctcggcgtgctcctcgctaccttccttgccgtcgacgaaccgcacgacggtgacctgcacgccggggtgctcggccatcctcccggcgagctcgagcgcctcgcggtcgtccggcccgccgaagaagacgacgcagacgccgtgcgcgacctgctccgagctgacctgctcgccgccgccgaagccgcggtcgacgaggacggcgaccgagcagggcgcctcgcgcaggatcctccggttgacggcgcgccactcggggccgaggtcgtcgccatggccgtggcccgggtggcgcttgtggaacgggagcacgacgagggagacgcgcttgtcctcggcgacggcggcgacgtcgtcgtggatggtgtggagcgcggagacggcggtcatggggcggacgtggacgtggccgagctgcgcgtaggtgtcgaaggcgacgtcgacctggtcgccgccgccgcggcgagggcggaggaaggggacgccgttgcggcgcgcggcgcgggccatgaggatggaggaggtgcgctcggtgagctcgaccatgcggaggatgtagagcttgacgaggcggcgcggctgggtgtggccgcggatggtctcgatgaggttgatcagcgccggcacgtcgtggccgccgtgtatgcaggccagcacgcgcagctccttggcgccggcggtggcagccgcggacggtgaggacggcgcggaggggccatgcagcttgcggtggtgcaggcggcggcggccggcgttgcgcgccggcttgtagatggccatgactgtgggggtggtgatgaaggtggtgaccagcgccattagcaccaggatcgcaaacgtctcctcgtccagcacctgtgttacaccaacacacaaaacattactcattactctctccattttttattgtaagacgttttaactatgattaagatcaaattgttttaattttaactaaatttatgaacaaatatagtattatttataataataaaatagtttcatcagatcaataattaaatatattttcataataaatttgtcttaggttgaaaatattactacttttttctataacttggttaaactaaaagctatttgactttaaccaaagttaaaacgtcttataaattgaaacggatgggtaataattttgcactcgttttggatgcatttttattggttcaaaatccatatcttggatggagccaaaatcaaaatcaaaatgcatagttcccaaaaaaaaaatcaaaatgcatggcattgacttatttagtgctacgtcgccctcggttgcatgactgacagatggacggcggagccctcaagccctgaatggagcccacctgtcagcgacttcacgccgctcatcttcaagctctgaatggtgcagtttgaagaagaggctgcttttttactgcacctatacattgcaactctggatggtctacggatggcaagcatcatcaaatgcaacattgaactttgaactcttgacaacagtgtggtcagtgtgtcccacttccctatgcactctattcagaaaccagaagagaagattcatgtggatcagactacctttgttgtttgcatctgtgaaattcattcatacttccaaaaccaagaaaatttctcaaaagtcacaggaaacagcacgtctcaaaaaaagaaaagaaaaagaaaatgaggaaaaaaacagtgtagaacagcaacaggaagcatgtaacaggtgacctctgcttttgtcctcacaagagcctttcttttggctccttccatttctcattgcagggcaactcaacaataactttgactctaaaaatggagaactaattcaacaaaaatacctcctctaaaaagatacttcctgtggttctatattaattgacgttttgaacaagattgaggtcatttttttataactttgaccatcaataactttaaaaatatttagtttaaaaaaactaaaacaacatataaaaatttctctttcaaagcactacaataaaagtaaaaatgcatttatttattatatatattataatagaaaaataaggtcaaaaatatatcttgtagaccgtgtcattatccaaaacgtcaattaaaatgaaactggagggagtacggagtatgtaattcagctaaaacacctctaaaaaaatcaataaaaaaccctctaaatttaaaatcaacaaaaatatctgtaaaaataaaatcaacaaaaatacatggtacttactgctagtatttttttagataattgtattatacttggtattataccagtaggtaaatttgtacatgtatgagtagaagaagaggaaaattagaggcaccttgcgttctctgccaatgttgaggacgatgagctcgacgaggcccttggtgttcatgacgacgccgagcaccagcgcctcgcgcgccgacatcccgcacgccatggccaccgcgaacgtcccgacgatcttcccggcgcacgccgtcccgatgacgagcgccagcatcccccacgccccgccgccccggatggtggcgacgtccgtcttgaggccgctcgacgcgaagtagagcggcagcagcagctccgacaccaggtcctccaccctctccgtcaccctccccgcgaactccccctccttgggcaccgtcagcccgaacacgaacgccccgaagatggcgtggatcccgatcatgtccgtggcgagccccgacgccagaacgcccgccagcgtcgccgccacccacacctcgccgccgccctgcccgtccgaccgccgcgccacccacgccatggccggcttgacgaacaccatccatattgtgacgaacgccgcgcccgacaggagcacccagagggagacgatggggctccggtggtcgccgctgcccgagatggccacggccagagcgagcagcacccacgccgccacgtcgttgaacgccgccgccgccagcgccgtctcgccgatgggggtggtgagcagcttcagctcggcgaggatgcgcgcgaggacggggaacgcggtgatggagagcgcgacgcccatgaagacgaggaacggcgcgtagcccgcccgcgcggcgcccgggagctcgccgcggaggacgaaggcgacgccgacgccgcacgcgaacgggagcgagatccccgcggcggcgatggcgaaggcgcggcggccgctacggcgcacggagcggaggtcgagctcgaggccgacgaggaagaggaagaagaggaggccgaggctggcgactgactcgagcacgggcgcgctccagggcgggaagagcgcgcggaggtaggccttgttgcggccgagcgcggaggggccgaggaggatgccggcgacgatctcggcgatgaccttgggctggcggagcgggcggagcaggagggcgaggaggcggctgaggaggaggatgaggagagcttggaggatgaggagcgggaaggcgaagtggagcgggtcgtccccctgccacacgccgttggacgacgtcttcaccgtcgccatctccgcctccgtcaccggcgaggacatccccatcggcgaaatgcggcggcggcggcggaggaggaggcgaggtcgaagaagaggaggatttgagtttgtatgtagttgaaaaaaaaatgagagcgcgcgggtgtctcgtgcatgtgatgtgacaatcactgcctctgggccatatatatgtaagcgactctgtttttttttttcttttttttaatctatacggtaggagcttgtcgaaagtcaaaaaaaataacttaaaaatggagagatcaaaatcagatagctttttttttcgttagagtttttacttgtttatttaaaattaagagtacttgcgttgaaagtaagtgccacatcgaatgataaaagcttattataaatcgtaacgactaaatcattttttatctcttaaaaagttaataatgaaaaaaatcacattaaaaacatcaaaattgctaaatgttagcttttacttatttttatttctttatatggcaatcgactagccctaattctacggggctgttcaacgatatatttaaccatattattttttttgacaaaattattaaaaaattcttacatttagtttgttgttaaatttttttaaacacataataaattatgttaaaattttaatgatattgtcaacttataaaaatttaataagatttattttgacaataatatgaacaaccttctccaactttctcaggagtcaaccacaaacaagcaacaggttaataatctagtattctagtaataggtaaaatgggacacgtggcacgccgctatagctctctagactagagttggagacgttgcccagttcccctgcaccaccggcgccacctcctgcttgaattttttcgtcgccatcgcagtgcgccatctatccatctatcgctagccattgcttttttttctttcaaaaataatagaatagaataaacctacagcctattattataacgtagcactctaaacaagtgtattttaaataaaattaaaaacacccaactaaaataacaaataaccaatataggataaggagtatatatttattgaagtatatttgtgaatctctattcataattagcaaaagttgtataatcgctatctcaatcttatgacatacaatcatagacaattatgtagatttgtagcttagaaatgcttatagttttagaaaagatgagtagtggctgactttatttttttttctaaatagttaaatgggtatacataaatggatgatttgtgatcattgttcaaggggttaaacgaatgaattacttcttataaagtttttctttaacaatggcacaatttaaaagggaagcatgtttcagacgttcaataatccagtattatatttgctcgaaaagaacatatacctggaaagcctgggtttaaatcctagtacctaaaatatcacacttatatgtggacttttagcagaatttaaattttactaatattgattaaggatatgccactgatttccgtctttttgaacatgtgttgaaaggtgcgagcgtagtgttacggtgtaatggtttgcgtgagtcggtgagtgtgcgtctatcatgtaactgggaaaagaaaatgcaccgatgattcctttggaatacgttggttttacaagattttcattttcgtaaagtttactagtccaaatctcagaaaatctgttctagatgacgccttggttcacgtaggagagcatcatcaccaaactgttagtattaatctagttaactatatctgccaccaacagtgaactatatccgcttgtatctgaaaagtaatttatcctgcatcatggagcagattgtatactaatattgctcaccgataagattatccgattcccgaaattaagtaagattaaactagccatgttattctggcgtcgatcgaccaattaaggcgtgattaccaaattgttgagtgacgatcgaacacgagaagcatctgtccacttccaaaatctattcattcaaccatatattcatgattgtttcacttcaattttcttttgacctcccataaaattaattaaagcgcagcaccattcaccaaaagcaacatgacagggctctcttccacagtaaacttcagactttcagactataccatgattccctcaaactgcgtcatcacaataattaataaataagaataacaagactaagcactaactagcatgaagtatcttgatcgatgaacacttgtcatctttctcagccttgcaatgtgggacaaaataatcgtgccttggaagttaattactttggaaattactactttatagctagtagatgctaatagcatttgacttcacttccaattttgttgtagaagcaagattctagctagctagctggagcatccaacttgatttttacacacatgatgtatttaatttcttgaagacataatcaaactgattaacactgcctgagatcgataagcaacagattcagattggtgagcaaagagattcatgttaacagtgaaataccaattataattttgtgaattagcctagcttaatcaagagtccttgcaagtattgatgaagtacaaacacttgatgcacatgaagaagcatgcatgtggcgttgaacaactttattaagctagcacgagatcgaggtgagatgccacggaaaaggggtcggatcagagagattacaagttgagtagcagtaaagcaaaatctagctacttatgtgaattaataagctccatggaatcaatcaacatctcaattacctgcctaatcaacacatatatctgtcgattgtcttaagcccatttcagctgcagctaactgttgttacatgtgatcattcacgggatagatcaaattaaacgtcgacatactgcctacgctccaaccatcttagagttcatgagattcaattgattgttcgtcttccacggaatgcttttcccatgattccatctcgactgattcctaaaaaagacaaggaatcaaggatataaaaatcatagatcatgcatatgctggatatcatatctaaactctgtatgccatgctgcatatgcatggtcaactgctctctctgatgaacacttgtgcattccggtttcagacaagcatggcacagcagaatcaacaatgagtgaacaataatgtggcatgtttatttcagcagagggaccaaatcaatgagttgaacccatgtttctcccatctgtatataaattggaatgcacgagtgaaatgtattatgcatattaagtgctaatctaattggttgtgtttaaattttctgaagaatttgttgctgcagtagaaaactactgagtattggggtttggagctcaaaattattcatagacgtgaaaaacaaggggagctttaacactaaccaaatcctttccaatgatattttttttatataattatcatttccgacagctagtttgtgctgaggggctctatatttctggatcatcgtagcaagcgaataactgacaccagtttcatgattaatggcggccatcttgtcctcaaaagctttaaactctcagactcagcacaacacctgtaaaacaaacgaacaaaaaccagcatgttaaggggaggaaacacaattagtgcaaaaattatccataattcactccagcgctcttgattttgtttccttaagatgcatatgcatggaggccacaaaatcaaactcgaattaaaaaaagaaaagaaaaacagcggaagctcgagtttgctccttttgccgatcaccttgcttgatctctcactctactgaacaaaaatgggggaaaaaatattggagatggttaggaacagaagctaatgaatgtattaatgggctaaattaattaaggaataagttcactttgggtccctctatttgtcgcctagtccaattttcgtcccttgaccgcaaaaccggatacaacgggtcccccaacttacgaaaccgtttaaattaggtccctcggtagtattgtgtccggtttttgctgaggtggcgcctacgtggctccttttgattaggtttttgtccaacgtgtcattgacgtggcgcttatgtggcattaactagataaaaaaactgtgggacccacatgtcagtcacacacaaacaataaaaaatggtgggcccatgaggacccacacgccatcctcccatttctctatccctctctatcctctccctccctcttctctcgctctccaaactggcggagcggcatgggcggcggccggagcggacgacggcagggtggagcggcagtcggagcgggcgacggcggggcggatccgaggggcgaagtgggtcgggcggcggctgatcctcgccggcacctcgatcagcagggcgggagagtggaggcggccgttccgcgatctgccgaaaccagcctggcggcggcgacggcgccaccgcggagggcgatgccaagggggaggacgatgaggaggacatcgccggctccgcgtggttcccctgacctgcgctggcccccgccgcacggaggatgggggc

SEQ ID NO: 60412 - DNA, 19011 bp, Oryza sativa
gacgaacggtcaaacatgtgctaaaaagtcaacggcgtcaaacatttcgaaacggagggagtatacaatagctagctagtaatcttttagatccagtcatgcatacatctgaatcgatttccacggagcttctcagcatgctcatctatctacaacggcgggtcactgtatattgcctgatttctggatctaatgtagtgtcaactaggcaatccgcgttccgtaaaacattttgggcatcgatagaagatcaccatttcattcttctcgacaggtgccttagaaattactagaatccaaagcaggaaaccaattaaccaaagcaggtgatgctaaaggaaaaaccagctcattaattctgaactcaattttatccacagaactattccccacatgtaaaatgtaaaataatgtagtaggggtaattgctaagcaacggatttgaacaaattaataaagtgtgtccaactcctcgaaacagtatgctagtaagttgtatcaacaacggtgagatgatttggcgactttgacgagccgaacgaacggagcaaggtgaaaacgcacgcacctcgtctcgtcgacggggtcctcgcaggcgagggccgcgtggcgccggaggccggatcccgtggtgacggagcaggagcagtactgggggaggctacgaagcgcggggcgccacgccacgccacgccaccggaggggaagacgacgacgcgcacaggagggggaggcggaggcgggggaaacaaatgccgctccgcttctgccctaggccagtaggcccctctccccgtctcccgccgccgccgccgtctcatccatggattttgccgcaaagatctggcaccctctcctctctgggcgccgccggcgaaggcggaggacccaaaccatggccgatgggcggatgtcgctgcgggttcccctggattcgacgagggaacgttgaggcggccggcgcggggtgcagtgcaggcccgccggaattcgagggctgaagcggttgccgttggggtgtcggcttgggcgcgtaacggcggcggtggttgtcgtctcgtcgtcggtgacgcgaatgcggcgcgcgtggtacacgggcaacagggtaggcgtaggcgggcgcgcgccaatgcctcgcgcgtcgcgtcgcgtggcgtggcgtgggaaggcaactttttctctacacatacacattggatggtcgagatgtgatgggggccttcctcttcttcctcctcgactccatcgtcttcctcttccatgcgcacacgcgcacagctaagaaggaaaccgatgcccatgcgcgcgctgtccagcttacacttcccccaaccattcccgctcctcccatcaacgatgcctcgccgctcgcatcagcgaatcatacttgtgccacaagcaatgcgcacactactctgctcaaccggccggtcggacggcgagctccaccaccgcctcgccttcgttagtcatttccaaaatcgtgctcgacaagcaagatatcggcgttaaatacccctcccctccaccgcctctccaaatttcgaacccccccactccctctcgcaaaccaatcccgtacgctccccaccgccgccgagcggagagagagagagaccaatcgaggagtgctcccgcgatcgccatggttagggttatccgatcgctgggcgacgtcaaggctcttcttcgcacgcacggcgacagaatcggcctcaccgtcagcatcaggtgcttgtggcgcatccgccatgccaggaggatgcgcgctctcctccggcagcagatgaagatcgacgggatgcactgggaggtggagggcatagagcacctcaacgctatggttcgtgtccaccgcgtgatcgccaccgccgcccctctcctggaccagatcatctccccctcacgacacgcctcctcgacgccgggacgaagctgcgccgcctgcacctcggcagcgccgccatagaggagatcgtgcatctgcttggggagttgctggaggatgtcgccacggcgatcaccacggagcggcacccgcgccctacgatgatcgattatcttcgccgagccaagttgctggtagaccaggtgtgggatctgaggattccggccagggaattctcacggctttgagtaagccagtctactcctacccttctcatcgtctcgtcctcctcctcctcctcaatctcggtctgtctggtgctactgcgtgattgctacccctcctcccttctcctcctcgtcctcctcctactcaatcttagtctctctggtgccctcctcgtcgtcctcctcctcaatctcagtctctctggtgccctcctcgtcgtcctcctcctcaatctcagtctctctggtgctactgcgtgattgctacctctccggtggccgcggcgattgactacggttgaatatattgatttttgatttctgaattctgaatgagcctacggttgaatatattgatttgtgaattctgaatgagactacgattgaatcttcaattctgaatgagactatacggttgaatatattgatttctgaattctgaatgagactacgattgaatcttcccattatcatgtttttgctacctttcggattcttccttgggggtaacttggtagttgcatgaattcagattttgtcaatcactccaaccatgcatgtcatctcagggttttggaagctgaatttaattgtttttgtgacggaatttgaatttgaatcatacgtattctcagaaactgtaacccattagtatcaacagtgctctacaatctagattgtgaatatgcagtacacaacacataacagagaaaaaaacatatcaacattagtactgtccctaaagaacaaaattcgttgcactcattttgtattgtgcatctatttgcaactatttcatttcaaactccaaaaagacgcaattcttataggcacaccctgtcatgtattttcagtaaaggcagtttccctaaaccagctattccattaattcaagtgtctatgctgatgagcaggccagcttctgaatcccctgaatgattagattcctctcctcatcaagttcatcttcgcctatgaaatgaagtgaaatcagttctatcaaacacatccaaaaaacatttccttacataactggtatgaccttatggtgctttagcgaaaacaatttcggtccttttgaatttgaaccgaagtggaggtaatagcatatcaaacaatcaagcgccgcggctacctttacttgtaggaagattttggagtagcttcagcagttctctgcgattttcgatcaaagcctcgatgatactgcgaggcttgttcggattggcaacaaaaacctgtggtatcacaaagaaaaaagaacccatcaatttttcaatttttcagcatcatcttaactgaactactacattctgatcaatgtaacagaaatttttgaatattcaaactaaacaggccttgttgtgcgtgtttatgtgtcgttttgtttgagtgcacatcaatttatcctatgtgtacttcatgttatgtacctacagaatatgcacacaatcaaatataataccttaaaaacatggaaggcgcatattctgatatttttgcttgaatcctacaaaggctgcaggttagtagtgacatggaagacccccaaaaaaaatcaatggaaattttgactattatgcagaaagtgaacttataaataaatgcgaagatttgttcacttgatggtttcagaagatctgcaacaatttatttaaaataaacatatcttttttatgtacttctatgtatggaaggaggacaaccgctggtgctcttcagataaggggtagaaacttgtgttcaagagtagcaaaatgctcaaacaaaaggatgtaactggcttactaccatagtctgttgttaaatagtttatgaatgaatagtaagaagattataaagaataccttcagtagagtaatcataatatttaagaaacgaacttccgtaatataacgcttcattattcgagcgtttggagcctccaacagaaattccgaaaggaactgagacaagatagatcactttaaatttcatataaattgaatgatgatcaaagaacggctgaacgtagtctaaccttcactgattgtcttcttgttacataattaggtgatgttaagagccttgtgtagagttcaaagaactgtacaagattatacaatcagaaagacacagaacaaatggaatatctcaacttctcaagtatgttagtaatacgattcaggttttcgcaaagttggaaaacagattttgtaggtcatttggcaaacaacagttggcatgcaatgcaatcgttttgatccactggaatatcaataatatatatattaaaaaactcacaagaaaattttgttgttttatttttctgtcatgaaaatagagtatatttcagaccacctgctcgtagtgggaactcaagaactcagcaacaactgtttcatgtttggtaagcagatcctgcaaccatcttgtcaagaacaaccatcaatcttgattcttcgacctccaatataattctttagtttctatacttgtaaatctgaaaatttggattaaccttgaaggtgttcagagcatcagaagcaatatcgaagtttggcagctccacatactcaaaaaacagttcgaagctactggaatccaatatgtatctgaaagtgggcgacaaagtcaaattcatgcaaattaataaaatgattattatgattattaattctttctaatccaggtaattcttattaattctttctacttcaggtaattctgtactgttgatctgttatactacatactctgtgcgcgtggtaaggatgtgcccatttttttatatataataattaacaacctattaattaaatatctagtaaatgatagagggaaattttaattgtaggatggacgctaagcgctatagcgtccaggaatggacgctcttcgtaacaatgtccagacctggacgctgtattgaacgacgtccagcatcccgtcagcctcgttcaacattcggttattatcatttgaagaaaatcaaaaaggggaaaataaatcgaaaataaatcgagaagagaatccgtctcgtctcgaccctctcagcggtggcgcggcgcctcttgtccgctgccgctgccctcctccaatccagtggcggaacctgctctcatcgcctccgccgtccgcttccaccccagatagctgctgtgcgtcgccgcaggcggcgtaccgctgtcatttgcctccttgcgccggaggccgccgccaccagtgaccgctcgacagcgacatcctctatgcggaccctagtcaggttttttgtgtggtcgattgtttcagcaataagattgtttcatcctgatagatttactattgttgtttgtggtgccatggttctgttgagatctgaaaaggcataaaatcctttccaagtgcaccttaatctcacttattgaagttaatcctgacatcctgttcatactactctttgccaagatgcaggtgacatcatgcatttttcctgccttctgatattcgtttgttgatggactgatctccaatatgctggtcactaatttctgtagagcacagaaataagctctatcatactgaattttgatatcaggattattacatgaaacacatcccatttctagctgcagaggaacatgagggattcagacctaaggtgttctcgaaggttcattaattcatgccttttgtattgagtatatatattaacctgaccatcacattactaaaatgtttgattggatctggttcctagtgtctttcaaagtccttatatatgtgctagtcctacaacagcagtccatacagtcgatactacttccatgcataaatggaactgatgatatattcagttttataattatactcgactcttatgctatatacttccttttcatatgtacaacatggaagatgaatctaatagtaatgttactaacttttgtgaaatgtctagcacgggaaagcgtttatgaaaatacaaactaccagaggtgcatgactactaattatctcagtgatttgttatatggatgcctcatggtcagcacgcaaagtataaagatttcagaatacgagaaatgtttttagtctacctatttcttcaacttctttttgccctcagttttttgcatttaaacgtcaagttctccaaaattatcaatacaatgaagtatttgactattgggtatactcaggattgcagtatagagcatggagataggagtgcccacacagaagatagcggaggccaagctagtgactcaacaaaacaaacagtaactctgtgagaatcagctagctgccttacttcatcttggtaaaactaacattttcgtttgatttacgttttcgggaagttcaacacaagtagttgagtgccaagaaaagtttcaagaagcacagtgcaactagcttatatatttaagtgagcttttttagattgtggatgtttcttcgtatgtataagaacttatctagtgtccggatatatacttggtttgaatcgttttgtttgcctggttgatgcaagaacgcattgtatctatccagattgtttgtcctgtctttgtaattgacacagttggctagattattgaaatatatgagtataatttatctagaaccatattacgttgatacgatgtgcagcgctattaaaatgaatcgacatacctatatataactacaaattgattgatccaacaacaagctatatatctgttttagaggcagccggaccagataaagaaaaagctaacgcatgcgtgggcacttcaaaggcagtgatagcatataattaagtaattaaacatgctcaatcgccaacaaagtgatcgagctaacgttgcttaggacaacacgaaggctcgctagcaggagatgtcaacaagcacttgcagtggccggcgtggtaaggcacattgggtcgcaccagactgtggacgctgttaggaagtgcgtcccgagctggacgtgtattctaacagcgtccacacctggacgctgatgacaatagcatccttactactttggtaaatccctacagataattactacttatttaatttgtgaaggattagttcttataaataaaaaaatcggaaggatgtgagcgtgcaaagcttctttgaaacgttaagtggtgacagacttataattctggtgaagaaacattagcctaccaatataataatactattgaagaaacaaagacatgtctagtaacataaatattatataacaaattaacaatgcataaggtgcaacagtggttttttagtagcaggcacaaacataggaaatcactttcatgatgttagaattctgtttttcatgattactgccattaaataataagccatttttatgtttcattgtcatttaaaaccagagagttcgtagcaaacgaaagaaaaatcaacagttcaagcacttgttcatttaatatcataccttagacatttatataggattaaccacatatcatgtaaaataaaggcaggcacgataatgttagtaaaattgcaagacagaataatgtcccaactgaatggaaactttaaacccttactttgtaagtgttgggtattttatgcattctctcaacatgttcccgcaattcagtgcaacgtccaagttcttgtagctgtcacaagagttgatcaattataattatccttcaaaagatacactgtaggcagaaaatgaccaagaaaccacaagctaggctccaaagtgcaggacactttgaatgtacgctatggctaaagcaataaccaacaattacaaaagtttataaaggagaaaatgtgacaactgactgactaaaggccgtgagtagtcaatatcctgtaaatatctgaacgatcatgttattactacagaattgtactagaagttcgaaagattatctgtgatattaagtcaagaaattgatgtgttaccagccaactaggaaatctaaaagctccagatggttctcaatgtacttcacacagcagtagctctcatcaaacttctgcctgagcaaaatgcaccagcagtgaaccagatcttttcgtacctgcaattcagagctaacgatttcaacaggctggttaaatggagaatgcaaacagattttaagtgataaaacacttactccccaaccaagcgaaggcagattctgaacaaagagggaaaggacatcctccttgcaaatctcaagggttatttgcaagacttgttcttgatttggttctgcttctccatcaccagacagcatttgcctcaatgacgagaggtttttctcaacctcttctagagcctaatgttaaaaaagtgaatcaggatgcattcggaatttcaaactatgtacagcagtacaagaaatcttcacaatagagtgaacaaacatgatgaacaatatcatgacatgactgagcacagcaaaccttacaatcatcctgatctaaaattcactggtttctggaccattgaacaatctaccgaaataatacacaattacacattctgccacaaccacaagacttaaaaaaaaagcacaaaaaaggaactcgtactattatcaccaggtttgctgaaacctttggttcgagaattacaatgaataacgctgcatctccccacttaaacatatactgacatgcccagagataatctcgccaacaataggccgcaatgagcaatctcaccgctaaaaggctcaggtgcccctcaattacgaagaaatgatcctcacgccgaggaaagaaaagtctttaccatccgaccaacgggcagcaagatcgccggttttgatctacctccagctgcatgcgtgatgaagggggctaatccgggatcgggcacgcacggatcccctgccttgatcgtcggacgcggcggcgagcggcgggccaagaagagaagaggaaaaacagaggagaagagaggagaggagaagggggatttttaccctggcgccgttcttggtgtggagggcctggaaggagtccttgatggagcggaccacctcctccggcgtcgacggccgcagccgcgacgccatgcggaagaagaaggacatcgccctcgccctcgccggccggggggggcgacggaacggaacggaacggaacggaattacggtgttgctatgctatcgcgggtcagagaggcggctgcgatggccctttcttattggcaaggcaacccccgcccagggccgttttgcctttaaccccctcttatttaacttttttgcttcttttttccctttttatttttatttttggtttctcttctcttcctttcgatgatgttttttacccattgttttgtttattcaaatgcttatccgaatcgcttattagcaaataaaagatcattcgtgaggaaaacttttatatatgtattcttaacgactcaaatgaaaatgatgtcaaataaactacaatgaaaaaaaatcaaattcaaactttaagttctaaagtttaaattttgacttataaatataagcataagtcatgctccagcataacataggtgcatatccttaatgatgtcttggttcaatgagaattactacacaacttcatgtgtacaaatagtcaaagaaaattgtgaacatcagcatccaaaccggatttacagaagaagaaaaaaaagcaacagcagtaggagtgcacatattatggtttcgacaaatatgaccatatattcaacattcgtctaaaccacaatacatggttgaatatatggtcctattcatcgaaaccataatatatggttgaatatatggtcctataatagccgaaagagggccaacgggcaataggttcatgccatattgcctttacggtaaagctcttctatatcgatgcatctgatatgcggtggcggagctagaaattattgaagcctaagactaagctatggcttaattgataggttgttgattttctcctaaatttacttgtgatctaaatggatctaaacttaattttggagataagactatggcttaagccatagtagctactctagacttgcctttgcccccgttgacatgcaaaagaacatgtgatctccaacttttgtttttcttgttttccttgcattttttttatcttagcttctcctagaattgataggttgagtaacctagtcatgtagttatgtttgtttgcatggctagtttctgctcactcctagaccaccataagttattgagtaaatttcacaaaattacagatatgttgaccaaattatcacaaaactaaatatttaaatcggcgtatcataaaactatagatttagcaacaaaattatcgtaaaattatagatttaaaaagtatcagaaaactatagatttgataacaaaattatcataaaactacaggtttggcgctaatttaattaccaaactacaatatttgtagcttcaacatagcaatagtgctaaagatttaaaatacaaaatctgttgttttgtgatgactctcattctattcttaaatctatagttttttgataaatttaatactaaatttgtagtgtgtaatactatgtcttaataaatctatagttttacaatagcctgttcaaagtgtgtgtagttttgttaaattcactccaaatatttgtgttgcttcatttttttttatggcttatcagctgtagattaaacaatcatatcaacgtgaccatattctaaaggcaaattttgctataggacatcgtggcttcgcggtttcagccgtaggatactgcacgaagtgacttttggggaaagacgctatgtaaagatgggaattagcttgtggacaccgcgcccattagaatattcatttttaattgaataggagaaagaaaccgcatgaaaatcctaaaatacccctggtcccaaatgacatatcttccatctctctctgtttacctctctcgcacagaagcgtctcgacgagcacgttgtactgtcgggaggtctgccgcgtgcacaagggcgggaggaggcagagcaccttgaccgcctagtccatgaaactcaaaatcacactacctgcatgggcaactgtggcctcataaacactcgaaccaaatgcatgatccacagtccccaattcgacaaccccaaagcgacattcccaagaaacgacttacatgaagcatagttattagaacccgaccggaccggcggtccgaccgggaaaaaccggaaccagggcgccggccagtccggttcagataaaagatcggcacgcaatcaaaccggcgataaaccggttgaaccgggcggtttactgcagaaccggtgaaaaacaggggtggttcgaccgctcgaacggcgtcacacgtggaggtggcgacgctgcagagtactggcgtcacgtgaattagataaactaggtaaaaaggtggcgacgctgcagagtactggcgtcacgtgaattagagaaactaggtaaaaaggtggcgacgctgcagagtacaggcgtcacgtgaattagagaaactaggtaaaaaggttgcagagcttgtgagtagaacccacaacctccatgcttctaccgagaatctctaccaccaggctatgtgatgggttgtgaaacaaccataacacacatctatttgaacctctttaaaccggcggtttgaccggtccaaccaataaaccagtgacccgactgccttaacggttcgatcatcggtccggtcttaataactatgacatgaagacgacccatccgatgacggagacaacgaggatcaccgagaagaacttgtctggcgacgacactatcgccgccttgccagggagagagctcgacgggatccatggtcaacccgcccgaatccaggccatcgccatggatggccccccacccaaccaccaccaccgacgcagccaacgggatcgagacccctgtctagctcactccctcgaggcggccgcaggagcgatctctcgccaggagtcgcgtcgggaggaggagggatgccacactgcactatgggcaccctttagtgcgagagatacaaatagagagatgaaagagctgacatgtgggctcaggggtattttagtactttcacgcaatttctctctcctatccagccaaaatgaatattctaatgcacgcggtgtccacaagctaattttcagagtgctttcccccaaaactcacttcgtgcggtgtcctacagttaaaaccataaagtcgtgatgtcctgtagcaaaatttgcatagtctaaattcaccggtaactatattcagctcaattactcattttgtgtattctgtgtttgcaatttgcattaacaaaatctgagtataccatattatagtacaattagtatagtacatacatttgtcagagtaagtcggttccttcccccacctagctcccagtattcacactaatcctcacaaaattaattacaacattgtgtcctatacaagataaaccaaagagatcatgaagcaattcgcacgttcatatcctcatcgatttttgcttaatttcccaatcgagaccccccaaaacagcagctagcagcacagatcatagcacccattgctgattgcacattaatttcttctccttttcctttgaagaaaaatcaatttcttcatcatgttcttgccaacttctttctttttttttaaaaaaaatcttttaagcttctgcaagaacaaagtaggagattgatcagtttagcttgtgcatggctcgatgctgctgctgctcactcctcgagcaccggcgacgatggccggaagaggtcgtacggcgcccagaggtagtcgacggcgcacgggcgccgcgcgtcgagccggatccatggcttccccttgccgctccaatggaggaggctgatgggccccgggtggaggccacggcaccgccccttgacgttgtcgccgccgaggccgtgctggttccagcggtggtcgacggcctggatgtcaccggcgagaacgaggaggaacggcggcagcgagccgaggtggtagatccgcgtctgcttctgcacctccatccaccgctcgacgcggcgggtgtagccgccggcgcgccacttgccgacgtccatgaccatgacgccggtgttgaagtagcacgggcggcggccggcgaacgtgccgttgagcgccgggtccgaccagaacgcgtcggtgaagtagttggtgaagttggcgtggcagtactcgggcgcgccgacgacgtggccgccgaggtcgacggacgccagcgcgcggatgtcgtcgacgaccaccacgtcggagtcgaggtagatgacgcggcgcacgtcgggcgggagcgtgtcggcgaggtagatgcgcgcgtagttgagcggctggtcgagcgcgtggcggatggagcgggagatgcggccgcggacgcgggacgggtcgaagcggtacacgcggaggtccaggtacgggaacgtggcgcgcaccgccgccgcgaggtcggcgtccatcccggccgcgaggaagtggaacgacacgctctccgggcacgccgtgtgctgcaggatggacagcacgccggccatggtgccccggaggtagttggcgtccagcgtcatggccacgtccaccctccccccgccgccgcactcctcgccgttgcggaacgcgggggcctcccggaagctcgggatggacgacgacggccgccggatcaccatcccggagtgctccacccggatgcgcgcggccgcgtgcccgccgagcaggacgagcagcgccgcgacggcggcgatggcgctcccgcagcgcgccatggtggcggtgcccgcggccgttgctacgacgaccgcgcggcgggcgggggtggagagagcgaattggacaaggaccggtgggtggccgagtggtggtggtggtggtgggggcacgacgacgtcttcgtcgccggcgagccggcggcgaggggggaccgcggcggggggaggaggagaggtggccaccctggtccttgggcaacgttggggtcggtgctctaggcgacgaggggggccaccattggagatggtggggaaaggatcaaaggaaggcggagcggtggaagagagaggaatagggttggcagcagcaatggcgggtacgtacgtgcatgcgcggtggagggacgggagggaaggtaggagaagacgacgacgacaacaacaacaaacaggtgcatggctgccctgcccattcttggttcaccaatttcctccatttttttttttgttagctgcttgtgttttttttctttttcatggaagctatacttgtgttacaagtgtgttataagttatcccgcaaaaaatacggaatacaagaatttcatataaatcggtataattgccatatggttccgccggtttttaatgtctaacgctgttgacttttaatgtatatttgtttacttgttttatttaaaaaatatagttatcactttttttttgtggtttgttctattattataagtgctttaggcatgacttttttttacatacttgtaataaaaaataattagtttacatgaatgatgaaacgcatgtctaaacgtcatatattaaaccggatgaggtaattcggaaaaaatattttattccatatgagatttaagataatgtaaattgatggctatgcaatgccaaattgctctattcaacaacaaggctgtctgggaagaggacgaagattagttgcgttttacactttagagagacttcttcaatgattcgatcttttttttttgtaggtttgtgctctgcgtctttaatatgaggcggcttcgctacgggaggggctccacctggatgcctgcagccacagagcaccagcgttgagcttgcttgcgtggcaaattcagttgcattgtcatacatcacaaaaaggtttagtatgaatcatgaacagttgatctagtctaatttaattcttatatatacacagatgttcctaccatttccaaattactttggacatgaagacaacgaagaactaacaaacgaacagcgacgtatcaacagtcctacgaaaacagataggggagcagaaaactgtgccatcaactaaccatggccgtcgatcagatatcagatgtcgaatttgtttcttgctcctaacaacaaaaccatgttgctcctaacaacaatgaatgaacatagctggaataaccagtatcgtcttgtgtttaatatagttgaaaacaatttgctaactttgttactaaccactaccagattaacataagtattattgaaacgagttaaaactaaattcatacttaaacatttggacaaacatgtacgtaccttcacgatcttgcagcatacgtttcttcaattcctttcccttcattgtttgcacactggtgtggcctccaaacgtggaggagattaacataacgcaaaagagaatcttaaaaaagataccggggcgcctataaatcggacgtccgatttttgtaataaaaattaggcgctattccaccaagtagatcggaattgtttaactaagtagatcaaaaatgtttcaatcatttaaaaaactgaaacacatcctggaacattttgttacaacgtatgaaataaacagtttccaaaaatcgggtgttgtttcaccatatataaaaacaatgtttcagcaaatagcgaaatgatgtttcaattcactacaacatttgatctatacatagtgaaacatcacgagtacacttattgaaactttgttggtggaacaaaaattaaaacgaattccctgagcttttccataatatgtaggtaatttattgcaacagcgcatgtggtggggacggtgcggaggttcgggaggcacgggaaggggcgtccgatccccagcattttcgaaaagatattggtgtaagagcaattcgagaattaaaaaagatattggtgtaagagtaattctcaattatccaatctctgctcattttagtatcttctgttcatatatctgaaagaagaatttctgcaaatcctgttcgttctatgtttctgtttgtcaaaaaaaccgacctttatggacaaccgataggaacaatatttcagtttggtccgaatcatagggaatgtacgtgtgtgctttactaattcaagttattataagcctcaatttaagaaatgagcttaggacatgtaacttctatagtcctagacagcgttgcaacgcacggacatcttgctaatatatagtgaattcatgcaatttgattgatttttgttcatgaagagtaaataaataattaatagctatgagaagacatccttgaaataacaaatccattttctggtgccttttctgccgctacttaattccttcccagctagctggtcatgatcatcatctgcgatctcgatcgaccattagttacagcagtgcatggaacgcaagaagaacaccgccgcagaatgcaaaaatcgctgccgttgcgtctttacccctgcagttgagcagcaaattaattaagcacgcgatataaatataatcaataaatttcaacagaagaagagctcatagtatatcatgcagcgtctcgatcgattaattacgtggaagcctccttaaggtctgagataatctgatcgatgcctctccgtgaaacgtaaaaccgtccaagttctcttggccgtttaatcagaactgttccgcgatctttgtaagcctgtccgatcgaaaagaatgcattaattaaggtccattatttaatcacaataatatatggttattactacctctatcctaaaataacagtagtagtgagaatccatgtccaatgtttaaccgtccatcttatttaaaaaatttatgaaattttttttaaaaaaatagtcacacaaaaagtactagtcatgttttgtcatgtattaacaatgcaaatactaatcataaatttttttaaataatgaatagtataaaactagactttttttgggacgaaggggagtagcaaacagaaatttcacaagatctgtcaacaaatttcgctccaactgatgaacgaaaattgacggattacctcaccaacaacagtaaatgttgtgccggttggaagaacccgctcagttcgctccaatccaactacctgtagaatcaagaactcatcatcatgaagataaattatttctctcttttttgacaaaaaatattaaattttgatcgatccaagtgtcagcagaagtactccctccgtaaaaaaaaacaacctaggaggaaatgtgatccattctagtacaacgaatctgaaaatgtgtcacatctatttctaggttggttttttttttttggaacggagggagtagttaaggtttagtagttaacctttaccgaaccttcttgtccacagacttggcacctactgcataattgtttgttctcctcaaagacgctgctctcacgattcagagtaaaaccagttgccttatgtgcttcaacaacatgcaaacgcccggtagcatcttcctagtaaaagagttagatatggtgtaacagaatgcctgaaaattaatttacctgatgacagttttatacatgtagaacatgatgctacatattctactccctccgggctgataatattagtcgttttggacaagggtaaaatcaaactttaaaatatttgactgcaaataatttctaaaatatttatcttaaaaatataaaaaccatatgtgtagatttgccttaaaatgtacttcaataaaaccatatatttgttgatattttcatatatattataatagaaaatagttgtcaaagttacttttgggagaccgcactggtggagaaaccatctttcgttgatcggccgatttccacaatagtcccggatgcaataaaaaccggggctaaagatgatctttagtcccggttcaaaagggtaacgggcatatttgatctttagtcccggttggtaacaactaaagatcatctttaatctcggttcgaatgctgtcagggcatgtcaggcccccccgggattaccaaccgggactaaaaatcgtaactttagtcccggttggtaataccaaccggggctaaagatccttgtgatctttagccccggttggtgctaccaactgggactaaagtcccacccctatatatatgtcttcttcctcctccagctgcccgagcaagcttcaaaatttcttcaaaaaagaggggaggtcatgccaaaatttatattgaatttattttggtgattacatacaaatcggaggtgcctaaaatgtttgcaacttcatcctccaatgttttattttgtcatactatatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtatggttttttttgactcatgtagatggatcggcaatggatgtacactgaccggcggtccaaagagtttattgacggcgtgcactattttttgagagtggccgaagctaacaggcaaaggggttttatttgttatccatgcaataattgtaagaatcagaaggagtattctacatccaggactattcatttccacttgttgagtcggggttcatgccaagctataattgttggacatcccacggagagcaagatgttgaaatggaagaagatgaagtggaagacgacaatattccggaatttg

SEQ ID NO: 60413 - DNA, 3699 bp, Oryza sativa
tgatcttggtgagatgttgtagcacgccagggaggactgcgaaagtgaaaaggaggcccataaattggacaagatgttggaggaccacagaacttcgttgtacccaggttgcgagcaggggcacaaaaagttggataccactttggagttcttgcaatggaaggcaaaaaatggggttagtgacaaggcatttggcgatttattgaaactcgtcaagaacattcttccggggggaaacaaattgcccgagacaacgtacgaggctaagaaaatagtctgcccgttaggactggaagttcataagattcacgcatgtccgaacgattgtatcctatatcgcggtgaggagtatgagaacctagaagcatgccctgtttgcaaagcactacgatacaagattagacgagacgatccaggagaagttgacgagcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacatcccaccgatggttcgcagtggcaaaacatcgacagaaaatttaaagaatttgaaaaggatgcacgaaacatacggtttggtttgagtacggatggcatgaatcattttggagagatgagcagcggccatagcacttggcccattacgatgtgtatctacaacctcccccctggctatgcatgaagaggaagtacataatgatgccgattattattcaaggccccaagcaacctggtaacgacatcgatgtgtacctaagaccattggtcgaagatcttaaacagttgtggaagaaggaaggtgtccctgtgtgggacgaagacaaacaggaggagtttaacctacgagcgctgctattcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtatgaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttaccatattgggaattcttggacgtacgccacacaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacattcttagcaaggcagagaaggaaagtatgtttgaatgcttggaaagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaataataacaaagctatgtgcattcatgaatgcaatttcgcagaaggtcatcgatccagatagattagaagcccttcagaatgaagtggtgcaatgtctcgtcagttttgagttaatatttccaccttcatttttcaatataatgacgcatctgctttgtcaccttgtgaaagagatccgtattctcgggcctgtgtacctacacaacatgtttcctttcgagaggtacatgggcgttctgaagaagtatgttcgtaaccgtgctcgtccagaggcaagcatcgccaacggttatggaacagaggaggtcatcgaattttgcatagaatttatcgaagaccttcgcccaattggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgtgccaggaacatcggtaagtccgatgcatggattacacgacatcacattgatactttccccacgtggctacgacaacatctcataggtaacgagtcgatcaaccaacaacttgccttcctagcgaggggaccgtctgggtcgatcgcgacattccagggatatgagatcaatgggtacacattctacacgagagcccaagacataaagagcatgaaccaaaacagcgttgtttgtgtcgatgccatgggacacgatggaacaactgccacgtattacggtgccatcgaggatatatgggaacttgactatggtcctctcaaggttcctctgttccggtgccaatgggttaggttgactggtgaaggcgtaatgattgatgatagtggtatgacaactgttgaccttaacaaggttggatactcggacgaaccttttgtccttgctaatgatgtaacgcaagtctttttcatgaaggacatgtctagcaaaggaaagaagggcagagggcctgacgagcctaagcgtcaagtggttctcccaggcaaaagaaaaatcgtcggagttgagtacaagactgacgaggattacgatcagttggataggcaaccccctttcacggtgacgattgaccctagcatcctcctatcaaatgaagacaccccttactcacgcagcgatcacaaggagggaacaatggtgaggagaaagtacgtgcggtcaaccgtcaccgccgatgtaatgctgtaattattgtgtacacgatgtaaactattttggatgtattgattatccatataaatcaattgatgtatggcataatttactatcattcatatgctacatttaattgactatcattcatatgctaattataattgactagagaatttttaaaagtattaagtcattcatgtggcatttacagatgttaattagagtttttcacaatttaatttactatctttcatatgctacttatatatgactagtcgaatttttaaaaggtttaaatcatgcatgtggcatttacatatgttaattagagtttttaacatttaatttaatataattcctacgctaagtatatatgatgattacaatttttattaattttaaatcatgcagtatgtatatacatatcttaattagagtttttaccaatttaataatatcattcatatgctaagtatatatgattattggaatttttattaattttaagtcatatatttgcttattacgatttatctacttaatttattacagacaaaaataatttttcgaagtaattgtcattaatctttgtacctttaataatgttaatgcattaacttctattttagaaacacatatataagcaaaaataatatgcagtgctataatctttagtcccagttcttatccctaaccgggtttaaaaagaatttggaaatagcaagaaaagatctttactcccggttgatgaga

SEQ ID NO: 60414 - DNA, 7927 bp, Oryza sativa
tagttcatgcacatggtgaccgcagtggatgattggttcggcgacgacagataaagttggcggtggtggacgttctcaatggcgacgccctaggggtggcggcaacaagcgagctccagcgcccagatctgactgcgcccaagataggatggcagaatggtggtcgttgatgacagggatggttgacggtgtgatggtcgtcggctcgcctagcacaacggaggctcttagcagcgaagccttggtggagatggctgccaagcgagcaagcgtcgatgccaagatctgacagtgggtaggtgtggacagtggtggaatatctttctcgagctcatggcagtaaaggtaggtgctcgtcgtgctgcatggctctgagatgctctaggaacggcggagggttcgacggtttgtggaagacagtggtgatgtggaatagcggctttttggcgcactaggggcgttcagaatgcaccggtggcgtaaggggatttggacgacaacggcgaatggcacgcatgataattgatggcagatgttggttgtgacatgcaggggtggagatggtgtggcgacggacagtggggcttagtttcggttctccctttcctcttgtgttgtcaaaaagagtatgccgtatttgaagtttgaaactaagtcttctagtagttttttttttgtgtgtgttttatgttttcctctatggaggtgtagagtctaagaacttgtatatgttttggccgtgtatatccttcctagatatataagttggattaatgaaaatccattattaaaaaaacaatatggattgtaggatgttaaggcctagtttgaaagggcttaatgaatgacgatggattatcttattttggtatataatttgagggtacaaacacaaataaatatcaattacaaataaaaaagctgtttaaaaatattttaagcaatatgtatatagattttctttttttttaaaaaaaacaatcacacactttatgagctctgtaattatgcccgcaataatttctaatctataatctacaagtaaaaaaaagagcagaggtaatactagactccatgcattctgtatatttactttactctctaagatagagttccactaaattatggatttcaggatagggatatcagtactacatattttcaggcataaataaagaataaaccatgctcacattatacaaacttgcgtgatagatgtaaatagatacaacttaccaatcattcgtcccgatgcatcaactttcctagtccattcaaacccaggctaaaacattccatgcaaacagaaataatctatgcagtacacatgtaagtttaggtattgaaccacatgcttgtgttatgcactactatagcaaattaactgaactagagcaaataggaatacaaaatccctcagatgcaactgagttttggcattgaatcagtacagaagctactgcttgattttaattctttagtgcttgaaccatcataaaatagccgcaaagattaaaaaaaaaacaacaacacaatatatagagaccatcatagtaatttgatccttccactttcacttttgtacgaagctgctgcatttctgctgtctaatcaacattctataaacaacatcataatgttctctcattacacaactgtaacctagagtatcagccagcttgggctaggatatagacctaaatttcatcaatgagtgccacatcgaatcattttcacttacgtgcattgttttggcccgagtttgcacgagataagcaagtcgttctatctacttcacgtaacatgtgagtttgtgcactgtgagtgcaatttactcaaaataaattgcatcatcatctttttgtgatactccgtggtttcgaaactattaagattcagatagttgtattgcatagtttcaaatataaacaaatcacattttttttttgtgtgtgtgtgtggggggggggggttaaattatggtgttccatagtttcacttgacaatttcactttaaattcaaatttaaaatttggagcctttaagtttgtgaacaaaagtacgagattggtcctccacaaattgaatcatgtgcatgaagttgtcacaggctcacagcgactgcacaacagcagctggagtaacacaaaaaaggccatttttatcactatgccattcatatgtattaaattatctctactctttctgttcgagtgatttgaacattttcacatccaggtataatccatgctaacaccaggacgtgttctcatttcagctataaatagcaaaaaaaattcaaatatgtataaacccgtcaccgttctcatccaaaattatctactttcccgataatttcattttcattaactccattcccgatcagtgagattttgctacgcattgttattgatataaaaagatggctataccttggatgcgagtgtggccatggagcactgcaatggcatcgccgccgttgggcgctggttgtccaccaagcccaaggttatcttcgtgctcggcgccaccgccaccggcaagtccaagctcgccatccgcctcgccgcgcgcttcgacggcgaggtcatcaactccgacaagatccaggcgcacgacggcttcccggtcatcaccaacaaggtcaccgacgaggagcgtgccggcgtcgcgcaccacctcctcggcggcgtcagccccgacgccgacttcaccgcggaggacttccgccgcgaggcggccgtcgccgtcgcccgcgtccacgcggccggccgcctccccgtcgtcgacggcgggtcgaacatctacgtcgaggcgctcgtggccggcggcggcggcgcgttcctcgcggcgtacgactgcctcttcctgtggaccgacgtcgcgccggacctgctgcggtggtacacggcggcgcgcgtggacgacatggtgcggcgcgggctgggggcgaggcccgcgccgggttcgacgccggggcggactacacccgcggcgtgcgccgcgccatcgggctacccgagatgcacggatacctgctggcggagcgcgagggcggcgccggcgccgaggacgacgacgacctcctcgccggcatgctcgaggccgccgtgcgcgagatcaaggacaacacgttccgcctcaccgtgtcgcaggtggccaagatccggcgcctcagcgcgctgcccgggtgggacgtccggcgcgtggacgcgacggcggtggtggcgcgcatggcggagggcgcgccccacggcgagacgtggagggaggtggtgtgggagccgtgcgaggagatggtcagccgcttcctcgagacgcccgccgccgccgccgccgtcgttgccaacggcaaagtcgacgtgaacgtcggcgacgcggccgccggcgtgcctgaggctgccgccgccgccgtcgttgcggcgggtgtggtctaactctaagtaggatacgcggcgacggtgcatgtttgcatggtgggtggcggctcatgttgcggttttgggttggctttggcgtggctgggccaggtggcttgcaatatttcattatttatttatttttattttgagctgcagtgatatgagattttgagtgagaaaggagagggagggagacacaagtatctttgagcttgtttaagcttagtgttacaagagattattttgttatgttttcagaatatataaaatgctagcgcctctagtataatcggtagtatttgacaccgcacaaaatagtagagaatgctacgcagcgtcaaatattaccagttgagggaatacaaattctaaagtgtttacttgtcttttgatttgaagtttaaaaccaatcgaaattcttaactgtcttttgaaattcgaagtgttttctcccttattagggcctgttcggaacaaaaggataaaaaacacagaaatatgatagagcgtaaattggaaagctcagggactgtaaaacttgagctgtttggaacagaggaatgctaggggatagatacacaagcacacaactaatgtgaaggaaaatttcctttaggaggaaccttatttttctttgtttccttttaaagtatatgatttcaaaaaacaatatttggagggagagatgtccctccaaacaatttttaagaaaaaaatatgagcgtgttggagattaaacacggagttcaaacaaacaagatttggagggagagacgtccctccaaacattttttaagaaaaaattatgagcatgttggggattaaacacggaacctcagggttgaaatcatacatctcttgtcactgcactatcaagtacatctcaaagtacagagtttctcaatgctcttttctttgatccaaacaacatcataggaagattttccaaaggaaactaaacctccacaattcctttaaaattcctttgatccaaccatgccttggttactgcatatttgttttagtataaccttatattgcttgaaactaaacttcccttcttttcatactacctgacagattgttagttctaagagtatgcttatctaacatgcggattataagccatagacaattttaaaatttcgatcttaattttcgaattaatttagttttatttcttattttcagccttagtttttgaaatgctaagactagaagtataaatttcttactagttgctttggtcacgcgttgttggcttataaaccacagcacacaagaggaaattatttatttgtatttacaaatctgtaccttcaagtattcttagtttaccgcacggtggcaaagaaatggagaaaccaaacaaaactgaaccaaaatccatatcttttttattactttgttaaaacatggttgggattaccgcgcacccattgataaacccgatatggaaataacaacctgcttaatgattaatgaagggaatcagataatctgatgtagagaatttctatatcagaggaacgtcctcaccggatcgtcgtcaattctgcatccaacgggcaacatcgtttctaacctctccttgttcggccttagctcagaccaagtccagggaaacgctttataccgaatgtcctaagaaacggaaatatcgaacgtctcgtctaccctacggacgaaccctgtcactgcatcatacatgcttagctgtttcttttcattctttcctcctctctttaaatattttttcttctaaattacttatccgatctacgaaccggtcacaccgttgtattcgttgcaattaaatttttacaacaagatatcatatgattatattatatcaaaagaaaaatatgtgtttcaaactgttaaaataaaatgttccatacgtgatagtgatatatttcaatgtgcgtcttcagtgtgtttcataaaattcttaaaactacctgctactactctctctccacctcatctatgcacacatgcatgtattttagcaagcttcaaaataatttttctcttaaattatttatccaatccatgatccgatcacatcattatatttgttttaattaaatctttacaacaagatatcgcatgattatattttgttaaaagaaaaacacatgtttcaatccgttaatacttgttgtttcatacgtgacagcgacatgtttcaatgtgtatcttcactatgtttcataaaatatttaaatgtttcagttgctaattttttttgttttaccatatctctactataaaaatttaacttgtttttgccatgggtttctagtacgttgttcctttccatttcgcatttggacgcatgcgtttcaaacgttgtttccgattctgttccatgggagtagtcttccctcccgttaaattttttctctctattacggtagttaagttaaaagatgctcttccattgatttcctttttttttcctcttagttaagttaaaacatactacctaatgcatttacggtcatgcatgcgacataatggtctcgtttggttttataactctatacctacttaaaaacacataaggcttccgatcgttcgtttcgtccatcgtcgtcgtgtgagtccgagtccgtcttttttaaaaaaaaatccccgagcagatcagcctcctaacccctttgcccccaattcccaaaaatcacaaaatcactcaattgcaatcccaaatcaaaaccaagaatcctcacaaaatcaacatcccaaatcaaaaataaaatccaaatcctaaccctagccgtctccccgagctaccctcctcgtggtcgtcgtcgtcgtcgccgtcgtccgtcgtccaccgccgtcgccgccgtcgtcggcattgccgcctttcaccggcaccgccaccgttcccgagcccgccaccgctcccggccgcgtcgccacacctgggagggggagcagcagccgccgagcccacatgcggtcgccgtcggcgctaccactgccgtaagatccgccgcgggagggaggcgagaggggtcggagggagccgtcgccgccggatctatcctcggccgccaccaccgtggctggatccacccacggtcgtcgccgacgccaccgtcgccggatctgtcacgcgagggaggggagggggagcggcactgccggggagggaggagaggcgccgccggggaggggaggtgaagcggcgccgccggggaggggaagaggtgccaccactgagagagagggagagggagggaagggaaatgtttttaaggttagggtttgaatcattgaacttttatataggtcgtgatcaattaagaccgtccatcagatcgaacggctcagcttctccagcgttcctaggctgcccacactattgggccgcttgtaatctcctcagagaataagtttactttatgtccctaaagtcgtccccgaatatgttctcatgccgcccacactgtagcccgcctcatgggccacgtgcacgcacagaataagttcacttgaggtcccttaagttgaattgtttttatttcattatgaatagattttcttaaagagctcatatcatgtaaaactaaaccctaatcatctaatatttttatattttgtataattttagtttacccgttgcaacgcacgggcattttttctagtataacttaatgtttcacttgttggtcaactgtaacatttgaccgtccaattattttggggcatcggacatccgatgggtagcttcctccccaagtccacaaggaaaaatagcgtagcgagaaagacgaaggtgccactcattccctatggctaccagctgctcgatcgtcgcactccttgaacttgtccgggagcacgcgcgctaggcgtcggcagcgatgtcatatgcgtaggaggagcagagcacgttcttggcctcgttgtagccatcagctacgtagacgatgtctcgttgcttcccaaccgaagaagccccgggagtccgggatcactgtgttgtgtcgccaccacacgcctccacctcctctcccgtgaaatccatgtgccgccactcgcccatggtgaggttcgtcgcggccagcacgtacgcactccatcaccgccaccggtctcatcgcccccacgcacgggtgtggccaagacaaggaacacaacgtcctcagcttccctggtcgtcgtcggaacgtctccggctcacatgcgcgccaggcaccttggccatttcgtccgacaacccaggatgagcttcgccgcttctggctcccaccctccccatgcagggtttaaaatttctgactaaactttctgaaatttggggtctatcagatcccctgatatgaaattattcgcatggttttttggtttgttttcatttagccaaattttgttaaaatttccaattattttttcagactgaaatcaccaaaatttaggtcctctcggtatccctaatacaaatagcgaaaacagattttgaaccctgcccgcccaactagaagcggcgg

SEQ ID NO: 60415 - DNA, 1553 bp, Oryza sativa
tgagaaaaatgcaaaaaaaaaaaatctagccattgattttcattaaatttgatgaacccattaaaaaacttttatctcttgaaacccgatcttacctgggccacgtacgtatgtatgttaccttttttcttttacgaaaatgcaatacgaaaatgcaagtacgggaaacgcgccccccctccacccccacccccccagccgccgccgccgccatcttccctcaatctctttcgcctcttttccacctattcattttcctattttcatgctttgttagttagaaaagaaaaatgcgttaaacaatttaagcaactataatgtctaaatcatacaactaacctttatccgctaattttcactatattttaactttgaaaagaaatttcatttggattatattttctaacttttgtatgccattcaagcaattgtaaacaatatgaactatgatgatgatgatgatgatgatgatgatgatgatgatgatgatgatgatgatgataataataaagattttagagctacaatcataaaataaaataaatataactgtcagtaatatttccaacatatattagtttgaaagcaaaagtaatgctaaaatataggtaactataacatgtaaatcattcaactaatatttgatccgcttatatctttagattattttgcatttaaggacccaaacctactataattcaactttgaaaagaaatatatcactttggggctatattttctaacttttgcatgtcattcaaacaattataaaattattaaaaaaatgatattgattttatcattgtatatatcttcacagtagttaaattagatgtacaatgataaagtgaaaataacctaaatccccccattctaatattataattagtcaaaatgatattattagacttatagtgttcatatttttaacacctactgtgaatataccgtagaaaaagacgtgtaaaaaagatagagtttaattctatttttagttaataaagtaaacaactaaaatagtataacaagtaattatatgcaagcatactctctcccctttcactctgttcgtctcctctctcattcaattcatccatcttctaatttttaactaattagtaaaaatgatcaataattacaaacaacagaatcaactatattagatttttaactaattattattcttaagattataattactccgtagcattatgagtttatttgtatataattgcatatataagccacactaagatagcagtatatagttgttgaaaagttttatttgttactattaaatttaagttttcagattcatgttaactaggtattatcttttaaaaaggataatatagatcatgcatatcacaaggaaatgaggcctatgatacatctttgttaatttatatgtaagtatataacattttgtgtaaatctgaaccatctagaaggaggactaatttggtgggacaaataaagcatatttattaacagtaatagttctttaggatttattttaaaaaatactaaacattcaattaaacaagacaaat

SEQ ID NO: 60416 - DNA, 3881 bp, Oryza sativa
cggcaccatttaggatttctgtagtagtggaggcactgcagcgggccatgaatgcatggccagcatatcaaggtcaccacgaacctgagcaccggccgagcctcgcgccacctaactccggcggtagcaacaaggtgcgggcgttgcacgcagcgttggcaaagacagcggtgcaagtccggcaaccacggcgagcttagcacaaggtcgaccggcggcacaccaagcatgacgatgagcagcggggcgacaaaggtggcctgttgaaactaactgaggtgtttaacaaaattcatgacggatggcattgttctaattttgaaatagtacagtggcatccacccaatttcacgaacagtaatgacgtattcttaattgaacaaatttgcaatggcatccatcaaattaaccctatcaataataaagagccaacttaagagactattctttgtatgagtgctgtttttctctgatgtgaagtatttgagagcccctctacctttaaacatgtcctaaatactgaatcacaacttcacaagtttctaaaaaaaaaagttaagcaattctaggaatgtgccatatgatcgatgtggactagagagcttccagccctgtcctttcttaaatatttgaaagtatgtgaggcttttgtaaaacacttgctcccaagtctaataattaaatagtttctgtggggtataagaaaactgtataatattacttttataactattaagaaagcaacatgtttgtcgtttagaaagcaatcatttaattttaagtagcaaaggtttctttcaactggagttagttggagcacggtgtatgtctcgaattgtaccatgcctgtacacgtgctctttcgaaacatcaacattttggaattatgagcattaattaatttttcaggtgtgtacaatatgaggtactgcaacttcataattagcactaattaaaatatcagtgttaattaatcgcgagtctcggttaactaacgtacgctagtggtgcactacagtaggaaaaaaaaaatctaatcttggatagcatagaccttgtgaaaaattaattccatcgctagctcttcaaaaatcggtgctcatgatattatatataccaaaacgctgttgataatatatttagtcattttttggtgtgtatttttttaaagaaaatctaacatgtatatcacgatccttcttgatctgcatcttgtataatcatacaaatttaaattgaaaatatggacgctgtctaaactgaaattaaactgaaaacatgcatgcatataattataattaataagcagtgccttctttttatagaacaccatcgtttaatatattccacaaagaacatagtaaatacaaatactcgtacattaatttctttgtggaatatattttgagttgaaactgtcgatgatctgtgcatatatacatcagtcgctttaattaaacttttttagattcaaataaatttatacaaaaatatgacaatctttttagaaaaacaaacatattatcaaaatttaatcataaacatatattataggttagttttaatggaactaatttagtgttatagccattgttaaaaatttattaaaatcgatcaaacataagaaaaggttataaaaaaaaatcaattgaagcgatttataatatgaaacaaagagatgatattaattgcatatctcatactccatccatccgttctaaaatataactatttttagcatagtgtcaagtcaaatatttgcacttggactattaatagcaaaaaaaaaaaagatcaatcacctaaaattgagttactagatttattattaaacaaactattattgtatgcaactctttttatttaaaatatcttacttttatagatatcattagtcaaagtagcatttcgaagaccatgtcaaaatccaaaaatgtttatattttagaacggagagaatacttctttttctgcaatgtaaaatgatcattcaagtgcatatatcgatctttgtgtgctatgggatcgagtacgatcgaggtactcaaatgggcagcaggtctactatgtttttggatcagttcgatcgattgccctggtcggacggttgtgagtgacatataaaacctgcaagttttcaacgacattctcacgtgtgcatctggagatcacttacacgagcaagcaatatatataactatgctcctacaattattgcaaacatatgtgcgtgcacacacatatatatatatcctgccgatcagggaatcaacattatcatatgtgtatgattggtcgttggtttttctctatatatttgtcggcaggtgtggggatatatatccaatggattaattcatcgagtaaactagaattaaccatgcattgcatgcatcttaattttaattacttgcattgcattgtatataataattgggtcttcaaatactaccttattactccctccatccgtgaatataagggattttgactttttacttgcactatttgaccattcgtcttattcaaaaatttttgaaattattattatttttatttgtgacttactttattatccaaagtactttaagcataacttttagttttttatatttgcacatttttttgaataagacgagtggtcaaaccgttacacgtgaatagtgaaaatcccttatattttcggatggagggaatactagctagtgacagagtcattggtgggggcaacttgtcagtgactctgccctgtgggccggtcgagccagcccagttgggtgatgcatgcattgggcccatgacacaattaatacgtacgtacaacacagtacgtactccactatactcaaatgggccgggaccaactccatatctgtaacccactttaatttaattcagatttataggaccgcaagttattgatccattcactgttaaatataatccttgtcgatcttgaaaaggaaataacaataattaatggtacggttattaattatcttgtgcgtgatgattgcttttttggagtgaaacaacaaggctgaattgggcaataagctagctcgatggtagtttagctgctacaggattgcaaattgacaatctatagctgctacaggattgcaattgacaatatatagtaatccctccgttttgaaatgtttaacaccgttaactttttagcacatgtttaaccgttcatcttatttaaaaaaaattataaaatatataaaactatatgtgtacatgaaagcatatttaacaatgaattaaatgatatgaaaagaataaataattacttaaatcttttgaataagatgaatggtcaaacacgtactaaaaagtcaacggtgtcaaatattttgaaacggagggagtaagaaagaagaagcgacagatcgatatatatcgatcgatggctacagtttataatgtgcagatttatcgctgataataatagagggaggcaaagagagacgatcgatcaaccttagcttttccttttccacaaacactggggaccagaaggaatgcacaatgcatgcattgctttctttgttcttcaagcaatcatcgtatcatctctttacaatgatcgatccatcgatcaatcaatatgtagtgtgcacaatgctcaccacatagtgacaggagattattctaaagaacacggaatgacgccctttttttttttgccaagccagcctatatatatatatatatatacactggtggagaaaggggctttactcccggttcgtaacccccctatagtcccggttttcaaaccgggactaccaatccgggactaaagatcactatctttagtcccgggtgaaaaaaccgggagtaaaaatccatttttagtcccggttggtgtt

SEQ ID NO: 60417 - DNA, 1601 bp, Oryza sativa
ttttcaaagtatcatttctctatttcttttcatcgacattgcttacataattttaccaaactattcgttagaatttaaatatgtaatatttaatacatccctataaacaattatctatcatctcttcttcatcgtaaagttagatttactttgtttgaaaaacatgtctaataaattaagtgtaaataaaaataaggtgatttgtcttgtttaattgaatgtttagtattttttaaaataaatcctaaagaactattactgttaataaatatgctttatttgtcccaccaaattagtcctccttctagatggttcagatttacacaaaatgttatatacttacatataaattaacaaagatgtatcataggcctcatttccttgtgatatgcatgatctatattatcctttttaaaagataatacctagttaacatgaatctgaaaacttaaatttaatagtaacaaataaaacttttcaacaactatatactgctatcttagtgtggcttatatatgcaattatatacaaataaactcataatgctacggagtaattataatcttaagaataataattagttaaaaatctaatatagttgattctgttgtttgtaattattgatcatttttactaattagttaaaaattagaagatggatgaattgaatgagagaggagacgaacagagtgaaaggggagagagtatgcttgcatataattacttgatatactattttagctgattactttattaactaaaaatagaactaaactctatcttttttacacgtctttttctacggtatattcacagtatgtgttaaaaatatgaacactataagtctaataatatcattttgactaattataatattagaatggggggatttaggttattttcactttatcattgtacatctaatttaactactgcgaagatatatacaatgataaaatcaatatcatttttttaataattttataattgtttgaatgacatgcaaaagttagaaaatatagccccaaagtgatatatttcttttcaaagttgaattaaggtaggtttgggtccctaaatgcaaaataatctaaagatataagcggatcaaatattggttggataattaacatgtgatagtgacctatattttagcattactttggctttcaaactaatatatgttggaaatatgagtgacagtgatatatattttattttatgattgtagctctaaaatcttcaggattatcatcatcatcatcatcatcatcatcatcatcatcatcatcatcatcatcatcatagttcatattgtttacaattgcttgaatggcatacaaaagttagaaaatataatccaaatgaaatttcttttcaaagttaaaatatagtgaaaattagcggataaaggttagttgtatgatttagacattatagttgcttaaattgtttaacgcatttttcttttctaactaacaaagcatgaaaataggaaaatgaataggtggaaaagaggcgaaagagattgagggaagatggcggcgccgccggctgggggggtgggggtggagggagggcgcgtttcccgtacttgcatt

SEQ ID NO: 60418 - DNA, 13582 bp, Oryza sativa
tggcgcagcaggacctcctccatggtgaagactgtaaacttcggggacggcgtggtgaacacgggagagagaggtcgcgagagagagaggtggttttttttggcgggtggcaagcagggaggaagataaggaggggtggggtaaggtggatagggggtggcgcggggagacgtgattgggccagctgtgatctcccgggatttttccttcgctgctgggagtgggaggggaagatgcgaagctggtccggtgcaatggcgtgggggaaggaaaagcacagccacacgttgagctctaccgctgcaagcctgcaatgtcgtttgctgtggggagagctgtaaaatgggagcgaaaattcatggccacaagcaatgcgagtgttttcttttagctgtagggacatgcatgggatcaaagtcgagtgatagaatgagaaggactatgtggcaatgcctataagagacgaatgtctaaaatgaggggatgtcctctcgagagacaaaaagtcaaaaatacaagagccattgcactgcttatttaacactcgtaacaaagaaacacgagacacccatatggcaagaacaatatagtcttagctcttgaacaaacaagttaatagagtttcatagcaattgtgtaaagctaatcaggccgcgaaacaaaagtggcagagaaaaatattctcaaaataaaattcaaaagcaaatacatctatatgccctatttggcttcagggctttattgcagccgcaactacttctagaatccagaatactcaactctctatctagattataagaattagtaactatggaatttaaaaatgaactactaatcggaagctggaaaacatgggatctctatattcccatcaatcatcagcttccaagaacatttagctcttccaaacgtgactttacgagtccttgaaaacaattgcctcaaggtttcttaagtgttctcgtgaactctagatgatagagagagaaaggcttttttcttcctcctcgacccctctttctcctcagttcctatggccctgtcactggtgatgggaggtagaggggttgggtctccaccctccttgtaaatccacagtaatagtcagatctttcttttccagtttctttctttcgttacccctaagggttatactttgttccctctatttttaatgaaataacacagtctcgtgttgattcctttttaaaaaaatatagttagatcttttcattaggtcatgttatttgggtagctttattcttttggttcccagggaggtcatcggggctggtcatccttgccctggtttccacagagagtgcataggtgctcctcttggtggcattcttcatagtctacgggctagtttccaccaccgcgccagatctagtaaggtcaaggttgtgccagccatatcacctatctctagtgagctttgtacaagggcaaccgtcttttcctttgtcgttgacaacaatttgacaggtaactgagttttgagcaataccttagaagccttaacctctagtcagcggagggctcatttgggtaagctccttggtgccattttctgcagtatgtcatgcaatctttgtcctcattgtcaatcaatgttttggctatcatcctcgatgctcctgctccaatgtcggccaacttcttcggctttagtgatgtttatccaaggtgtgtggctgattgcttctatggaatgccaaggtcttaacctccatcgatgtgaggcctcaactgggtttgtgctaaggcaacatcttcagcaattcattgtgcaatcaccatcgtcaatcgtgtcgtccaactccaaatcttgctgtgggcagagaagatagaagcacctaattatttttccaattcttttaagtcctttgcttaaatttggttgtaatttttccatctttaaactactcttctaaaaaaaaggttgtactatattctaaggcctaaacccaactcaatctctctaattcattttgcgagaacactttaacctgtttcacttattttttggatgaaattgaaattatttggccgtgctctagtttcctaaaaaggtcgagcggagttgaagctatgctaaacaagctcttaaaaagggtcctccaaagaaggtccataaaaacggctctaaggcttttaatgggatgggcctggccctaatttgggcccaaagtggcccagtcttgtgtgcttgctgtactagtttacccgggagcaactcgtagatacaacttgcggtaggggccttccggtaatttgacgggattcactaattggaacttggtgttgggagtccccgtcgactcgcactcgacagtcgatcgccaacaagcccaaacccggagagagccggaggagatccgtcgtctcccgcatcctcaccggccgccggcgatggagaagggcaagggcctcgcccgccgctgggcggtggagctccacgacgcctcctcctctcctcctcccactcctccatccccgacccgcccggcttcaccagatccgcccccgacgcggtactacctcttcttcccccccccgtctttcgtccaactgctctattctcttccccctcccgcctggatcgcgggattgactcgtgtgctctcttggcctcccgcaggacgacgccgccggcgcgcggcagcggaaggattccgagaccgcgtggaaggcgcaggtgagctcgatctccccctctttccctgcgtgattgtacggtagatccggagttttagatttcttccatggctgtacgagaaattcggtgtggatcgacgaattctgtcgaatctaggacgcgtcagatcttgctgcctcgttatctccgcggagtgctcgaaatttcgcttgcaattgcatatgctggtatctaggttttaggtctgtgtgtgttgactatactgtctgtgctcgtggtgtgggcagaaagcgtgggaggtggcgcaggcgccgttcaagaacctgatgatgatgggtttcatgatgtggatggccgggagcaccgtccacctgtttagcataggtatcacgttctccgctctgtggcagcccatcagcgccctccgctctgttggcaaaggtacttcctcctgcctatatttggttggtgtcacttgctaatttagctcgagattaacagtgttagtgctaccgattcatactggcaagtcctgagctcctgatcaatgaatagtttagcctcttttatgcaatttcttttctggcgtccgcgtagtctggctgcttgtacctgggcttccatattgtggtctatcttttgttggtcaacctgatgtgtattcatgttaagaattcttaatgcctggtcacctgctgcttgtcacctagattgtctgtagagcgcaagtaatacctaggcatattatgctaaaaaattaatgtgggatgcttttcatactcctgaaatttttagatgtgtgttcatgctacatcatccctaaaattatagttgttaattttactatattgtttataacaaaatcatcttacgtttccaaaaaaaaaaaatcctttacctgaactgtagtaatagaccaacaaaagtatacgaaaataaaagagaattggacatatcaatgattaataacgttgcttgttttacagtggagctgattcgtaaaaatgaatatcactgtcaacctgaataaaaatatgcaaagatggctattctgttgcataaaatgctaatgattaactcgcatcagccttctatcttctaaaggcacatgatgattgaaccttcagttgcttgtatgtaacaatgaagtattattctggacttgtgactgatattgattggctacagtccacattcatgttgtccatattttagcagccatgtaccagaagttgtgacaacaaaaatgctcgtgacattcagtactgtagtctaggtgttgagtttttttccttaataaaccttctgtacttttgcagtttttgaaccattcaaggacccaagggtggatactctagcacctaagttggtctttattgctctcaacttggcagctatgggtttaggtgtatggaaggtaagttatagtaccatggtttagtcagaattttcatgtttctctgtaagcactttgggcacttagctgcttcttctacagctcaatacgttgggtcttcttccaacaaatgcatcagattgggtgttttcactggctcctgctcgggtatgttgctgataccacccaaattacttcttgaatttatctggtcacttttaggtttgttgtactgggaatgtgtgttactctctctgatcacgaaatacttgtccttttggacatacatccggtctttttttttaaaaaaaaaattgagtattggtatcttctaaaaatatttagattggatatgagagtcatgtgtcaatttgtttcataaagtactttataatatgattactttattggggttttcaagtctataacaatagaattattggtaaagttacaattaggaacccatgaaaatgttaaaaacgaccaagtatttgtgactggaggtagttcgtccttgcataattgatggtaactactgtgaaaactgggactcaatcaacttgctgctaccagttgcttgttctgttaattgcttcacctgttcatggcatctgcaacttcactataacctgcaaactgcccaaaaccttttgatatttgtccaatctcagtgaaacttgttttgtgagattgtttatttacctcctgattggcatgaaacttgggatatatacacagttagtttttgcccaacaaagataaataatacaaaatttgagattgaaacattttgaggaatttagaactgagaagtaccatagcttgaagactccccctaaaatattgtatggtacaattcatgatgtgtggcgactagtcacaacaggttcatgttcacctgtatgatatccacatctctctctctttttttttttgttctggctatgtcaattgcttcaacaaaatagccaaaagcccaaacttgaatttctgttagagacttggctcttttttcttttaatgtatgcacacatttactggtacaaattgtaaatattgcgaccaaaattttatcccttttgataaactttctcccttagccaccgatacttgatatttttccagtcaatatttctaactgaaagtctagaatgttagtttgccactatttacttttatgatctatatggattgataccatgtatatatatagcagtggttgctcgaactgattgagttttattctctgctggcaggaggttgaatatgctggtggagggatccccttgcactgaaacctttatgtgcttcagttagtacttattaaagttttaccacttggaagatggtgtctgtactaagcgaaaaattaccctgcagatgggacaagtctggtttttgtgaggatcatatttcagcacctgtactaaacttgcactatatcttgagacaagtaacttacaatttccttgaccccttttgtttaccctggttatttatacagagtcagttgattcttagtaaagctgaattatgttgttatgatgattgattgttgtcctgcagaggctcttgataccagccttcttttccttaaggcaatcttggtttgattatgagctgtgaggctcaagatggaatatgttggcctgttagtgctagggaccaatttgttgcccttatatacaacacctttacgttttgttctgaatagcgtcagagaatttgaactgcagaacattcagtgtgttgcgcttctgcagttgtcttgtgagactctctcttgctaccttgggttggttcacctcgcgccagttattggttcttgtggtcatcgtggtgcccgctggtagcggtggcagacgcccgcgctttccataccaatggagattggagaagacatagcaacgcagcgttgatcagggtgttgaagactcggatgacgatgctgctgcatccgccgccgaagtgcatccactacaacactgtcgtggtagatgagatcatgagattgcactcgagtagagtagccgaaggccggcgccgacccagaatgtaacggctggcgtcggcgagctaggatggagagcacctcagggattacgattttgtgaggagagggaggccatgagacgattgaggattagagcaaaaccaaatcgagaagcctcaccgccgtgactccgtcctgcagcaccgctccgcttcctcgccagttcgcgactgcaacgtaccttggcttagggttctgaatcctcatcccaatgccctcaccgctcagtccactctcttatgtctccacttcggcttcgcggtttgcgtccgatgttgacaagggtggaggccacgacgcctggccggccacgcgagctggatacttgcgtgcccaggaaaaattgactcattatttggggtggccacagcgcgccgagcctcggccgggggtcacttcgccccgctcaaaaacaatatcaattggagcctcgctgggcgggacgatggatcgggcggcggcgctgtcgattccaaaaggaggactacggtaccgcacgcacgcaccaacagttgcttgtaacaaagatcaacatatacgagaactgctatacatacgaggaaacctttttcgcgaacgtgcaaaataattgcacgttaatatattagaagaaaagagttatagttacacgacgcaatcagctagaccagcttatacaagggaagggagaaaaggcaaaataaaaggctgagctaagaaaactacggcggctaaacacaaactccaagcagcgggaaggggccaagctacgctagactcccaataaatccccaaaagtggtaatgccagctaaaaaccacagatggccctccgagtggatggactccagaaccacggagacagaagagagcgcagagtcgaaaaccctagagtttcgttccttccacagctaccaagagaccaagagcaccagggagtcaaagctagcacggagatgctctggtaagcaggccctggaggacggccaccagttctagaaccagttgccactaggggagagagggcagccatccaggaggcgacagcacacggagccagacctgccgagcaaacacacagttgaggatgtggttcgccgtctcaacgtacaatactgctaagtctcttatcttatgcacgtggcaaacatggagcctagcatgtttccatggcccagttatacgcatgccaaaaggcgactgacgaaatcgcatgtgatgataagaaacttgcagattttttaagtagttaagatcacgttttatttgaagtgtacaagtatggaaaaaaagtttaaaactaccaagaagggcattcgcttaacgtcattgactttttaacgcatgtcttttttttcgaacgtttaggccgttatcgacgttagaaggtgactcattctaaggacaaaacgagactaaaccttacagtgcacagttaattaggaaaaatgggacgaaaatcacaactacaacaaactcacaactaaccaacctaaactacaaggccgcaaaagcagaacagctaggttcactaagtaaatgttgttcaccacaagatttgcaaaaagaagcaaccgagaagacaagcaaaggctccctcacatgggcggagacatggcattatcgtcatcacacaggtacccacgcgatcgggcaactccaacttcatcaagaaacgctagggatcaggagagacttgcaaaccaacaagcttgcaactctacaatggagcgaaacatgacagttatactctgacttaagtcatcgttgccaagctcgtaaccgcgtagcagctccgactaccctaaaggacagcatacagaacctcttagaaccgaccatagctttgagtcatcgttaccaagctcgtcaacacgacgcagcagctccgaattcccaaaagccacccatagaagccaaagtggagcatagttgctatgggttagctccaagcacgacacgatagagaaaccaaaaggacgtctccaaggaggaatcgacgcccgctagcgtcgccattcacgcttttgcctaggcctccaccaacctaccactatgaagacaaccaactatcgatgttgcgcccgctctcaagtgtgcaagcaaactttagcattgcagcgtgctgagatgaccttctctcctgcatcatggccacacccaaccaccaggaactggaaccgccatcaccaccaacagagacaccggatgtccggatgtcccagaaccagtggcccatcacccctcgttgctgaccagcaaagcaaaagccctactgccaccgtcttccactggacccctcaatgccattgcctgcggaaccgcgtcgccaccactccgtcgaacgggccggcctgctgcagtcgcgccgtcgtcatcccgagggcattgtcgttgccctgtgagcaggagctgttgttgatgtccgcacgctaggagggggagccctctctaccgccaccaccatccgcttgccggccagtgggaggcccgtcacccacagtcggaaccaagggcacaggccccagatccagcgacttccctaggttgcaccggtgccatccagtggctcgagcggtgacggggcaggaggtggaggagcccgctacctcctattatcactgctgctagccacgccggccatccgacactcgcaggtgcgtcaactgctaccttggccaaaattgacgcggagacgccggatccaaccacgcaccggatctagatgtgacggcactataccagcgccccgcgccttcagcttgtcgtgctcctcaccgtctcccttgcgcaggaggcgagcctcgccaaggtttggccctactaccacaatcccatgctcgccgcctagagaaggcaacgtgctccgacggtggcgaggcggaggatgagggggagtgggtggtggcgggcggctagagtttcgtacatatgcatgatagattaaaatatgtgctaatttatagttgtgttatactagtaataacatatgtgcaaatgggatgtgttgtatgggcacataaaattggatgacctcgaagtgtgaatcgagcctagctaaagaattagatctaaaggttgcgcaacgtgcggatgtgaattagatctaaagaattaatagtactaattaatttcatgctacaccaaacttttctccacgtgtgaacattagtggacttgtggtgatctatgttacactgtgtcatgctcttcttcacggttaattaattcattaactgaacatctaatttgtcaagctggcggtggagatcgacggtttaaaaggagacacttttgttgtccttttgtcttgtggatgtggagaatgcgatgccatttctcgtcggttcatgcatgatacgccgtctttttagtttgtgcgctgggtatctgaagaaaaaaaagaagggatacaacacaatgcactccattcggttcacttcgcttgtaagttagtaattttttttcttcttttttttttggcctatataaacactacgagttcagtctccatttcgctgcagttgaagacttagtttgtagtttgtgcaggatgcagacggagaagaaggagtctgccggcgccgccggcgagaagccgccgagcttctgtgacaggctccagagagctttccacgcccgcccggcgttccggcctctccgccgcctcggcgtccgccacggccaggacgacgacggtggtggtggtgcgcctggaagtacagtagacatgcagcctgcgacgacgacgacgcacggcggcggcccaccgaggccggtgctgccaccggcggcaggccacgctccggcgcccgtcgtgctgccgccggcggtagtgaaaccggctgccaagcctgcgggcggcaacgctccggcgcctgtcgtgttgccgtcggcgccggctgcaaggccgccgccaccgtcgcgtcgccatgggcatgcacatgcgtcgacgaccgggagcgcacctgccgccgagaaggtggcggcaacgacgacgaggccgccaccggggattccggtgcccgtgccgccgccggctgctgctgctgccgctgatgtcaccaccgccgcggcggacgcgaaggagggcgatggtgacaaggagcagcaagggaaggggaagaccagggtgagctccagagtgcgcaaggccttctcctccaagtagagacacatcacaattcacacatccatggccaccgtagtgtgaagcagaagcaacccaataactaactactgaaaaatatgtaccttgaggactttgtgtgaacctaagtactctatccgttattgttttttaacgtatgacatcgctgaattttaatatatgtttgatcatccatcttatttaaaaatattatgtaattattatttctcttattatgacttgataaattaaatgatctttaagtctgacttaaataactttatatttttaaaaagttggaataataagaatggttaatgttttaaaagtacaacgtcatatattagaaaagaaggtagtatatttccataagctttgtaacactgctttatgcaaaatctgtgtgaagcagaagcaacatcgtttttttttgaacttttgcgattgattcatagcaataggtcagattttgttttctttttgcaaaagaagaggtgaaaatttttcatccgtcctaataaaaaataataggtcagcaacggtttgcacgttgctacgtgataactaaaatggactttcaactcctcagtcatatggctggggagattgataatcttccaactaacctgcatgaacgtattataactacaacgatgaaatgcatattaatagaggagaattaaaggtcttttaacttcaatttcacatcagctgagacttccgttttgcccttcaacgatcaaaattcatagaatgatgtggctagataaatgttgattgtgagagcacttcagccagttgcacttccattcactacaacaaaaaccttatatagaggctcttttgtagagacaattttcaaaatgcctttaatcaaaatgcttctaagttttgaagctctatagtttagagacactttttagaggcactttgaaaattgcctaaaatatttttactctagagacactttagagacatttttaggatactttgttaaatttatcttgtagagacatcctttcggcactttaaaatttgcctcatatgtaaaggcattttcttaaggcgttttaaacgatgtaaaggcatttttttttcaaatattaatatatatcaagtaattagatataagtaacacaaatcatatatttatatgtaattaaatgaggttgagatggttagtgtattgaagataaaaaatagtcaattcaagaggtcatgagttcaaggattggtaagggataatatttttcttttttttcatattgatttgctatagttgcctcaacatattaatgcctctacaaagtgcctctatttgcatagagacatcttacaaaatgactcttagtttgtagagacaatacaccaaaaggcacttatgagacactcttcaaaatgtatctataacactgtgaaggcattttataaatgtctctatagtattaggaaaatgtctctacaaggtatatttgttaaaatgtctctacaaggtatatttgttgtagtgattttggacggagctgaaaccatttggtttggttctagcttcacaagaggtaaagctagagttgagactgtgccaaacggacaaaaacctttgaagtaactattaattgggcgttcgttttgtttctcgaaaatcaggcgttgttttactaatcggaaaaaaagtttcatatgctagatcgaaaatgtttcaatctcttaaaatgttggaacacatttgaactacgactgaaacattttgatataacatatgaaacatccaatttcaccctaatagaacaccaacaatccatatcagtcaaggacatggatatgaaacaccatcaaaaccccattgcaatatttcctcaaaaatcgggtattgtttcacctctttgtaagaaaatgtatcagtacttgagaaaaaaaatcagcatttaaaacaatgaaacataaccgaatcacacttcaaacattctgctacagcatataaaacattgatttctaaccattgaaacatcaacaaactctgtgtacatcaacgattaaaatatgaaacattattaaaatatccactgcaatatttgatccaaacacgagtacactagctgaaacacacacaaaaaaaaaactggtttggactgcatctttctcctctccggcgaacacagggttgccgacaactacctctcggtgctcaccttcggtcttagcgggggccgtcagggtcacagaagaagaggacatggccatcaagaaatgtcgcggtgcgccagagatccaaggacgacgagaggaaggggtaggtgaaattgacaacattgcgagcagtggtgggttgttgatggcgcgtatccgatggaggaaggagggctcagtgatgacgcagcgaaagccggtgcaggcggtggcggtgcgggtgaggtcggcggtgaagagaaggcatgcggaatgagcgactgacaaggcactcgatatttcgttaggcatggggtgcccaagcctaatcgttttcgaaaaacttttagaccagcgggaacaaaggggaagtgcaaaggaataagtccactttgactcccttacgtacctagtggttgaatataattcataaccttaaaccgcaataccgaatatctcgacccctcaactattaaaagtggtgtaattttaactcccttggtgattttgaaggcagtttcattgacgtggctcctatgtggcggtgttggcgtgacgcttatataacattagaattaaaaaatacgtgggacccatttatcattcacaaaagaaatattgtgggacccattgacatggggatcccacatgtcagcctctctttctccttcctcctcccccctctctctctcccctttctctccctatccggtcgtctacggtgagagctgaagccccaggtggcaggcggcgggagggtgggcggtggaacggcggcggtagcggtggcggagcaagtcagggaactgcatcggcaggggaagtggtagtccaagcccgccaccggagcatgggccggtggccttggccaccaccttggtaaggttgaactcatgcccgggcaacgtggcagcgtcgtgcgggcgcacaacaacgttgcatggcaaagaagtatggcgcgcccagccatccacgttgtacagtgtgcggacgagaggtaggccaaccacgtagtcgtgttcggcttctccgccaccgccgctgcgggggtggcatggcctagcagtggcgtagggaagcgtttcgtgtcgcatgtgaaggcatgcgcgacaggtgcagtggcgtccacagtgagcgcatgcatctcgtcacaacggagaacgctaacaccccctcc

SEQ ID NO: 60419 - DNA, 1024 bp, Oryza sativa
atagacctatctgattaagttatctagcaaaggtggtacctctgtatagtggtttttcttaagtcctcgcgcaggaggcaaatttatgccgtgaagggcaactgtgatatttatcgaggcgcaggtaaatatatgagatgaattgtgcacaaattgtttgtgaaccctgattgcgatgacatggtgtcatacaatcagttctctctaaagacctcgggaacgccagaactcctctcgctgctgataacgttacgttcagagtgcatggggactagagttcatggaacaggtaccactaatgttagtaaccgaaaagctttgccatgacaaggctaatgtgtttggcacgtcatggattgtgggtaaagcgtacatctactgtttcttaaaactattcgaatagccgtgctcgcggttatcgggcattgggactcacaatggcatcttggttagaaacataattctagattttattaaatactgttgcattataaacattatagactttctacttctacattctcaactttctgcaattaaacctagctctacacatatattaccatttcatgcattcattgttgattaatataatagcttgctgagtacgttgtactcacccttgctttaacccccttctttcagagttaatttggaattcttgccgaagccgggagttcaattatataagttagtcttatataagttagtctcatctcaacctaattcgcaaatatagattagatagatggtttaagtctatagccaaacattagggtcaagtcattctatagcttctgttgtaatagttagccacaaccttgtaaataccctattatatcacataaagaagtctcctttggagccttgatcaaatgtatgcaatgaagatccagattgttgaacctgtatcaatctactgatccagggcttgatacagttaaacatgtcggtttccgaatcattagttctgggacccgacagcgttgatatcagagcatatgttttactagagccttaaacc

SEQ ID NO: 60420 - DNA, 12583 bp, Oryza sativa
  unsure (1)..(12583): unsure at all n locations
cctcgaggctagtttcctcttaagaaaactcgattttattttcgctttcttttttcagttggagaagaaatcggggggcgtttgcgatgcgagcggcgggggaggagggggtgttatctgaggaatgcaggtggggcccacatgctgactcagcttaggtatcaagggggtggttgggcccacttgccattgaccgttcgccgcctaggcgggaacgaaaccaccgggtgcttttctctctctctcttggtccccccctcctctcgcatttttggtccccgtttagtcaaccttattagcgagaaaaatagaaaaatactagctatggacagcattaaagctattactactatgttattatccagcataacattttctcaagcagctctatttttcaaacaatttactattggcatcccttttaacggtaaatcgattttatatttacgatgctaaaaaaaagaaacaatttcctaggtataaatttgagcatgagactgttcaagatatagttagaagtcttttttttaagacaaagaaggtacttatattcatataaatacatcttttttatggggaaaacatcaatattgttatgatagagttatagttgtatcactcgattcactacaaataacatgtttatttttaatagaattttaccaagactatagattcaccgttggtcttcgtctatttaagcgtatgctacatatgtgttcatagatgtgcgagtgtatattacgctggagtggtgcgcatgcgtatacgtcttctacgttatcgtaaagaaaaggtattatgtaattttatttgttaaaaagatgtagttaatagtgccaatgtaaattggagtaagtggttaacataaagatgtggcgagaattgtccagaaaacaaaactactccatccggttccatattaattgacgttttagacaagattaaggttaaacttttataattttgaccatcagtaacttaaaaaaatattaaatttaaaagaaatagaacaacgatttgtcttttaaagcactataataaaagtaaacatacatttatttattatatatattataatagaaaaataaggttaaagacatattttgtagaccgtgttattatccaaaacatcaattaaaatgaaaccggagaaagtactcgatactacaaagtggatccctagatgttgtgtgctactgcttcgctgtcaggtctcgaagccacacgttggggtgggttccgttcgaccagtagtagacagggtttcccttaccgccggtaaccgcacggttaccgggcttaccgtggggtacggtaatataaatactgcggtaacctccttaaattcaaataaatttaaaaaataatttaaatttttgataaattttgcacggttttatacggtttttcacggttaccgcgataaccgtgcttaccgctggggcgcggtaaccccggccctggcggtttgggaaaccctggtagtagaccgatcgctacgcaaccgatactcacctttctctctctctcgtcttgtgtgtccctgttgctcggccaagaattactcacctttccttttctcctcggacagccttgcaattctcgggatgcatcatcaggcggccaaccttgttgtcatcagctggtacctgctccagattttgcacgcatggcaaacagtgagtcattaatgctactaattgtgtgtgtgtgtgcccctaattaggcacagtttaggacagaagatggcgtgtagccaaatttaacaggggccggattgaaccggcatatgttgtttttgttatcccttgtcagacatctggggaggataagatagagatatgtcaatcatcggcctgatattttgaagtactcccaggagctagcatgcagaagctgctggaggctaccttagctagcttctgctaattgattgaataaatacaagaaaaaccatgtgttgaatttacagtggagtgcaatgctcttgtttctatggattcaatatttgattaggagtaaggtactatgtaatatttcatttagattattgagtgcagtatctacttaatggtaaataaatcaattttaaaaacaagtgatctgagtaatgcggtagaagtttcatcagaaaacatatttttctaaatgtgaagtaaataatctgttttactaacacgatgaataaaccgaaaagaacacggcctaaaacacacggcgtgtcgctatctgattgttaattattgtctgtgacaaactagtccctgtagaggtatcctgcgtgcaatcagggcagatggttaccttggattggaaaggggcctctcccagcatagctgcctcttgctgctcctcagctcttcatcatcccatccccagatctatctatccatccgtctatcctgttacatgatcatggccttgttagctactactccacttttcataagaataaagccatgcatcatggagagcattaggataacaacagtagtgctgaaaatatacggttgttatcacgattagagagagcagcacccctcaagtaacagtattcctgaccaatgcaaccagtagccacactgaaacgcaacaaaaaaggccccctgaaatcaacctttctttttcgaaatctaatacagtagtagagatgaacattctgcatggatggaatccacagattgcattctgaacatcaagcaagataaggtttggattctcgattctcttttcagatatacatgagcactgctatgaaaacagctggcggcataaaggaggttctgacttctgacgcgcctccagcctcctcatatctgcactgatacaacatgacgaacaaatttcagtgagttaatacagtgttcatacagatgtccatgattgtgtaattcattttcaaaatatctggcattggaaatacaagaaaaaaaaggaagagaaaataaatcgcaatgatgtaactgagaaacttctgaagcatacatttcttaagaccatcaggtcagaagcaccgctgaaagcgaatatcatgaaggatggagggaatttacaggagcatgatgaattcaagcttcttcacacaaacagttcagcatgatgttgatcaccaccctacttcagcttccagttaaacgccaccttagtgcttgctgacctcctttttgaacaaaattattgcttgcctgacctcatagatctgtttgcataccatttgcttgcttactgaatttagtcgttgcaatagaaagaatcctgaatgtcttacgataacaacttctactgctcatttggttgtcttacagaagggcataatcctggatgggattccaagataaacccaatcagaaaaaaaaaaaaaactaaccagatcaatacatcgtggatagctacactgtctgatcactaaaaagaattgaggtaagtaactaaggagaaaaaaaatcctaattgactaaaactaaaacccacgtgcctatacttttcgtatatcttattagggcaagttgcaagttgcttatggcaacaaaggaaagttgtacttattgcaagctgacatgaccagacaatttgcagggtgccctgtcaccatttgcgataagatctaaacatagatcatgcaaattacttatcacaaaaatcgctttcatatattaccaaaggtattccatgatcacgctagaaaatgtatcccgtgtggcctcctgatccataaaacttctgggatccagcgacaggtgcatatagttggtcatggctaaaccatatactgctgcctaaccccctaaaaaaacatctagggatcagtgaacaattgtgcccaagcctaatccaaggaaacaaaatagggatcagtgaaacttacaggctcatggaatgtaccatcttctgtatctcagaacagacgcctttatgtgaatgtgacctgtaccctcggtatttggtgnnnnnnnnnnnnnnnnnnnnnnnnnngaacataacaagcagtatcaacatagacatgactccaataataacaatcagaagctagcttagattaaactgagtaccaaaattcacaggcaaacacaaccagtctagaatatggagtaaacaaaattgcagccgcaaattaatgaatcaaacttagtctgttttacagaaccggtgagcagtttacctactagataacaaagccaaaaactgtatgtttcctacaaaaataatgaattgtatagctggtttctctaagagaagaaaatagtcagaatttcataggtatgaaggtgcaagagctcattgcaagaccatcagtttattataatattttagggtattatctatggaaaaatcaaaaccataaacctgggaacagcataagtgtatctcagaataagtaactgaaattactctgacataaaattatttgaaaatgtaactgaagcatcaaaatataaaacagacattatttattactacatcagttttgaaatgaagttccttttcttttctaagtagaccaaaaacgaactcactacataaacattgtgtgcaggttgctgttcgataatgcaaaaaaccgaagggaaagctacttaaatatgcaaatagatacatcacgaaagaatccttagaagaaatgtgctacattggaatatcaagttatcaccccgggtagactcctgaatatgatggtattaaccttttctgtcctgcctaaaataattaacagccccatcaaggtaacataaacctttggatatctgtcagccgggctagtctatatcattcttacatgatcagatcaactctcgataacctacttaaccttttttgggtggtgggagggtgtgtgtgtgttgggagggcggggataacatgcaaaaacttgcatatcatgtcattagaaagagagctgtccccaaacaaagtctggttacatagctacccaacccaagcggtgaaacagcagcacacaggctctgaggaaaaaaaaatcaaaggctaatatttcacaaagaagttttgaacttccatgccactttgtctcgccacgcttgcagcttctgtagcccagaagtgagcatggaagacgacctgttttcgaacacctttgccttgcttctttccatactagccagaggatgaatatcaggattgtactgatagccttttgggcttgactctaaagcatatagtaaatcattttgatcagtagaaatcagttcctagacttgatgaacccttcatctgagggacaagcctactatttagcatctcataaatttctgtacgttgtgaatgcatctggtcccttgagtagaaaacatggttccttgcgtttacttcaatctggctaaaaccaggagtcttcttgactttgcttcccttcataatcttccacacacttgccacctcattccacatcccaccagatgcaaaaacattggccaaaagcgtatagcctcctgaaccagaggggtcaattttgacaagatcctcacccacagctcttcctacctccacctcattatgtgtcatgcaagatcccagaagcgtccctagaatggcctcatcacacatatcccgctgcataccgtcaaccacttccttggcttccctcacgtaccctgctcgacctaggagatccacaaggcaagagtagtgctcaatggttggccctagtccataaacatggctaattgatttgaatatttttcggcctttctccactaatccaacatggttacaagctgacaacacagcagtaaaggtagttgagctgggcttatatccacaccttaacatttgggcaaagccctgcaaggcgcaaggtgcacacccatggtttgctaaagcttgtatcatcgatgtccatgttatggcatccttctcgttcaatctcctgaaagcaagccatgcagatgacagatcgccacttctagaatacattgaaaccagagtatttcctaagttagtttcgggctggtaccccagttttgtggacaacccatgaatttgtctaacctccattgtgctctcagatactactaagacactaattaatgtagtgctgtcaggagatactgctgagcggagcataagaagaaacaacctcaaagcttcgtccttcagattattcatggaatacccatcaatgatgatattccaagtcaccaggttctttgaaggcataatatcaaacaacctttgtgcatcattcacttggccatcattggtataagcagtgatcattgaattccatgccggaatatccttctttggcattctgtcaaagaactctcttgccctagaaacaaaaccattctgtgccaagccagtgaccattatagtccaagagactacattcttatgtggcatcttatcaaacaactgaaccgcgtcatccactttcccagcactcataagaccggttgccatggcattccaagaatatgaattcatctgaggcatcctgttgaacaactccaaagcctcctgaatacaaccattatcaacataggctttaaccatcactgtccaagcaaccacgttcctctctggcatcttatcaaacatctccctcgcttcccgtagcatcccattgtgtgcataaccctgcaccattgtcgtccacgaaaaaacattcctgtatggcatcaaatcaaacaggcggcgcgcttcgtccacaaggcccgcacggcaatatccagagaccatgcatgtccaggcgaccacgttcttcaccgccattccgtcgaacagcctgcgggcacggtcgacctggcctgccttgacgtacccatcgagcatgacagtgtcaagatggatcccccggcaatccggtggcgccgcacggtagagcgcctccgcgtggggaaggtcccggtcccagaggtggattccgaccatcgcggcgtacgcgacggcatcgtcccggcgcggcattccgtcgaacatggcgcgagcggccgccgccccacgctgccgcgcgagggagacgagtttgctctcatcagaatcggggtcccgacggaagcgtccccgccgcggaggatgagtgctctccgcggtgctgagacggcggcggcggcggaggaggaatgcggtgcggagaaggggacggaggaaagcatcggagacgccgcgccggagagcgaatcgaggaaggcgtttgatacaggaaagcctccccattgctaggtcgtggcagcggtcatgggcgggagtaccgagaggcaacgacgatggccgccggccgccggagaggatgttcggagtcggagacgacggaaggaatatgggttttttttaactatttgccactcttacgagtggcactatcgagataccactcttctaatttttttattacggaaacaccatgggagagatagcttttttcctatttagagtgtcatgtcagcgagagtgacttaaaatgactttttcacctctagtttgagaaatatgagagattatatacaaacctatgtaagaaaatattatatattatatctaaaaagagttattacaggcaagtgaacttggtcaacgtgtatttccaagtttgtgcggccttttctcagaaatagccctcgtatttatgtttcattcgaaagacagcccctaggtggatcgctaccaatccaactcgggaaccaatgtgagtaatccgattgagtacgcgcaacgccaattgggtgggaaacaattgtctgtgagacttttcgctggaggaattttttttttcagataatataaaaaaatttcggcatttacttcaaaagaagctacaaccgcttaatacaaaattctctcaagagagcataacaatccgacaacatcgaaacaaaaccaacacataaggagtaaacaattattgaagtctatttgtaaatcttcatccgtagttaacgaaaatatgtatgaccataacctttaagcttcgacatgcaaatagtatgaactccttactctcttcacactttttcgctgggagaataggaacaggcaagatttgaattgaaaatttcttcctcgttcgatcaacacatacttctggaactggaacgatcaagataacatcaaccaaactttcacacacatatatgttcagagaattacagattaagagaactgtgtgcattaggctcccacttttgatttcagagcccaaatgttcagaaattaagagagttgtgctatcgatcagttacagtgttgcatatttgatctcagcaatattggctgtcttttgcaagccccttctcctccacacgcgcgtgcaattatgttcatatcaagccctgcaaataatctcacctagacttatctatcaataatacagcattcagattatttccccccatatatgtaaactttgctcgtttgtttcttcagacatatatactgtgcatgaaggtaatgcaaatatcttacctgaagaaatccagccagcaccaccagttcttcagagaaatcaaggcctttctgcgtgcagaacaaaatagcagcaacgcaaactaagagcatacattgcagaacactgcaggcagctaagatcaaactaccatgctagtaacttgaaatgaaatgaaaatctccccgggtcagtgaggaacttcagtgttgctgtcatacacaaaaggtgagagagtgtttttcccccctattgacagttagattaattttgttcctacgaaaacagattgaagcttcttgcttccagaaggagtaattatcctgcgatctgtttgagacagagagattaagatagtgacttgagcgagtgagtggcagactggtaaaactggcgacctaacaaatgtctccatcgctcgttagcacatgcaattaagcgggatagtctccacatatatccactaattaattaataaacgttgaccagtatgatgtcgccaccgatatggacacagatcggcgtcgtaactggtcagagcaagcactaataattacgtcctaattaagtgtcaacaaatgctgcattatttacttggtcagtagaccactagaagccccggcctaagtactactggtactagtagaaccaaggtaacaaaattcttgaaattaatatcaaggtaacgaaaatggtgatcaatgatcaagtgccagcatgaatggttcgtacaacacttgcacctgctacgtatatactccattttgtagagttgcttgcagtttatagttcctctagaaatgcagacctggttggtcgagttgaatgtgtacaagtgttaattacctagagatcttgttgctagagaagaggtcgtcagagatatactactgcaacaataaatgtacatctttttgaagagaaaattagttttatatattcacgctagcaactgaagtctaaaatgtttgaccaaacatatatactctagatgtatatatagtagccaaactatttgagataaggatatacttacttggcaatgcataatttgctctactagttactctctttcttaaaaaaaaacttaattaatttgctagttgaccatgtatgtcgatggagaccaaaatgagtgagggatctagaagatgacacatgtgcatctctgattaatttcagcatgcatccaatgggtcgaaatgaaatggttcgtcagtttgtgcatgagcctgcgttgtcgcagccaaaaaatcgacgaggcaggcccatgcactagctaccttggtcaaccatggctgcagcttcaccttcactagcttggaccaagctaagcacagccatccattccattccatataacaagctagcgatcgaggccactcaaatccaccaacaagctagctgacaatcaagtcatcagtccatcaatggcgatggcgtcgtcgtgttcaccactagtagccgtgctggtggcgctgctgctcgtggcggcgactgtgccggcgccgtgcgccgccgtggacccggtgaacacgtactgcgccaggaacctgagcggcgcgccggcgcaggcgagcgtggcgcaggtgctctccgagctggtgccgcgcgcctccgccggctactacgccacggccaccgccggccgcggcggcgacggctccgccatctggggcctcgcgcagtgccgcggcgacatcccggcccccgactgcgcgctctgcgcctccgccgccgccaggcagctcgccggggcctgccgcggcagggccgacgcgcgcgtctggtacgactactgcttcgcgcgctacgacgacgccgacttcgtcggcctcccggacaccggctacgcgctcatcctcctcaacacgcagaacgccaccgacccggaggcgttcgagaaggcgcagaggaaggtgatggcgcgcgtggcggcggacgccggcgacgcggggggcggcgggctggcgagggagaccgcgaggttcaaggacggggtgaccatctacgggctcgggtggtgcacgcgcgacatcacggcggcggactgcgggctgtgcgtggcgcaggcggtggcggagatgcccaactactgccgattccggcgaggatgccgcgtgctgtacagcagctgcatggcgcgctacgagacctacccattcttcttcccgctcgacggcggccagagcgccgacgcctccgcctccgccgccggcgactacgacagggtcgtcttgaatccgtagattatttcaactctctataatggccatatatataataagggtatcaaaaaatcccatatattactactaggagacgcattgcaggtttatatgtttacggttgtaatccaatttatctcataattaactaaataaataattcgccagatgaacgaaaaagtctacttcctctattttttttaaatagatgattcaattgacttttagcatcatacttgattatttgtcttattcaaacaaatttatattttaacatatttatattaatgttttaaatagcatgaatgatccaacgttatttcaaaagttaatggtgccatcgccctactctaaactgaataaaaaatcgttgcaacgtggacgtgcctatagctgagggaggtaaaatatactttttgttgatgaataatctgcttcacaaggcccacaaataaatcagatggaaatgtgcctcgatgaggtccaacccactaccaccggcccaagtttggtacgtaggcccaagacgaaacgtcagcgtctcagcgaggtgcccttaggtcgggagttcaccagcgccgctgccgccgccgcttccctccgcctggagcgccgctcccaacgacggcgacgacggtcagtatatctccgacctcacctcgccgcacgccgccttctcgtatctacctctccgccgcttggcgccagcggattctggttccgagtccggccttgcgagcacgccgccgcttccggttttttttttttttttactcataaatcagctctccccctgcaggatcgccggcgggtctctcatttcatctcctcccatcttccgacgccgccgtcggtcgtctgctggtggcacgcgggttctgttccgctcgctactgaccggtgcggcaccaacctattccccttctctttctttctttcttttttctttttctaaattagcagtttgacattaattagatgcgctaattcatagaagaaacttgaatttgatgcactattacatgtactgtgttcaaattccgatcgaaatcatctcgtgtacggagtaaattctcggtgcctttcggcctcttcgtgctttttttgcctactaaacttctgctcgatcttgacaatataagtttgagcaatgatcctattttgcttctgacatgggttcctatgtttttagctttaatggtgctaatgtgatatgtatgtatatttctacacgaatatttccctgcttttgacatgggttgttcaaggaaatcaatgccacattgcatgactgagcactatagcttctatgctgtatatatatgctccctataattgtgtcaattttgtatattctagttctaacaaaacatttctgcctcttgaataaaaatatagggctagttctacatgctgttactgaaactaaaactttgactaggtagttaactagtactggtaccaacatatatgactgatagtataagtttccaatcatttgttagcaaataattcttgtgcgcgtggttcatttctttcttgttctgttgagtcagcgcatggtggagttagttggttgtgcacatttgtagctcgaagcatgcatgttcatgctggaatgggtcattagttagtgcatggtgcagcacaccccgacgtttgggatggcagaagaagtggatgggcgtggcactcgtggcatcaaggacatgatctagtttctgttttgtctatttaagttgcaatataaggtcaagaaaagctgctgctttgcagcaccaaaaactctccttgtgttcaattcttttcatcaggtgttccactgatcactatgtgtagttttctctgacatcattgtgactcttgagtttttctgtgttgaatcattgtgaggtgttttacaaggcgagaagctcatgaggagaaataaaatgtgaatgtggaacatgct

SEQ ID NO: 60421 - DNA, 4291 bp, Oryza sativa
ggggtcgggccgctcccgtttcgaccccgagggctggggcgccccgaccccctgtgggtttggcgccacgtgtgtgggttaggtgagcacagcggcgctcacctaaccgcgtttatcgcgggttggacgagcgtcccacaccgcatttaatgcagcgcagcacactcgttcggtccgtgacaggtcacagtgtgtgaccggttacagaccggtcagatcgcgggttaggtggcaacaggcggcctttcgcacgcctcgccccgtcccgtcggaatgataagagcttcctggctctcgtccctagccggagccggcgtgctaactcttggagttggtatgtcagtcccggtcagatccattccaggcttcagcgcaagcatggcaaggaagtcgctggccattgaatgaaggttgaaatgggcgtccaccgggaaagctggcgaggggggcaggaggcgtgtgctctgcttgtcagaggtcacttccggctgtagactagccctcattgtaaaaagcatgtttcctttcttaggcagctggaggcccttgtggtgacccctgaccagataaaaaggaggcccaggcctaggagaggagagggggagggagaaaaaagggaagaggggttgggactctagcgaatgggttctagaccctgaactctcgctcgctaggagaggagagggggagggagaaaaaagggaagaggggttgggactctagcgaatgggttctagaccctgaactctcgctcgctctccggctctctgtattccttcacgcacagatccaccagaacacaggagtagggtgttacgcttctcagcggcccgaacctgtctacgtcgcccgtgtcttgtgcacttcctctctcgcggacgttccttagatcgagggcgaagaacctcacttagcgcccccggccgaaccggcaaaggggggcctgcgcggtctcccggtgaggagccccacgctccgtcaaagtgctatgggtaataataccaccttcgaaatctaagtgaagaggtctcaacttaaatacggagctagtcgagagtctctgttgaccggttgagatggtgcgcggacaaccaggcggggcgaggcgaggcgaggcagacagttgctgctgcgctctctcattttgtaacagacggtaataaacacggagaattgatttcgtatcaatgaacgcgtcggttacggaattaaacgccgtgaattgatttgattccgtcggttacggaattaaacgccgtgaattgatttgattccgtcggttacggaattaaaggccgtgaattgattccgtcggttacggaattaaatgccgtgaattgatttgattccgttggttacggaattaaacgccgtgaattgattctgtattaacgagcgcgtcggttacgaaattaaacaccgcggttgatgactccgaacgttactctcgcgctcgcatatatatactccgcagcgaccagaacgacgacaaagttcttcacgactcttgtacttcgagttcctcctcctctgttcctgagctgcagaatccttccccggttctgttcacctgcacgcacaggtgtacaggacgagcaggtgcctccggaactccgtccgcttgagaacttgcacgggtagacgggcgatcaagtttttagatagcgcttcaagcgcgactgctcctgttcttcgcgactactactgctgcatcgacgccttcgtcaacatgtcgacggagattggagacaaggaggtgaacgacatcaacggaggcaatactgcctcaaaatccagcggtgggacgttcttagggtatagtttcattctcctgattctattagatgtttctttgttgatgttcttcgcaatggcagcattgcgttactatgtaaatgttgatgcgtatttcattttaagcatgctcaagttgtatacatcaagcattatcactagatctactcatattaaaaatgtcatgtttattgtcttaatattttggattagaatatgccgaattatgaccaaatttccaacagacgtcggccgcatgtcacttcgctgacatcaaacacgagccgaactgagatcgatgcccaatcagaggacgagaccggcgccgtcatcctcctcctcacgctaccatcgccgtgccttcctcgtcctcctccggtgaaccgacttcccgaatcctataaatagccggtgaagccctctcttttccccacatcatccgagctctacgagctctctcttctctctccaccatgaccggccaccactaagtcccggccgatctcctcccatacagctccacttctcgaatccatgcaccactagtctctcttcactccggcgaatccattttgtccatttcccccttctctctccctccaaactaagccaccaccattaccaccttagccggccgaaggtgagctcgtgttgccgctgttccggctaactcacccttcctctctcccagccaccaccctccccgggtgcgcgttgctcgggaacacgttccgccaccgacgtcgccgtcccccatccactggagcaccggcgtccctctctccctctcctctcgtttactcggctgaaaaagaagaaggaagatacgggaggaagaagaagagaaagaaaaagaaaagaaaacaaacactgacaggtgggcccctgcacagtaactctcctattttccctatttaattcaaatccaattctttagaagcccatatctcctaaaccgtagatccaattccaatgaaacctagatctaaattcatctaaattcaaaagctatattttgatacctaatttgctattttataattttatttgaatttattcaaatatcatttgaatttatatttgcctttttcaaatactttcttttaccccaaaatacctattagccactaaaatgcggccggttggaactttacgtcttccatggggacgtttgcggtctattggccctgacgtcgaaccgttggttgtaaagcctgacaaaacccaaaccaaaggtcgaagtgctgctcctggcatcttacgcctcgctgcgtacaacggtcggagcttcactattccctcgaccaccatagcacactgcacagttagctttcgggccctgtgtgatcctagccgctccgccgccactcacggttgtcggagtaacacttccgcctcgctaaacctgcacaaacctcccatccctctagccgttatattgtctattgacaccgactagagaagataccaaacctagtcgtcatgctttagcgatgactagcgaacacccaaaccctagccgatatttatcttaccttgatatcggcttagacaattgaagccagacccccaccagctataatctcaaccatttaccctccaactacccatagcatatacatgaaatacgagccgatatgctatcctatttcagcatcgactcgagaacaactaaatcctagctattcttctaccaaagccaacctcgatcaatactagccacatatccacttaaccagttagattattcaatatatctcctactctccaagaaaccaaaacccacacatgaaatataagcgacattagttgcttaatcccctctagcctccaaccctttagaacctccacatataatattagctcaataatccctatgtcctataaaagagataggctatatcctaaaaccaagccctctttaccgtttatcgttttctcgttattttatgacttttattgaatttggttcttcgtctttcttagtagagtctattatcttttggatggcaacctgtggtatttcgaggatcggataatcaggttgcttatcttgaatttatttgcgttggagcaaggcaagttattatctctctcctttgagcataattatcctttattctatatctccattatctcatgcattagtcattcatgatttcgaatgcgtaacctgaacatagcaaaccagatatgctagctttgcttagccctgcctaattggactgcataaaatataatgaacttagattggaacagtatggtagaaatggttgatttccaggtggctagtactgttccaaccgacataaaactgccaagtacatgtgaagaacatacgagtacgaccgcaattctcgtatgggcatagacctagctgattaagttatctagcaaaggtggtacctgtgtatagtggttcttcttaagtcctcgcgcaggaggcaaatttatgccgcgaagggcaactgtgatatttaccgaggcgcaggtaaat

SEQ ID NO: 60422 - DNA, 20900 bp, Oryza sativa
attccgtcggttacggaattaaaggccgtgaattgattccgtcggttacggaattaaatgccgtgaattgatttgattccgttggttacggaattaaacgccgtgaattgattctgtattaacgagcgcgtcggttacgaaattaaacaccgcggttgatgactccgaacgttactctcgcgctcgcatatatatactccgcagcgaccagaacgacgacaaagttcttcacgactcttgtacttcgagttcctcctcctctgttcctgagctgcagaatccttccccggttctgttcacctgcacgcacaggtgtacaggacgagcaggtgcctccggaactccgtccgcttgagaacttgcacgggtagacgggcgatcaagtttttagatagcgcttcaagcgcgactgctcctgttcttcgcgactactactgctgcatcgacgccttcgtcaacatgtcgacggagattggagacaaggaggtgaacgacatcaacggaggcaatactgcctcaaaatccagcggtgggacgttcttagggtatagtttcattctcctgattctattagatgtttctttgttgatgttcttcgcaatggcagcattgcgttactatgtaaatgttgatgcgtatttcattttaagcatgctcaagttgtatacatcaagcattatcactagatctactcatattaaaaatgtcatgtttattgtcttaatattttggattagaatatgccgaattatgaccaaatttccaacagacgtcggccgcatgtcacttcgctgacatcaaacacgagccgaactgagatcgatgcccaatcagaggacgagaccggcgccgtcatcctcctcctcacgctaccatcgccgtgccttcctcgtcctcctccggtgaaccgacttcccgaatcctataaatagccggtgaagccctctcttttccccacatcatccgagctctacgagctctctcttctctctccaccatgaccggccaccactaagtcccggccgatctcctcccatacaggtccacttctcgaatccatgcaccactaatctctcttcactccggcgaatccattttgtccatttcccccttctctctccctccaaactaagccaccaccattaccaccttagccggccgaaggtgagctagtgttgccgctgttccggccaacccacccttcctctctcccaaccaccaccctccccgggtgtgcgttgctcgggaacacgttccgccaccgacgtcaccgtcccccatccactggagcaccggcgtccctctctccctctcctctcgtttactcggctgaagaagaagaaggaagatacgggaggaagaagaagagaaagaaaaagaaaagaaaacaaacactgacaggtgggcccctgcacagtaactcttcctattttccctatttaattcaaatccaattctttagaagcccatatctcctaaaccgtagatccaattgcaatgaaacctagatctaaattcatctaaattcaaaagctatattttgatacctaatttgctattttataattttatttgaatttattcaaatatcatttgaatttatatttgcctttttcaaatactttcttttaccccaaaatacctattagccactaaaatgccgccgattggaactttacgccttccatggggacgtttgcggtctattggccctgacgtcgaaccgttggttgtaaagcctgacaaaacccaaaccaaaggtcgaagtgctgctcctggcaccctacgcctcgccgcgtacaacggtcggagcttcactattccctcgaccaccatagcacgccgcacagttagctttcgggccctgtgtgattctaaccgctctgccgccactcacggttgtcggagtaacacttccacctcgctaaacctgcacaaacctcccatccctctagccgttagattgtctattaataccggctagagaagataccaaacctagtcgtcatgctttagcgacgactagcgaacacccaaaccctagctgatatttatcttagctcgatatcggcttagacaattgaagccagacccccaccagctataatctcaaccatttaccctccaactacccatagcctatacatgaaatacgagccgatatgctatcgtatttcagcatcgactcgagaacaactaaatcctagccattcttctaccaaagccaacctcgataaatactagccacatatccacttaaccagttagattattcagtatatctcctactctccaagaaaccaaaacccacacatgaaatataagcgacattagttgtttaatcccctctagcctacaaccctttagaacctccacatataatattagctcaataatccctatgtcctataaaagagataggctatatcctaaaaccaagccctctttaccgtttatcgttttctcgttattttatgacttttattgaatttggttcttcgtctttcttagtagagtctattatcttttggatggcaacatgtggtatttcgaggatcggataatcaggttgcttatcttgaatttatttgcgttggagcaaggcaagttattatctctctcctttgagcataattatcctttattctatatctccattatctcatgcattagtcattcatgatttcgaatgcgtaacctgaacatagcaaaccagatatgctagctttgcttagccctgcctaattagactgcataaaatataatgaacttagattggaacaatatggtagaaatggttgatttccaggtggctagtactgttccaaccgacataaaactgctaagtacatgtgaagaacatacgagtacgaccgcaattcttgtatgggcatagacctagctgattaagttatctagcaaaggtggtacctctgtatagtggtttttcttaagtcctcgcgcaggaggcaaatttatgccgcgaagggcaactgtgatatttaccgaggcgcaggtaaatatatgagatgaattgtgcacaaattgtttgtgaaccctgattgcgatgacatggtgtcataaaatcagttctctctaaagacctcgggaacgccagaactcctctcgctgctgataacgttacgttcagagtgcatggggactagagttcatggaacaggtaccactaatgttagtaaccgaaaagctttgccatgacaaggctaatgtgtttggcacgtcatggattgtgggtaaagcgtacatctactgtttcttaaaactattcgaatagccgtgctcgcggttatcgggcattgggactcacaatggcatcttggttagaaacataattctagattttattaaatactgttgcattataaacattatagactttctacttctacattctcagctttctgcaattaaacctagctctacacatacattaccatttcatgcattcattgttgattaatataatagcttgctgagtacgttgtactcacccttgctttaacccccttctttcagagttaatttggaattcttgccgaagccgggagttcaattatataagttagtcttatataagttagtctcttctcaacctaattcgcaaatatagattagatagatggtttaagtctatagccaaacattagggtcaagtcattctatagcttctgttgtaatagttagccacaaccttgtaaataccctattatatcacataaagaaatctcctttggagccttgatcaaatgtatgcgatgaagatccagattgttgaacctatatcaatctactgattcaggacttgatacagttaaacatgtcggtttccgaatcattagttctgggacccgatagtctggaatgtaatttttatgttagcatttaaatatagtcaatatggatattaaagtattgttttcactaaaaaatatagtagttcaaacatatcacaagttgaatatgtgatttaaaaggttataattattttatttatattgttcctataaatgctagtaagaggagaaagagaagaaaaggaaccatggaagagctggctagacctgatatgtggaggtccattaatggttttctccccataaagataatttaaatttcaattatcataaggataaaactaagagaaaaggatgaacgacgcacaccacatggggatagggagggccggatatttttcttaaaaaaataattgatatgatgacctaaaataatgcgttgcatgtttaagtcgaaaccgatagtcaggtgttttgttttttatcataattttgtacgattcttttaacttatgagagacctgtatagtggcttagaaatatttataggatgtttaatgtataagtctttaacattgtttgggtggggagcgtggaaagaaggtttggtattgtcttaaataaaaatctaataacaacctaaatggtacgtccatcggtttaagtcgaaaccaatgattagatgttttgttctgaaatttttaagatttttctctaatttagaagtgtcacatagtgttttagaaacatttataaggatggctaatgggttttaatgctgcataggatcgcggtgggagtttaggatgttttttttttgtaagaaaaagatatatctaataacctaaaataatgtaaacgttactcgaatgttttatttttttagattttctctaatttagtagtcctatatggatgtttaggaatatcccttctttctataaagttaagacccaaagctgcctcttcaattcgccacgtcatcaacattatattagccgttcgatcaatatgtacatcagatatacaccattggatcccttatcctcttgcccagcatgcatggtaatcaccttgctccttcccattcccctcccttaatcacatgcattaatttacagtagaaacagccaaatcaattgagccaggaggtgcgatggttaataagattcatgtgcctcttgcgattctcttccaaaccttttaataagcccctttacaatccccactataaccaagtctcttcccctttgcatgaatcttttcatcgtatgttggattctatttggtaagcctgaatttaacatttattttaaccagattctatttgagtacacattatgatttgaaccaagcatgagcactatgaaagttttgtccattggtttctctgaacttcaagaaagaatccctatcctatgcatttattgttgttttagtttcttaagaaaagattcgtcatacttgcagccaatacttatatgtcctatcactaatttatttgagtagttgggaaggatatagaggattacaatatagctgtcctgacatagcgagaagcagcttaacttgctcggtatgtattttgttttcaggttcaaacaatacaatctaattgtccatactaatatgcatatttacatacgttctcaaatgtgcctgcagcgaagcgcggggtttcatctagtttatatgatgtgtaatgaacttattaggagaggctagaggaagagctaaatagatctagtaggttaatgcttttaaggcctgtaatttttttaattttaattattatggaaataaaaaaggaaaagaaaggaaatggagggatcgtacctacattgctgtgaagatgaataatgcgtacgttgtggaggcgtacggtagggatgaaaaccgatcgaatacggtcggaaactagctctatcatatttgttttcatattttttctcggaatcgaaatcggaatcggaaacccggatacgaaaacggaatcgaatattatcgaatacagatacggagcgaatacgaatcgaaatgaatacggtaacgaataattatcaaaatatcaagacccctcaaaataagcttcttaaaacgaggaagagatgtagccattagttttcaaaaacaaaacaatagtattctcaagctgttgactgagttttcagggtggtagatgtctaagctaatctaatctagcaaggcgatttagccaataccggcataaaccctaaaacgagaagcagccgatagagctaaattgatatgctaagactagattaacagagacatatgataaataggtaggcaaatatatcatccaaaccagagcaatccaagaggtcgaatgtactgatgcagccttgaacaacgccggcatagacgatacaattgcctaggccgacggaatattgaacttaccccttcgccggagatcgaacaccgatgcagccccgcatcaggtgccaagtcccgccggacgataaaataaagtagaaaaggtaaaagggtggcgatgcgccgaattgtattgatcgtcgagatagattacatagaccccgggtgtacatatttatacccatgggttgatacaagtccttgttggacaagaaagaaactttcctaaagataaaaggaaaagataaagtccttataactaaacacactttcctaaagataaaaggaaactaacaaactattcctaattaatagataacttgccatgccgcattctctttgaactcggtctcttctggataagcttcctttagtagatcaatttccttaaccgaatatagcaagaatccgacaactgacgacttgacaactctcatcggctaatctcaggacttcgaagccgatgctgactctaagccgatgactacttcgggctttccaaattccactgttaacagtcatgtatcaggtcatggatgaaaaaacgccgaaggaaatttgggacaagttggcaagcctgtatatgtccaagtcgctgacgagtaagttgtatctcaaacaatagctgtatggtttgcagatgcaagaggagtcagatcttaggaagcacgtggacgtcttcaatcagttggttgtggatctaagtaagttagatgtgaaactggatgatgaagacaaggccataattcttctgtgctcgcttccaccgtcgtatgaacatgtggtgactaccctgatgcacggcaaggatactatcaaaactgaggagataatttcgtcgttgcttgcacgagacttgagaagatcaaagaaaaacgaggcaatggaggcttctcaggctgagagtttgctggtcaaggcaaagcatgatcatgaagcgggggtgttgaagagcaaggagaagggggcacggtgctataagtgtcatgagtttggacatataaggaggaattgtccgttactgaagaagaggaaagatggcattgcaagtttagcagctcgtggtgatgattcagatagcagtagtcatgagattcttacagtgtctaacgagaagtctggagaagcgtggatgttggactcagctagttcctatcacgtgacatcggagcgggagtagttctcttcatacaaatctggtgattttggtgttgtttacttgggcgatgacacgagttatcgtgttgttggaatgggcgatgtcaagttcaagatgtgagacacgtgccgggactaaggaagagtttgatttcgcttgggagcctacatgagataggttggttgtatcaggtggattctgataggaagaccatgaatatcatgaaggacggcaagactgttatgattggtgagaggacaagctcatgtttgtacaagttacaagggagtgctgttgcaggtggagtcatggaagatgggtatgctggtgttgctgtgcacgatcctgaaggcggcgagcctggcgtaagctcgtcgggcggctcggcgtgagctgcggcagaaccaactcaagtcctggtacacgaaggttcgagctagtaacagattcggattggcgtggcatattcgccaaggtggagtttgttagagtttgtgtcgaatatgtgtacgtagtcggttacagtttaggacttggagttgtaataggtattaggactagagtatgagttggactctatcctaggttctctcataaatagaggagcgtgcctgttgtaaccgcatagcgacttagcatagcgagagggagcggctgccggcggcgaccggccgttagtcgttgtaactctgatacgctgtatatgctggatcggggaggagcgcccgtaatcagtaccccggagatgtaggccttggctgaactccgttaccaaatatcgtgtctcggtgtcgtcatcgttttggatctcctatggtgttttcttccgcggtttggtttccggtgtgatttcggggccggttttataacaccacgcatgccacacgctcgcacgcgcacgcacgaggacgaacgacgaacgaatgcacggacgacacctccagcttcccgcctccgtatttccttcgtttctcaactagaaggctcaagactggaggcaaaagaagcgcaatttcaacctatttcacctcctcaaatccgcccctactcccactaactcaatcgtcgtcaccggaggaaaattccccgaaactctaataccggcgccattgattgagctccaaaattcatcgcatacatcgccaatcctctgaaattgaaggtaaaattggattctccatgccgagtactccatttcccctctcattacacatccaatccatcgccggaatgctgccggcgctgcctcccggcgtcgccgctctgttcggccgcagccagccgcatggcgcgccgccgctccagggcgccctagctttggccgtcgccaccctgggactcctctcgcctcactaaacctcaccaggccgcctcccgcaccggagtttgccggagtcgccgccaccatggccgcctccgcctcctattactgcccgccgccgccagcctcgccaccggcgcttctctcgctgccgaccacaaaaacggaatcgcctcgacccctagataacaaaatcggcgcccccttgtccaaaaccggcctcctctgccgccggcaatgtgggattccggccagttcatgtgcagaacgagaagaacaggaaatccaattttcctattgaaaaataaatcagaaaaatcctttttatttttctatcaggttgaccatccgtttgaccttaaaatcgaaatctgagacctattccaaactcctagaattattctgaatccatcagtatcagttttgttgcaatccgagcacccgttgtcgcgaccctaattttagccctagggttcgccattctccgaaattccaaaaatccctaaatttaattatttaaaatcctttccacccattgttgcactttgtgatactattttcttttgtttatctttgtttttctgttatttattgtggtgatgattgttgcgtaaatagaaaacgctgacgttggtccggtagtcgaagcgagtgaaatctccgcaccaggaggagacgatttgtacgactacatcgcgcccgaaggttgcaagacatgcaccctcccttgaacaatttaatcccagcagttagagagttattttggtagcgtacttgtcctttggagtatgatagactgcacgaattattttaaattaagtatattactattattgcattatattttctgttgttgttataaacaccttaatgagccttagagtctaactaacttaggataaaatttgagaaacacttaaacaaactgttaattatttaatatgatattgatttaatatggatattattactgcatatgaaaacatgcttatggaactatttatggctatatgctaagaattgatcacaccacatgtgagcgggtggtacacatgatagagttcatgtgtttggttttatggacctgcttatggtcatgatggatatatggatatatttatggttatttcttatttaaaattgatataataatcaacccccttgtgtcaataagaatgacatagtttcgcccatccacacgatcgatttgtcgaacctgcccgtatattgctccaattgattgaacttctgcaggcctttcggtgcactggccattagctttcaagtatgtgaagcaaagtgacatggttcatgtttatatgatttatatatgtgggctcgatgggccccgagagttcagaattaccctatgggtccatgaagttctaggctgcccatcgagtaacgaacaatggtaagtggatgcggaggtaggttggcacacacctcggaccagatcactccgagcaacatcccgagcatcctttaacttataattactaggcagaagggagagatatatggagcaatattacaccttgttacttttcagcccggccagctgtgggtatcgtgtgggtaaagctgggcagacactgcagagtcgttgagtattcgaatacgccatgctcccggttaatggagatgtgtctatgggtgattcctgattatgggcacaagttaaactaaatggctatgaattaatatggttaacttatttattatttaatgttctattcatgttatttataagtaacattcatacttttatgctcgttattattgtttaaattaaatgttcaatagtgttgtttataacaaatgcttattaagataggctctatgaaataactgttaaggttagggtttaaaccttccagctctcaatactgcatgttgtatattgcaattattgtatttattatcataagcatgtcttgctgagtaccatttgtactcataaatgggttcagatcatgaagaggaagatgcatgtggagaacctgttgatctgttagagtgggacaactatggtttctaggtcatcctatgctcagacagttcctgtggtggagtctagcagtttatctgtttgtagaaataaggctttataggccatatatgtaatggtttgtatttatgttgtgttgtgaattaagtgacttaagtattgtatgatggaagtttatgcttttatatcatttcatgcgtaactgaacatcctgggcggttacgtattcgtgggtgcaccatgactttatcgggtgtccccacactcgagcggcgcgccgtgcggcggcggcgtcggcgggccccaacgggttgtggcgggcgtgctcgcgcggcgggagggctcgagcgacgcgccgcaaggcggcgacggtggcgggtgggagccgtggccggcgacggcgtcggccggcaacgggcggcggcagcgggcagttggcacggccggctagccggctaggatttctggtttttttttttgctgaaaaatatctccggatatccgatgaaaaatgccagatagtttccgaccgttttccaattccgtcggatatcacccttactgtattcgttttcatatctgagaaaaaaaatccgaattcatttctgaatccgagaaattccggatatttccgaccgaatttttccgaatccgaaaattggtccggacggacggaaagcatccgaaccactttcatccctaggcgtacgtggacggagggagattttattttaatggaaagaaaaatctaacattaaaattattgggttcaccaatttaaatgtaaatcgatggtcagattttttatatgatgtgtaatgaacttattaggagaggctagacgaagagctaaatagatctagtaggttaatgcacattttaggcctctattttttttaattttaattatcatggaaataaaaaaggaaaagaaaggaaacggagggatcgtacctacattgctgtgaagatgaatagtgcgtacgttgtggaggcgtatgtggacgaagggagattttattttagtggaaagaaaaatctaacataattattgggtccaccaatttatatgtaaattgatggtcagatttttctattttattaaagtgacatgtggcgactcggggagagagagagagagagagttcaaattaatggatccactagtttgaattatctacacttcaaatctaatgtttaagatagtaggtttctggaaatggaaatggacagtaagttgtttcatttcttttatattttttctacattaaaattagtagctaccttcagaaattattagctatagaatagaataggattatataggaaggagagatgtagtactagaggaggaagcgtacatactacgtgtatgtccgtacgtagttgtagtactgtgggccggtgggagaggggataggagggagttgggttgtgggcttctttttttaaagataatctaataataaaaaataatgggtccacccatctattaaaatgccacgtagcgattgaggagtatttatagaaataacacgtggcagtttaggaaagtttgtaggaagtttaatgtacttttagtatataatagatagataatagataataaacttgtagaagttgaattttaacttgcattttgtggattgatatattacatattgatctatcttattcatatttttttaattttttttataactatttagatgacgcgcaataaacgggtgtatgtccactcaagctgttaaaacagtttccctgtatacgtggcaacgtccttcgataagcagagagactgacttcctaccaaattttcttcccttgcgaagcgtggctgatacgcggacaaggctttaccatttttcaatgctatagctgttgtgtattaaccttcttgcgaaattagcttttccaatacaaaacccaaatgcgtgcgttattcaagaacacataataggttatttcaggcaccacgtttcaaggttgggcaaattgctaaaacagaaaattatttctctcggcgtcagcatttcatgagcataatgtgaccatgcagcttcaagaattcctccaatgctgtcttggacgaaccaccgtcctccagagttcgaccaatcatcccctgaatctgcttcacactctgtcgtatcttgtccgccttcgccgtaatccccatcaccatctccacgacctcgaccaccctctcacgctccagcgccggggagtccggccagttcccgcgggacacctccacgcacgcgccccactcctccagcatctgggcgttgaagaactggtccgccgtgagcggccacgcgatgattggcacgccgtgcgccatgctctccagcacagagttccagccgcagtggctcaggaacgcgccggtggacgcgtgcgcgaggatgctcacctgcggagcccacccgtggatgagaagcccaatgttcttggcacgcatcctctcctcgaacccttccggcaaccactcggcgctgaactcgcggccgttggtggtctcgatgtcaaacccgaacggcggacggatagcccaaatgaacggcctgccggtgagctccagtgccatggcgaggtcaaccatctggtcaggccttagcgagttattagacccgaatgagatgtacagcactgacctctcttctcgggtgtcgagccaccgcttgacgtcatcgtcgttatggtcaccgatgtgatcggagtgctccgtccggcgacgcactagagggccgatgggatagaccgggacgcccatcgttttccggagcatgcgcagcccggtcgtctccaactcctccatcgtgctgatgagaatcgcgtcggtgtcgtacccggccgatgtctgccggcggtggtgggccgaccaccggtccgtgccgtcggcgtggagtaggtaaggcggaagctgcgaccggtggacagtaacctccgggtggtccgggaggcagaacgcgtcgtcaccgggcgcacgcaggtgcggcaagtggttccacagcgagtggaacaccacgctgccgaacgcgccgcaggagacgaagatggcgtgcgcggcgccacgccggcgggcgacgtctgtcgtccacgcgaggaaggggtcggcgatgacgcagaccctggcaccgttcgctccggcgtcggtgatcaagtcacggacgaagctgtcgaagctgtcctgtagcgagcgcgactcggtggcctcgaacagcgtgatgaagtggaggagcggcacggcgtcggtcgactcgatgtctccgggcaggccgtgctcggctggcgcgaacggcagggcgtggaaccggaggtaccgcgtctgggagctcgaccggcggcggaggtcttccacgttgcgcggggtggagacgatggtgatgtcggccgtgggctgggcgtcgtggaggtgggcggcgagggagaggaaggcggagaagtggccctgcgccgggaacgggaagaggacgatgcggaagctgccatcgctgggcatggtgaacacgttgttctttgacttcgaggttctccactggaaggaaattaaatttttgctttgtctgaaaggagaggaagcacgacagcaccggtcggtgtgtgtgtggcaatggctctgggtggacaggatgaacgatagggtggggagcgaggctgggaaggatgcgcttggcagttggcagacaggctttgggatgaacgacgatctcgcggcgtggggcagttggtaaggcttccgacgcgggatggggcagggaagcaatggtgtcgtggacttgtcctttggtttcctgtccgtgagatcgtgacgtgaggtggggccgttggatttgatggtcggggtacgacgcagcgcgattccgggcagaaaaagggcccttgccctgtttgcgccacagggctgatgcgaatgcgagggaggcgtcggcgtcgctcgcggctcgggtgcgacgtggtgctttgcgtgcggcagcggcgcacggcaggctccggcttgaagggcgggcggtggtcaagagcgggaccggaggcgacgtgatgggacggagtcgtttgcccggcgtggtgtggcgacgagtgcgcaggagcagcacactggagtatagcaggcgcggcgctgcatcatgctcgcggtcgtgggcgtgcgtcggcgcgagactttggagggcgaccacggtcgacacggctcacggcactggcgctacagtccacacgattgagcgcgagactggttcgtcacggtgtagcggcggcagctcgtgctgctacgagcagcggcgcaaggcaaaggcaggcatggcccgcatgggcgcacggcttggctggcttggctggctgcttgaccagcaggcgtcctagccggcctggcttggctgtgggctgctagctgtgctgggctcggccagaaggtggcgacctggcctttttgtggttgccccgactggtattttaagaataactagcaatagtgccattgcgttgcaacggcaaaaacaccgtttgatagtgttgcaccttgaaaaccttaaatctgtaaaaatcaagtctaatttgatacattaataaataggtagaaccgagtctaatttgatcaattagcataggatttaggatttagttctagatttatttttctagactacttaagagtttatccaacggactttaatttgaaaaatgtgagccacattgtttgatcaattttgctttcggcctaggtcttcccaagccggcctaaacttgagctggcccatcttcagcgagttagagtcaattcgacggcccgcaagctgagcagctgagcgcggccgacgtatgcggggacggtccgatgcacttccgcggtccattgggcgcagcgtaatcaacggcagcaacggcctgacgctgggcgaatctgagtcgtccgatttaatggacggctccaatcgtccccgcaccggatgaagcgccgaccggggagaggggcaaaaccctagctcccaaatccctctctcttgatcacatttcctctccggcgacgagcgagcggaacgacggagcgagcggaggatgtttttttttctttttcatagtacaagttttttttctctttttttgttttttctcacctttatttttctccaccgaggagtcggatttttttagagtcggacattttttttgtcgatggaagttttttttctcttcgttttttgttttttctctctctttttttccaccggaggagttggacttttttttttctgatcttttgcttttatcgctttttttccggtctttttttcacctgtttttttttgcgcttgttttttagaatcggaaagattccctttttatttcttttcgcccttttttttttactgcggaatcggattcatttttcttttctttttttcgcgatttggtttctcttttcttttttttcgcccggttttttcggccgttttgttttggatcggacagattctttttgcccgttttttttttgacagtagagaatagtggtaaaactaaattttaagaagaaatagtggtaaaattaaattttaaaaataaacagtgcctcagcactatacttgatggcgccgagccgaggttgaacatcttagctttcaggtgttatattgaataaaatctggtggcaaggctgtgattataatcgatgtggtgtttgatgaacttgctcgagctaaccgatccttattaggaccaagcgctcagatgaaattcaagaagtgttgtgagtttttctctgtggttttattccagttggtataaaatatactcatacgtcccataatatatatatatatatatatatatatatatatatatatatatatatatatatatatatattgacggagcgttggggctcctcaccgggagaccgcgcgggcccccctttgccggttcggccgagggcgctaggtgaggttttaagccctcgatctgtggaatgtttcgcgagagagcaaatgcgcaagacacgggcgatgtagacaggttcgggccgctgagaagcgtaataccctactcctgtgttctggtggatctatgtacgaaggagttacaaggagctggagatcaaaagagttcaaactctagagaccctctcactctttctctctacgagctctgctctcctctttcttctttttcagctccctacagtccgttagtccgtcagtcccctctcttggtaggcatggaccttcttttatatctcaaggggataccacatataccatttctacctacccttcttttgggtggggactcatcctactttaaccaaaacttggctcgtaccttcgcatgccaccgggttaaccctgtccttccctcattaatgggcggagatttgcaatggctgctctccgaatgaccctccgatgggatgggtcataccaacctccactccgccggaagcaggtgcaacgtgggagcacggttgtttgctaatgacgtgaccggcgtcagactagtcacaaaccggtcattcttgtctaccacgcgtcagtttagcatgccacccatcagcccttcttcgtaaaatgacttccttgtaatggttgcgatgaagcctggtatgaatctagccgggactgacgtgctaactctaggagttcccacgccggctccggctagggacgagtgcctaggggctctcatcattccgacgggacggggcgaggcgtgcgaaaggccgcctgttgccacctaacccgcgatctgaccggtctgtaaccggtcacacactgtgacctgtcacggaccgaacgagtgtgctgcgctgcattaaatgcggtgtgggacgctcgtccaacccgcgataaacgcggttaggtgagcgccgctgtgctcacctaacccacacacgtggcgccaaacccacagggggtcggggcgccccagccctcggggtcgaaacgggagcggcccgacccctcggggagacagagggaggggcggccacatcaccctcgggcccgacccccccgagggggtcaggccacgtgggtgaccgcggctgccccaaacctctagtcaagataaccccggtcccatgtcaccgacagtagcccccggcgttatgccagggcgatcgccctccacgaggaaaacgctcgggcgtgacgccactccttaggcccggtgacaggtggggccggtctctacaggcgagcaggaatccagtggtcgcaaatcgcgcgcatcggcaagggaaaaccgaccgacaataatgagcggctttcttcaagaccgctacattacttgagtagcacgcaaatcgggacgagccggttcgtttcgcctagagatgtgatgatggtgcatcggttggcgagcgtagttaacgcgcgcacgatatgtcccatctcgactgtcacggccgcacatccgcctcgtgcgccgcaaacgggcgaacgggattagtggagtagtgggcgcgagaaacgagggggcgagatagtgggcgcgggaagcgaggagccgggcatagcgttggcaagggtataaagacgccaaggaagagattcgtttccttcctcttcgccattattccccttgccttcgccgcttgcgctctaacttctcgtttcctgtgccctaccctcgccgcactcactcgctctcaatcccctcctctgccggcgtcatggcacggggctccgcaccgctcgacggtagcgtgctgccgccttctcgcatcgtgagcgagaggcaggccgggctgccgcgccgattcatgccggaatctgccaccggccgggaggtggttgcgctgggtgagggacgcccggcgccacactacccggggcggtccgtattcttcctttccttcgcaatggcagggctggtcccgccattctcttctttcttcatggatgttctggagctttatgatctccagatggcgcacctcacccccaacgcggtaatgacgttggccatcttcgcgcacctgtgcgagatgttcatcggggtgcacccatctctccggctattccggtggttcttcaccgtacagccggtgtcgccaccgtcggtagtcggtggctgctacttcccgccgcgggggccggtgctgaaccgctacattccctgcgtccttcgcaagaagtgggacgactggaagagcgactagttctacacccctctcgccgacgaagcgcgcctccgacttctgagccagcccccggcgcaggcctccagctggcgggcgccggtagatctgggagacggctacgacgccgttcttgaccgcctggctagtctgcgatcccaggggctcacgagggccatggtgtacggcgattaccttcgtcgccggatcgcgccgctccagcggcgcgcccggggcgcctgggagtacaccgggtccgaggactacatgaggacccaccagggggtcaaatgggactgggtccctgaagacttcaaggtggtgatccaacgggtgctgaatctcagctccgtggaggcatccttcatcccccaaggtgtcctccccctctgcagcgatccagagcgcgccaacatcctgaccatcatgcaggcggtcggggcgtcaggggagcgggctcctcgaggccacgatggcgcgggcgggagccgaaggggggagcaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagataggggggaccgaaccatgccggggaaacctcatctcccccccaaggtggtcgtttagccgacctcctcgcaggttcgtccccgcgccaactgcggctgtattcattctcccatctcccaaggcaagtttttactcacccgtttttcatcttctggtttttcttctgcctcagcgagatcccgtcgcgcccttcccgccattccaagtccggccggtctgaggccgaggagacggcgaccgcggaggcccggaggcgggaagctgaccggcgagaagccgcagaccgcctccgggaagccgaggaagctgcccaggaggccgtccgggctcgccaggctgaggaagccgttcgggaggaggctagactccgccgggccgaggagtccgtccgggagacggaggcggcgcgcgcacgccaggcggcctgccaagcccccgacccgactccgcccgaggcgacgacgacttccgagtcctcccacgacgaggccgcgggcgcaccgctcgggcccgacccctcgggcgacgctcaggatgagccaacttcgggggacgtccccgagtccggcacgtcgatcggcaggccgagccgtgcggcatccttaccgaggcgactctcccccatgccttccgctgccccactgagcgcggagccccttctgcaggccttggccgccacgaacaccacggtgttggacgggttaagtgcccagatggaggtcctgcaggcagagcgggcggagctcgacgcggcgtgggcgcgtgtcgaagaggggcgacgctcggtggaggccatggtggagacgggccgcaaggcacaccgccggcacacctcagagctcgaggcccatcggagggagctggcggagatcgccagggaggtggaggaggagcgggagactgccctcatcgccaccgccgtgttcaacgcggcgcgagacgacttctacctccaatacgggagccgggcggcggagctagagaagaagctcgacgcgtcccggcagcgcgaagaggcccttgaggctcgcgccacggtgctggaggagcgcgcccgcgccctggacacgaaggagagggaactggcgggtcgcgaggccgccgtcgccatccaggaggcaacgctggcggcgcacgaggccgcctgcgccgaagaggagtccgcactccgcctccgcgaggacgagctcactgagcggaagcgagctctcgaggaggccgaggccgcgacgcagcggcgggaggagcaggcgcgcctgaatctggaaggcgcccgcgccgagagggccgcactggaccagcgggccgctgaattcgaggcgcgggcgaagg

SEQ ID NO: 60423 - DNA, 6045 bp, Oryza sativa
ggatactagatagtttttgaagatttaaatgttaacaagttgtctctgtacctttcctctagcacagcttgatgaattgctagctccctagtcactttacatgctgaaatcttggtcggctttggcatttcataccaattccaccttgcattttttaaatgtctgatgtctcatgttagaatctagaacacatgggagctaaaaaatttatggtgaacctttcattgtgctgcaggttaatctgttgtcagaccacacaaaggagagaggcactgcagtaccaatgggcatgaagttcagagttgtttgcaggaagttgtatgattacgtcagatatgatctcaaggagattgcttttccttcatccttgccagatcctccacacatcaagaagcggccaaagctcaccttgaaagacaagtggtgtattctgaaggaggcaaccaggctgtacggggcttcttgggtcagagacattggccctgatctcagaccgaatgactacaagaaggtcaaagaggaacccgacatcaagactgaggagggaagcagcgagcctaccacggttgaggaccttctcggcgcattaaagggtggagcagagaaagccaagcctgcgttacagcggatgtacatggctcgcgcctcaaactacacagatgcactgaagaactatgtcgagtcctacaaagaaggtctgaaagagcacttggaggaagaagctatgggtaaaggacatcggcaaggcaatgacgcaacaaagccaccacagtcaccgtcatcatgattttgtctgaacatcttaggtgtgataccacatagaagtttcagcatatcttgtgtatgtaatcaacctgagttgatacattgccttctattgtagtaagagggctctctaggctgtagactgaaaaacggcaaatggacaaatggtgcctttgtctttgccaaaaagaaaggaagaagagagttcttcatcatttggttgtctgatattttttgcctgctgaatttggtgatgtgtagtgtaaatatgggctatgggctaagtatgtttctatggagatttttatttttcctgtttcaattgttgttattggttgctacgtgctgattgtctgtaaacttatatggatgtcgtgcagttgctggaaacacaggattatctcctctatttccatgcttatacggtctgtttggttggagagagtttctaggagggattgggagtttaaaaggatgaggctattaactgttttgtttggttgggggacatgggaattttggtgggatggggatggggaattgaggaatgaactccctccttttcaatacctgggtaggggcaggtaattaggagggaattcctcctttacttcgcctaaacaaatctcaaccatccattttcattaatgatctaatctccaactaaactccctatcaatttccaccacctctaccaaacaagagactgagatgaaaaatcaaattcccatcttaatctcaccatcaattttctcgtgtaaactcccaatcctcttccctcaagttgccaaacaagccgataaggttatgtaccattaccaactgtggtacacctgtcaatgcaacctttctaagtatctacctctgctctgttctgcagattgctatgtcattaattgaaaacgaaactggagcaatgccattggaacctttagtatttttattcaattgattgaaacgttctgactagcaatttttgttcccctttaccagctgattgaacaaactagcattccatcatacttctaaaaatgtgttttgtactcaagtccgaaactactttcaattaaagtttaggagtcttaaacagctttcactactatcagtgtcaagagactatacaccagccgaaaggttcagttcaaaacaaattcgatgacaagacactgcagtatcagagggagaagttgtatacatgaggcctgcaaatctgaacctcttaacatgctttctttatatcatcaggtctgttattctgctgtgcttataattatattagtcaggtagtattagctagctcgttgagatagatgtttgcttgcctgagttgagtcgaaaaaatgtaactagttgcattgtagcaactgagtctgagaactggttgatgaatggctttgacgatgtttaccgtagttcaaaagtaataactgatgaacaagtaattaactaatgctgtacattgcacaaatttgattactgaaaagaaaatttgatgtcagtaaatttgtttaaaatgcagaccaggaaaccttgatgagcagcttaattccgcagatgctgacttcaaggctctctgaaccacagatccttggagtgaattcgacatttgtgcgataatgtggcagtcagcatcgcctgcagcagcaatgagcgtcaagacgagctcgtcggccgcacggacggccatgacgcggcgggcaagatcgacggcgacgtctccggcggcgcctccagctgaagaattgctggtcgcgttcactttgctgctgtcgtagagcacaatggatgcatccgggatgctgctgctgcacgcagtgatctgtccatggaagcagcgacgatggcggccggcgccggcggcggcaggcaggcgcagggtgacgtcgacggcggcctcgacggcgcctccgatgtaggcgtaggagagctcgaccgtgctgagcctgctatccagcgtgctgcagcttccgacgaccacatcctcgacacctcttggcatgctcaggcttctaaattcgattagccctttgctgaattctctgtcgtcgacgacgacatcgccgtcatcctcctcctccttcaacttgagattcacctcgaagaaccggagtcggacacctcgattgatcgagttggtccggtcaaaaccaacgtttcatcctatataatcatcatcatcatcatgcaatattgcaattatgcaagaacaagaagtgatcaatcgatcgatcagctagattagataatgatgatgacgtacttgccttggaggtgatgagctggggattgtcggtggtgcggcggaagaggtagaggcactttcgatcgatgacatccctggcgatgacggtgccgtagacgagcacggggtagccgacgtcggaggagacgatgttcacggcgaggacgttcaacgacatgcgcagcctgctgtcgccggctcggtggaggggcggctggccgcggtcgacggttcggcacaaggggccgatcggcgactcctcgtcgaggttgaagaggatggagctgcagaaccacaagcgggtgtaggtgcggcagccatgcttggggtcgtactcgaggatcttgtccctggcggcgtcgcaggcttcccgccacgcctggtgctccgcctccttccgctccttctcccgctgcctctccagcgctcgctcgccgtccgctctcgccaccgcctcgtcgtagaagaagggctctaggccgctccactcgtcgccgccgccgtcgtcctccgccatgagaaccagtacgtcaactaattttattaccgaactaacggatgttacgcacatatatttctttatctttacccatgtaatatatatcggatctaagagttcttattattcgtagcgacgtacgatgcgtggacgttacttttaattatatatctatctctatctctactattataaaaattaaatatgtttccgctgatattttgataaattatttgtatttgagtcggttttcaagatcgtttacttttaaaaatacataaggagtcgtataataattcttttaaaattctaattgctttagaattcttgtcagagcataagatagcaacatacaagatataaccatcatgccaataaaagttccaaattagatatcaatactattaaagtaaaaaaccggagaaggctacagctcggacgtccgataaaactcaaaagatcggaagccctacccgttgcaattctgagcagataacaggattcacgcaaaccatgcactatgcaccatctctttcctactatatacatgtacactctttagcaatttttgaaatgatttttctcctaacctatctatatgatctatgatctaattatatcgttgtaattaaatttttataacaagatctcacatgagtatattacgttgaaaaaacatatgaaacatttttataccataaataaaacagttgagttataagtactgaaacatcatacctatttactgaaacatcaaaagaacgctattgcaacatttgcaaataaactagtgaaacatttgaaaaaacttattgaaatacctagataataggatgtgcaacatttaataatctgttgcaacacaaaactttaaatgtgcaacaaagtcgaattaaaaattgagacatttgtttctcatgcgtgaaacatttgattttaacggttgaaacatatgtatttttttatcgaaatatattcatatgaggtcttgttaagaagatttaattgccataaatacaacagatcagattacagactagataaatagtttaagagaaaaggaaattttaatgtttcaaatggttgttggttgttggctttggttgaaaaaataactattctattgtgtgagtcctttacacatgcgtaactaaaaagtttgctgatgtatgcttctatcgagtactactttgtttctctgcttagttaaatgtgagggtcccgtccggtatattcttccgggtcggacgtcttaaataaagcatttctggtaaaaatcgtcgtcgtcgtcgtcgtggtggtcagttcatgtggatggatggatagatctaagcgctcgcccaattccaactcaccggatgcactctgcttttttttttcctccctttcttcctctgttttttcttgatgaatcagaggagcagagcacaaggtggcacagacacgcgcacacacacaccacgcccacccacccctctctcggctcgggttaccttgctaaacccaaaacctctgcccttgtgtcactgacaatgtgggcctccttgaactacagtggacaactttttacctcccctagttgagtttggatggtattaattagccacataaatgaatacactacttaataatactaaaaaaatagtattaaggaagcaagcagcaacactaaccgtattactccactagttaattaatcaatcaaaagcaggaagaattaaatgtcctgatggaatattatgacgtcagccgcgcgtcactttacgtgcccggccgatcacatgcatgcaagcatgcacacacggcgcttgtaataatatactagtccgtcaagtgcttttttttttccttttaaggggggacgtcactagttttgtgcatgtcatttaaaaattatcaaaaaattcttaaaaaaattatcaaaatagatcaatatatgatatatcttttcgcaaacatacaaggcaacattctacttatacaattcgaaacaaaaataacaaatttgaccgtgaactacacgttctattcacggtcaattttattgtttttgtttatacttgtacaagttgaatttgaatatgcatgcttgcgaagttaaatatcacatattgatctatcatactaaattttttttaaattttttttgataacttttaagtgacatgaaaaaagaggggatatcccctaaggatgaatagagttttcctactagtccttcgtttcatattgcaagtcataatttgattaggtttgacaagatttatagaaaaattagcaaaatctaaaatattaaattagtttaattaaatacaacattaaatatatttataatatatttgttttgtgttgaaaatactgctatgttttttttatataaatttggtcaaaccaagtttgattagaaaaggatgaaagagacagagagagagtagctggatttttcacattttgatccttttaaaaaacttatttcgcaaatagacccctgaaaaaacttatcccagaaatggtccttttttgggcgccagagtggctg

SEQ ID NO: 60424 - DNA, 12998 bp, Oryza sativa
cgcacaccccccgcggtatggtggttaccgcggtaaccgtgcggttaccgtgaaaaaccgcacaaatttcgtttccaaatttttgaattcaaaatccacggtatggacacggtaaccgcacggtttggtacggtaaccgcggtaagaggacggtaaccgcgatatgttggaactgaaataagaaaaataaaaaaaataatagaaaaaaactaaaatgtgagtattttagtttatgttggaactgaaataagaaaaatgaaaaaaataatagaaaaaaactaaaatgtgagtattttagttaattaagatgtggttatacaacagaaaaattcggcatgacctactctatattgtagagtccacagtataatgtccacgattacaattctagttcgaatgaaaggaaataaacaaggacatgcatagctacgcattccactgattatatgccatattttactcctctgtggacatgagcatcaagccatgtgaatgtagcaaccccgccttgtattccttccaactttgacctgtccatgatgatgttgtttgccactgagcgtacaattgagcataccactgaggctcttgccattcatacacccatgtagtagcaggataatcagaagcttggggacggttgtacacatacgttggatagccactttcaaagctagaggcactgaatgagctagagctatcctgttgtatgtcactgaattgttgctgttgtcggactcccggtgcaatggtagttcgttgagagcttggagcaccatgatcctggtcctgagtagcatgagtgaagtcgccctcacctgcaaatcaaaaaattgcaagaaaattatccagtactgaattggaagatgaaggttgaaattgcaactgaattatatcacaccagtgaattgaacggggctgtggtgatctgattgttgggtgtgacccctaggaggcacattagtagtgccttggcctccttgaccatcgtcgtcgtcgtcatctgtttcagttcttgagctactatcattggactcttggtactctgggcttccttgggtctcttcatcgctatcaacactagtcgatcgtggacccttgccctttacctttttagatggacgtgcttttggcggctttcgagtcttccttttcccaatatgagtgtcacctacattcgtatcagcccactcaacaatactagaagctcccgtggtccttcgcaggtcatccaagttgactaggtcagacacaagttaactaggcaggggagcgtcactctcagctgaatcttcatctagttcggggcaagcattagagcgagcattgtccatccaggcactgatatgattgttagtttcatagaatgagaggtccgctaatctttgaaggggatcatcgtcctccaccctaatttgggcatttgcttgctgaattcgaaggcgaaggttgtagttcacgtacactagcttgttgagcttcttgtgggtaagtctattacggaccttcgtatgtacgaatgcgaatgtgctccaattcctttcacatccactggaggagcaacattgaccaaccaaacgcaacgcaagcttcttcaaattcggcgtgtctaaggcaaacatagaccaccattgtgctgcaaaagccaagtaacatgtcatttcataattctgaatacatcaagatcaattagatatatcatagttccatgattagaaacataccaggtgaagttttcccatctatggccatccttcttgctagtgccctcccaaattcacccgtcttacgtcggtacatctcaacctccagcaaagcggcggcagccgtatcgatatccgtcatccactcgaatgcctgtcggaggtcttggaagacagtagcacttggagaatacgcgtagtgcgtcctagggttcaatgcggcagctacaaaacatggcacaggttaagtaagagttacataatatgccatgtggattatgttatgaccaatatttaccggcattgatgagagtctcattggttaggtcgtgcatccttctgttcacgatttccatgtatgcttcaaacttgtccctttgattcgcaaaaagactgtcgtactccattttgagcaactgatatctcaaaagtacctcactcaaattggggttcttgtcctcgtcagcaaaccgaaggaatgagtacataggttggacaaaattcactactgcctctaagttctcccaccaagacagactagatagacatgcatgtgcatatctaccttccaaagtcccactaaatttgctttgcatgaagacagaggaagccatccattgcatgaaaagatctcgcttcctaaggaaactctggagaaacatgtagtttgttccgaaccttgtagcattccacttaaccagttcaccacctatagctaagaccatcatagcatgcaacttgttatgattgtatagccatctgcaaattttcctagcactctcaatcaccatttcgtggtctggcattttcccaacctccttaagcatcaagttaactgtgtgtgccacacaaggttgccacacaattgtcttgtattcttgccgtagtagtctgcacgccttcttgtagttagagccattgtcagtgataatttgaacaacatgctccgagcctatttcgcgtaccaccttccttatctcctgcattggtagataacataataaaaattagtccatgcccctagcactgacgataacaggtgatgaagtaatttgttgcatgaaccatacataccttcagcacaaagttagcatcctggctttgccccggtcgcatcaatggacttgtggaaaaacattattccattgcagtatatcagaaaattgatgaccgacatactcgtcggacctgtccaagaatcacacattatagtaacaccgtactcatcccaatccttcttgaacctatcaaattgcttcttcacatccttctctgtagaatcaagatattttccatctatctcgttaccagttggagaaggtacactttcacctacaattgacgtatgaaataagtagtgcgcaatgagttagaaaaaaagaagttccttaatagatgcatacgtaccccacttttgtgtctcccgaacggcgctcacaaagtatggattatcggcgtttctaccaggaatgccggcggtaaagaagaaccttgcccatgactcaccaatggcttgcctagcttgcttccccttctttgtgaagaatcctgtgtcaatgcgtggctgcacaggggccttggcagatgctaggttgtaatctctcacagcaggtgactccctatgagacgtagcccttcgtagcatattggtaattgggttacttctacctttccgtgcctccggctgagcggatccactcccaccgccatgctcataagtgccaccacgctcctcaacatccctcctaaagttttcgtcttgtcgtgaggctacaatggctgcttccatttgttcctcctcgtcggcatcacctgttaggtcataatagttgacccttgctgcttcaacccttcttccgctatcactcttacgctggtcacctgcatcttttatcctgtccaactcacggcagaagaactcacggacatccggaggcactgaattgcaatatgtaacccccttccttcttgcagccaagtgttgctttaatcttgttgccccaccaccgcccctctttgtatggcaatacttacagcgccatccaggtgggatattctccccgtgctcccacacagggtccctactatctgacatctccaccctgtatcaaatgcatgagaaattatcactgctaattataaacatacctcccattatgcaataatacgacgtaattatatgtacactggtaagcatgcatccaaattcttccatactatgacgtatttaatttaacctatatgtacatagaccaaagcaatcaaatatacttcacatgcatggttttagccaagcacgggcaaccaaatgccgaaataaactcatattcccaatgtatttcacatgcatattggtaaaaatatgttctattgacctaaatcccaaaatatgtccatgcatatcacagtaaaaaataccataccacggttcaagccacggtaaccacggtagggtggacggttaccacggttttcacacgattaccgcacatacgtatatcgtctcatagattacgaagccgacggtaaccgtacaaaaccgcacggttaccgctcctaaccgcgcgaaaaccttcaaaacggagggattacctcttgcccgtcgacccaggcggttaccgtctcgtaccgcgcggttaccgccgcttaccgcgcgggaaccggcctcgccggcgcggaggcggcggatctggcgcgggcgcacgccgtcgccccttcggtcctgagcgcaactacgcgagagaggggaaaaacggtaggattcgccagagaaacgaagcagaggcttccaaagatattttcctcccattgtgggccttattgggcctcgtgaacagtgcatacttggcccattccatttaatcttttttcttttttataattcacaataggttttgcgctcaaatttgaatttacctgcatctttttgatgaaattgtttcaccataacaacatacaaaacaagcttttacatccatgattttttttgatttttttcgattatttttcaaatttttgaatttgagcaaaatttgcccaaaccctaccgccggttttcgttaccgaccccccacggtaagcccggtaaccgcggttgccgcgcggttaccggcgagaaagtgaaccctgtgtgcacacaagccatcaagttttcaacgggacgaagaaaacggtcggaagatgtaaaagtaaattaaatatattcaaatcatttccgttatttttttttctcgaatgcaaaatcattccaaatcatgacgatagagtcagaaatgataatggttttaccggaggccggagcatcagaaaatactatagacaaaatcattgaagtagagcctcaaaaacagcaagcaagtcttagttatatttatattgtaaaatactagtaacttgtcttagttatatttatattgtaaaatactagtaacttggtcatttgatgttatagatgttggtgtatttatcttatctgttatccataaacttggttagattgtcaaaacgctttcttcctctcgcgtcgccctcccaaggggtggctcgggaggcaacgagcttcggccgtcccctctcccccacctctctcctccacctcgccaccgcctgagcggccgcccggctggcggccacaaggaccgcgctcaggtgacctggggagccgccttgggcggcggcgacggtgaccgccagatccgcgccgctccgatcggatctggcggggtggcggctggcgaaggggaaagcgacggcggcagggatggcaacgacgacggggatagcaagccgcatcgggtgatggggaccgtcggcggcggggatggagatggcgcggggctggaggcggcggcgaggacggcaacagcgggccggatccggtcgtgctagaggcggatccccccccagggcgtatctggtgcggggcgagctcaagccggtggcggcattgcggagctcgcggcgacggcgtcggcgacaacggcgcggagctcacggccacggtggtgatagtggctggacggcggtgacagcaggtggctagccgacgagcagcagctgctggctgccgtggcaacggggggcactcgcagcgggagaggtcggtgcggcggcgacagcaggcgtggagctcgtggcgacggtggcgacagcaggtggctggccggcggcagcagcggcagttgtggcgaccgtggctgcggtgggaggaggcatggccatcttggacggctagccgggggcgtggtagacggccgtatttggccggcgcgacagcgattggaggaggggtcaaagaggcgcaaccgatggcagcggaggccggcacggcgcgagtggtgtggccggcagtgatggaggctggcttggcacgagaggcacggctgagcggctgttggtgtgagggtagtggtatattttttcttttttcctggttacgaccttctagggttgtaattttgtaatttttttctactctatcaatacaacttcacactgtcttgtgcgagtcgttcaaaaaaaataaacttggttagaaatttgactaaaatgactatatggaacatagggagtacctttcttacggatagaccagtatactcacgacaaaacagcgtaaagcctcagaacacacatatgtgtgtgtgtcccatatatatattgctcaatacaattcagagtgacatggtatacatagcttgcatgcgtagtagcccgggacttagcctagctaggtattgagtacactacggcaaaactgccaagaaccggagagagaaagatcaggaggctaaagagacagagagagtgagagagagaggtgcgtcgaatttgacggcggctcaggtagaaagagtggagcaagtggatcatatctctatggtctatggatccctcaatcttgatctggagtcgatgagcgagtcctgaatctcctcgagcgtcctccctttggtttcaggcacgaccatcaccacgaacaggatggtgatcaagctcgccgcggagaacatgaagaaggtccctgcatttgcacgcaccaatggcaaagggaaaagaaaacaaaatgttaagtgtatcaagaaagcagcgaggcaaaacattttacatttctataattcatagaataaatctcctcctggtaaacttgttggcataaatccaacggctcaattcgctgatttatccaggttgaatgaatctttcaaaaggtaaaatggatggttattttacatctttcaaaaggtaaaatggatggttatttgtccatttcgcttagttcttcagagatgaaggttattgtttttgactactggcattacagcattggaagaactacagtgctgtgttggtggaatttttacttacctgcagaactccagtccatgaggaagctgaacgagtaagaaatcgcgaaggaacctaaccaactaactagtgtcaccaagcttccaccgattgctttcatgtcaatcgagaatatctgcacgcaattcgtcatccagaaaatataaatcactctcctcctgaatcactacagattgatgaagaaccttgtaccatatataaccatccaaaaccaacactatataattttgcatacctcagacatgacaacccaagggacagggcccattccaatcgagtatgctccaatataaacctattacagaaacagcatcagaaagagtatcagcagtctgcagtgatgtttatctttcacaacatgctacatggtgtagactactaaatgttgcgattgaagtgacattagaatgtgtagtgcatacagtcctaaaaatttatgtactgcaactgaagggaaaggatgtacatggattatgtacttaccagtataccggtaagagccaattcaggaacccattctgagaatagcccttgtgcctagcagacatgaatcaattaccattatatacagaaacaaacagagatggtcctccttacaatttgagctgttaataacattgaatgatagctttttttggtagattttcaagggattgtcaactgtatcaagctgacttatgccagtcccgaaattttcaaattatacaattatcttttcatgtactttcctaggaaaaatgtactagttacctttaggtagaaggatattcctgtcagaaagcagcccaaaaatgttccggatgccgagacctaaataacgaaaagatctcacaaaaaattctatctagcatgcttttctttgtatgtatcagctcagctttgtagcatttataccattagaagaacccgtcttccactcttatccattagaatggctccgaacaatgtaataggaatctgaaaagatcagtgttataaacaaaatgggcttattagttaatttattaactagaagcagtgtatcaaacctgaataatgccaatcaagatggttccaagttttccagagaaacctgaagtgcgataaaatcacaaagttcatacagaactgtcagaggacaacaacagtgatcacaatatttacgtacctgcagaagtgaagatagagcttgcataaaagcctacaccatttatccctcctaattgctgaaatatcatcaagccaacacccacctgtgtatataagatccagcaattatgtctggttcagttcttttctaaaaaaagtttcacactatcagcctccaaattcagtggttgaagttttaatgcgattgtgattttgacatgaagtagttgaagacttgaagtgatttcttacagtgacagcgtatatattttttctgagaaacaaatcttgaaccctggcctttgggaacctatggagtgattcaatatactcctggagaaaatgatcagtctgagcaaagtccttcacattaaattctaacatatacaagcaattaggacagaattaaactttaatctcgacggcctcttcagaaacgtcagcatcctctccccgtagcatttgcaatgaggcatgaaattctttctcccttccaacgttagcctgtaatttaaatgcagtggaactcaatacaagaagtgcactatgaaatttattactgatgcttcataagttcatgtgtatgatcatgtaaccccttcaattaataaagcaagaaaatcatggggtaaatggtcccccactgacaaaattcagaacttaattttggtgttccatagagcgtttgacaaaggtagaactaagaagttcattaccagccatcttggtgactctggaatgaagagaagtcctgttaatagcaaaacacatggtactatacctgcacaaaagaaaatgtatttattaccatccagcatgaatgtgaagaataaacatgttatttctatggatatgaagacaaattacctactaacacaagattacgccatgcaaccagggcgccaattatgtatgtagctgaactcccagaacagatcagcaactgcgtgtgcagaaggtgcggagtggaaactattaggattcaataaaaatgcctgtcgatatccaattttcattttctgaaacctggtttgaagttgcaaggcctcccctgagattctttggtgctatttcagcgatgaacacaggcacctgccatatccagcaatatgacgaagaacataaatgtgataattagtcaaggtaaaaaaagttgaaaccgatacaagaggggaagacggacagtcagtgccgtattttgaatcaagagatgcataccacataagaaagaatcccagtactaaagcccaacaatatccttccaaagtagagcatgataacaccctgtacatcaaaactcaaatataagatacccacaagaaacagataaggaccaagtgcaagaatcatttcaccaaggaacaaaccttagccaaatgcaaagaaagccatccaaaaatgcaaatagtagctgatatccgcattgtctgcgacaaacgaaaaatatgacacacctggaacatcaatttacagcaaacagataaatcaacccaattgaaaaatgggactgctttaccattttacgtccaagaaaatctgctaagcgaccactagtgacagcaccaatcattgccccaatcgtcagtacagatccgaatagtgcaaactgcaaggttagaatgagtctatacatatcacagtactacatacgagaatattacagccggtgaaagttgagtacaagtagcacagcagagcgaaaaccatggaagagaaaatcactgacctgcgaaatggacagtccaacttcatccacaatccctgactgagtgggtgcagaataacccacctgcatatgaacatggctgagtaactaaatgatcacattcgacatagagaagggggaaaataatcaatcaatacattccagtggaccagggatatataagtactagtagcatatagttggaatgggaatattgtactctagctggaaaaggccatgagaacatgtgcacatttgctgagatacaaccaaatgtggtgacctgtccacttcacaaccctttgcacttcccattccttgaagctttgcaatttcttagttgaagctagcaaaatggtatgtaattagtcagctctaatcaactttccgttttttactgcagatactttggcattgtggccttccttgatttttacctctgcaaacttaccaactcgaatataccgtcaggcgtcagctgtcagatggcccaactgtattgccatttttgttctgctttacgcgtttcttgaactcatgggtctcactaattaagattctttacacttaaaaaggaaagtaattagaggagatatgtaaaaacagagtgagagcttttgcccagccagaatggaaagaattctctgcaatgaacacttgaattataagtacggtagaaatttctgggaggaaaccccgtcgtgttcgtattgatttaatttctgtttgaattactaattgctttcttgagttgaaaacccttccatagtgagagaaaggaggggaaggcgcttacgcaggtgccgaactcgaaggagccgcacacggcgacggcggtggagagcatcagcatcgacatggacccttcttctcttcctccgcgccgacccccgcaatcgccgcccggcatcattctggatcttctcctcatcgccccgcccctgcttgtgctgccggaggagcagcggcgccgtcacctcgccgcctccgcctccgccgccgccgcccgcggctccggccaccaccgcgccctccacatcctccgcggctctcactatccccattccccccggcgcaacacgcacgcacgcacgcgcgcactcgagagcagcagcgagcggcaatggcagcaaaactcgggaggcccaagattggcaaggagcgcgagcgtgtcgctcgggtcgggagctcgggatctctctctctccctctcggctcctctttgaggcagcgccgctatttatacgggcgagcgcgccagggcgggcctcactgacgcgtggggcccagcagctgacaccgcagaggcggcgcgttgagcgtagtggagttaggggggaagagaaatatctcccattgtttcgaagaaaacgagaaaaaagaatcaaaatatctccgatgatcgaggccgatcgcaagcacgcggtaattaattactaccctcgcatttctaattcattaaccttaatataaatatcaaaaatattaaaataaatatgaaaaatattataatgacttatattatgaaatggatatgaaatggatgaagtaattagttaatcaattagttaatgtgatctcattgtcgcgataacgctaaagaaaactctgggagatcgatagacgacgagacgagacgatagcgtgatcgatcgatcgatttttgcatctgactgatctctgcaatgcgagagcgacaggaaggagacgtagcttagcttgattgatttggattaattatgcaatggtgatgagctattgagctggaaccatggcagcattcaagcagcggtgtatagtgcatggacatgaatcctctgcggtactgtatttgcagtagcagtggctagtaggtggacccgattccacatgtcagcggttgttactacagctgatagtgtatacctacccatacacatgtgtgctatctgcagctagctatgcacactccaaagcacatatgctacttgatttttttttctagtataagaaaattgtaatggaagaataagaagaaattgtagcatagcatttgtaggcatatgatgatatgatgccaaggccagcacgatcggtcggcatggtggttcttgactcgtccgcaactactgtagcttagcaataccgcatacgcgcaattgcgaaaaacaaaacaaaacttagcctccggttttaaatctgtgttcttggccttttttccaactcaccatcagggatgtgctcttcgccttctttttcacctcatcttcctctttttccatgccttttaaaccataaaagttttctatagaaaagttgttttataaaatcatactccctccatttagtttaaggttataagacgttttgactttggtcaaagttaaacttattttagtttaaccaagtttgtaggaaaacgtagtgacattttcaacccaaaacaaatttattatgaaaatatattcaattattgatttgatgaaactaatttagtattataaatattactatatttgtctataattttagtcaaaattgaccaaagtcaacacatcttataatctgaaacgaagggagtattaatctatttttaagtttttaagactaatatttaattaatcaagtgttaatgaataacaccttttttgtgccggaaggtagaatttctgaactcggcctaaatacaatacataacaccgttagcttttttaactcgtttggttatttgtctttttagaaataatagctacccctacgtaaataggcaaacacaaggccgggcacgatctagtgatacactgatacttttctcattttacgcaactaaataattgaatgaatattattgatctgagggaaaagtaatgtatgtactcatggaattgaaatgtgtgtttgtgatgtgtttgaaatattaaacaaaaaatataacagtctttaagtacttttgaacggactttatatgtgattctcatatttttttccaatctaaatatttgaaaaaaaaacattgacagttaaatcttcaaaggtttattaaggtacgaataaaacatgttttcacggaataaccttataggttccacttggatgctactcaattctgacccgtc

SEQ ID NO: 60425 - DNA, 4919 bp, Oryza sativa
ccaaccgggactaaagtcccacccctatatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacattttcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttattgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagtaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgatagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcggggatgctctagagtcgaccgataggcatgcaagtagcagtctatccggacagtccaacaagggatacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcgaaaaggggcctagaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttaagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtctagaggcaagcatcgccaagggttatggaatagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagggcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatggtagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatcttttatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaattttgaaatagcgggaaaagatatttactcccggttgttgagaacaacctggagtaaagatccgggggtatatatattcccggtgcgccctcgtcttcttcaccaacacttagacattttcggccgatcgatctctctcggcctct

SEQ ID NO: 60426 - DNA, 3225 bp, Oryza sativa
ccactgtaaactgtttttgttttctttggctgaatcaggttctatccggctctacgttgcactttgaaagcagaggaagcatcatgagacttcttccaaaagctcgtaattaaagcatcaataatgctacagctaccaggcatcacaataaagctacagctaccaggcaggagtactacttgccatgtgtctttctgtcagcaatttattctatcgaagggaagaaaatctggtagggcgaaagtccatccggtaggattggagccatggtttcgcttaggccgaggttagttctaaactttttctttaaacttttaactttttcatcacatcaaaacttttctacacacataaacttcgaactttttcgtcacaacgttccaatttcaatcaaattttcaattttggcgtgaactaaacacacccttaataagcgaaacggcatatttacaaacgaaaaataagttataaacaaaatttgtatatacgtgttctttgcaatctaaaagcaaagattgaaaaataaacttcgatgaaaaaaatcttaaaatcagctctaaatttaaaattgaaaattcaaattttagttaataatcataaacataagagatgagtccgtctcagtcataatctcgtgcaggacacgtgcctcagtcataatctcaaaggctcgaagcatcccctcaaaaatcgtattaattactaatgtcattagcaacaaaagtgacttcgacgtggacttgttcttccagcgcatatggactttctcccagcggggcgctagtcgcggcaccagcggcaattacgtgaggacattgttgttcgagtacagcagagtgccggcgataccgtgtgggacggcggtggcggaacattttcgacagcaacaaagcgccgcgcttggctcgtgttcggcgcgggaggtcaccgcccgccatgccgcgcttccctttccaggccgtgtcgccgccacacgccacggcaagcgaaggattctaaatagacatgtatcactatatacgtggcaacgtccttcaataagcaaagagacttcctactaccaaaatttcttcccttgcgaagcgtggctgatacgcgtacgagtctataccatttttcaatggtatagctcttgtgtattaaccttcttgaaaaattagctttttcaatacaaaacccaaatgcgtgtgtactcaagaacacataataggttatttcaggcaccacgtttcaaggttgggcaaattgctacttcctccgtttcacaatgtaagtcattgtagcatttctcacattcataatgatgtaaatgaatctacatatatatatatatatatatatatatatatatatatatatatatatatatatatatatatatatattcattaacattcatatgaatgtggaaaatattagaatgacttacacagtaaaacggaggaaataaaacagaaaattatttctctcggcgtcagcctttcttgagcataatgcgaccatgcagcttcaagaattcctccaatgctgtcttggacgaaccaccgtcctccagagttcgactaatcatcccctgaatctccttcacactctgccgtatcttgtccgcctacgccgtaatccccatcgccatatccacgacctcgaccaccctctcacgctccagcgccggggagtccggccagctcccgcgggacacctccacgcacgcgccccactcctccagcatctgggcgttgaagaactggtccgccgtgagcggccacgcgatgattggcacgccgtgcgccatgctctccagcacagagttccagccgcagtggctcaggaacgccggtggacgcgtgcgcgaggatgctcacctgcggagccaacccgtggatgagaagcccaatgttcttggcatgcatcctctcctcgaacccttccggcaaccactcggcgctgaactggccaccgttggtgggctcgatgtcaaacccgaacggcggacagatagcccaaatgaacggccggccggtgagctccagtgccacggcgaggtcaaccatctggtcaagccttagcgagttataagacccgaatgagatgtacagcactgacctctcttcttgggtatcgagccacctcttgacgtaatcgtcgttatggtcaccggtgtgatcggagtgctccgtccggcgacgcactagagggccgatgggatagaccgggacgcccatcgttctccggagcatgcgcagcccggtcgtctccaactcctccatcatgctgatgagaatcgcgtcggtgtcgtacccggctgatgtctgccggcggtggtgggccgaccaccggtccgtgccgtcggcgtggagtaggtacggcggaagcttcgaccggtggacagtaacctccgggtggtccgggaggcagaacgcatcgtcaccgggcgcacgcaggtgcggcaggtggttccacagcgagtggtacaccacgctgccgaacgcgccgcaggacacgaagatggcgtgcgcgacgccacgccggcgggcgatgtcggtcgtccacgcgaggaaggggtcggcgatgacgcagaccctggcagcgtctgctccggcgtcggcgatcaagtcacggacgaagccgtcgaagctgtcctgtagcgagcgcgactcggtggcctcgaacagcgtgatgaagtggaggggcggcacggcatcggtcgactcggcgtctccgggcaggccgtgctcagcaggcacgaacggcagggcgtggaaccggaggtaccgcgtctgggagctggaccggcggcggaggccttccacgttgcgcggggtggagacgatggagatgtcggccgtgggctgggcgtcgtggaggtgggcagcgagggagaggaaggcggagaagtggccctgcgccgggaacgggaagaggacgatgcggaggttgccatcgctgggcatggtgaacacgttgttctttgacttcgaggttctccactggaaggaaattaattttttgctttgtctgaaaggagaggaagcacgagggcacctgtcggtgtgtgtgtgtggcaatggctctgggtggacaggatgaacgagagggtggggagtagagatggcaatggcccccgttcacgcttccccgcggtgaattcacctattaggtgatggggatggttaatatatattcaccatggagaataaaatggttgtaaacctctcaccatcaggg

SEQ ID NO: 60427 - DNA, 11857 bp, Oryza sativa
ggtgacccgactttactgtgtaggaggactaattttagactttttagttgttttggcccataatattgaagtccatttaacaagcatatataaaatctaaccctaagtcaaccggtcaaacaccaaatcctccacccaaaatcccaaatcctccaaatccgcactgccgcacggcgcgcacgcccgtgccagccaccaccgccatccgcctgtccgccgggagccaggcgcgccgccgtgcactgccagttcgccagccactaggcacgccgccgctcgctgtctttctctcgcgtcgtcgtgctgccgggagcccccatcaactgaagccgccgtcgccgggagcctgcttcgatgcgccgtcggaagacgccatcgccgggagccgccgtcaacgtgccatcgggcgtggtgactgcagccgtcgtcactgggagccgccgggagtcaccgtcgccgcaccgctgggagccgccatcgacgtccgccagcgccctccgacgtcactcgttgtgagaatgattcttcctgtgattttcatctataatttgttgatttgttgagtggagcattttggatatatattgatataatgtgattgtgaatatgttgtttaaccggggacgggctaaccacggggataaattcaccacatggtgatcggggctggagaaattatagccccgtcgtggttgacggggacggggacggtgaaaatttttcaccgcagtgacggggacgcggtggtgattcccgacggtgaattcatcattgccatatctagtggggagtgaggctgggaaggatgcgcttggcagactagctttgggatgaacgacgagctcgaggcgtggggcagttggtaaggcttccgagcagggaagcaagggcgtggacgaaagtcggtaaggcttccggtcctgcgattaatggtgtcgtgggctttgtccatgccgtgaggtgggacggtggggccgttggatttgatggccggggtacgacgcagcgagattccgagcagaaaaagggcccttgccctgtttgcgccacagggctgatgcgaatgcgagtgatgaggtgcgacgtggtgctttgcgtgcggctgcggcgcacggcaggctccggcttggagggcggtcggtggtcaagagcgggaccggaagcgacgtgacgggacggagtcgtttgcccggcgtgctgtggcggcgagtgcgcaggagcggcacactggactagagctggtgcggcgctgcatcatatgctcgcggtcgcgggcgtgcgtcggcgcgagacattggaggcgacttcgctggactagagcaggcacggcttggacgccaaagttgtcgccacggggctcgcgtgacaagcggcgcggctttgctgaacatgtgagcgtacagcgcagcgtgatggctagctgcttcgggcgaccacggtcgacacggcgcacggcactggcgcgacagtcgacacgattgagagcgaggctggttcgtcactcggtgttgccgcggcagctcgtgcggctacgagcagaggcggatggcgaaggcaggcatgggtgcacggcttggctggctggctgcttgccctagccggcctggcttggcactgggctgctagctgtgctgggcttggccagaaggtggcgacctggcctgtttggtggttgccccgactggtttgctttagaaggaataagttcactttaggtctcttcatttgtcaccgagctcgaaattcacccctataccaaaaaaaccagatacaatgtatcctctaacttacaaaaccgagcaaacgagtttgtaaaatctaaatcgagaagcctctcgttttaggtcttgtttctttcagcttgggattattataatctagattattgagtcagattactgtaagctagattgttataatttatagtaaaataagcggttagttgtttctttcctaaattattaaagcctaaattattgggtttgcaagtctaaagagggagtgggtggcatggtgggtaatttttcacccaataatctagaaaaagctcaccaaaatgagcttattagattataataagctgggctccagattataataagctactttaataagttatctgtttctttcagcttactcctaataatctgaattataataatcctaagctgaaaaaaagggcttagtcatatcgcgcgatgcgtctcagagccatccgaccataggcttggcacatgcacgtagccggagccacaatgagcaagaaaagagagtactgctacatatctacacatgcatgtcttgtttattattatgtcataaatgtatttcttccttcttataaaattttctcttaaactagaaagtaagcccgcgtaaatgcacgggcaatttattttttttgtttatagaaagaatactaaaataaaccatatgttaccgtattcattttaagaaccatagattaccttataatctaaaagaagaaatatttattatgcgaaataaattataaagtttgatatactaattgataatatctattatattcaaacaaatttcactttgttatggctatacgtaaagtcgcatatcaccatctttcgtaaacatacaggttaatatgggtttagatttttttcttttactatacatctaagtcacctacgtatattcatgggtaatattcgaaggaataattcatattgtcaaaattatttgtgctaattttgtcaacactatttagatgagaatgacatacttatataaggatataataggtttccatgcgacattttttattgtacgtatgtttttttttgtgaatagtactgcacatattcgtaggatggttgtgcacatatttatatgagtgtctacgatttcgttttagatcattagttaaaaacatattttaaaaaagtttggtgggatggcatgaagagatgccacggtggcatgactttttcgataacatcttaaagagtttcattatatatatatatatatatgcataatttgaggaaaagtttagtgttgcaaagaaagaaacaaaaaacaaccaaactaagcagatcatatatacattctttttttttccgttttgacatctcttgtgtaggtacgtacgtatgtagggagagattagttggtttttagctggaatatatccaatataatggttgaaaataatggatctaccagttgaagtgtaaattgatgaccatatattttcttttttatattttttcttataatttttttctaatttatgagatctattacgtgatatattaagagttcttgtagaagtgtagaaattctattgcctatactgataatatacttgtagtcgattattatttattgtggcttggtggcatgctttactttacctatcatttgttgatagttctccacttagtatagtccgttatatatggtgcttcatgacataagtgctcgttggatggtagctaattattagatgcactatgcatgaatacctcgtaagcaatatgacttgacgattagtggatagaacttatatacttatggatcagtggtggcatatgattgatatattaggatatttttttattcataaagtatattatatactacacattaaacgttttagtaaataagcaataagttctagagtaattatcggattggttgctccttttcccagttatctacccattgatataggaattattacaaaagacatatcttttgataataatatctaaatccatctgaaccattttatgcactataattaaattgacaaccataacctacatcgtatatatttaaaagcaacttgtgtataattaaaatatattttatataaaagtttaaaaattaaataaatatattttggctttattatattcaatatttaattaatcttgcactaatgatacgtgtcgtttcatgtatcctgaataagctcagccatccagctagatcaaatgaagcataagtagaagataaaggagatcagtacggtgtgaaaagaatatatacaatctttgatatttaaatattatacgaatagagaaaacacattcatgataaatttagtgatatcattttgacatatcattatttttataaggagtaggtaacttttgagaattgctagtcacaattagaattgtttttattttaaaatatgcaagtctaatttaactattacataatatatactttaattaatttatgcttctcattggtgtttcgatgacatctgcctacatttttacaacgtaagtagagcatagttaatatgggcagtttggttttttatccgagtgaaaaaaaaaagaaaataaaaagatgtcgttagcccggcctgcttatgtacatatgtacgtacttttttaccttggaatatatgtacgtacctttttttttttgggaatacctactaaacgtccgtacttatgtgcacatatagatcggcaatattgagttttggagataactttaattggtatttttacaatagatctaatggttgaaaataatgggcccaccatatattaaatgaaaatcgatggctaatatttttttagaatttctataatttattagatcgccacatggcggcgtaggagcatttccaggggtcctatgtggcggcttaggagggtttctaggaagtttaatggacttttagtatataatagatagatagatagaagatagatagattacttattcgatctatatttcgattacaccattgtgttcgttgtaattaaatcattataacaatatcttacatgattatattatgataaaaaatatttatactggtaaattacttttattatatatgtaagttacttttatcatatataaaaattacttttagatttgattaagttacttcattcatagtgctctgagtagattacatttattattgtttttagtcaattccacaatttggtgccgattaaatttaattttttgataaactcatgtttttcatccctataacggatttacttctaatgttgtaacaacttacttccatttcgtactaagttattttttttatgatttatgtaaattgctttcagactttattaaacttactttcataaatgtatttacttgaaaatcttctctacactttggttgtgaatttactccacatagtttcttactacaatccagttatagtgtaattacttctaatcttatagtagagaattacttctattgcatatctaagttatttctacaatttaaataaattgcttttaaattgataaaatgtttgaatatattccacatggatctcattttagcacatattttgagtagagtacaatgatgtaaatagatcttaaaaataatatatgatttataagatataaatctttaaagggggatttatatatggaatggagtgatctctggttaggattaacccactaccgtgcactacctagtcacccctcggcggtattctcccgggttttggctaacgtggcaccttcgtggctcctttggctaggtctttatcccaagtggcattgacgtggctcttatgtggcaattcgatccgaaaaaattaataaaccacgtgggactcacatgttagtttcacgcacaaaataataaaaatggtgggggcctatcgatgtttgagatcacgactacggtatttggatggtatggggatcgttggtaccagggtatatgcgagattgaggtaaaagagatggagacggagatttttatacaggttcgggccccttatctgacaggtaatagccctacatcctattggccgaagccggtgtagctctttattcatctggatcacacaaatacaatatttgggataacctatctggtcatcgttgacttggcggcatgaacaccaactcgtagttgacgacgggtagtcttcctcctcgagtatgaactcgtcgagatgagagatgccgctagatccctcttgtcggcccccgtgggcactgatggggtttgccaaggctaatctgatctctaatgttgatatctggtgacgtgtgttggcttgtgtgtatgttgtgttggtcttgtggcttccgtgtatgttggctgtgccccctctcctcctagggggcttgtatttatacccatggataacccattgtccaagtaaaactagggagaccaatatggatacaatctgggtagtctttgtcatttccatatagaactctatttgtccttccttatccggatttccttctatatacgaagtttgattccgtataagacatggtatatggtgggccccgccgagctgaatcgattactattgggtatgtggtatccataaccctgacagggcctatgtggccccacattttatcctcattactcccgtcttgtatctatcttctctatcctcttctctctatcatctatagagtcccactctgaagcggcggcaagcctcaggcggagcggagcaaagggatgaagtggggtgggcggagcggcagggcgagcgaagcacggtagctggatcaggccgatggaatggagcggaccgtcgtcatcaactgctatagcacctgccatagttgccgcgctcgccgacgactgctcgagctcctcctccggccatctccaccgttgttgcccccttcaccgcccgtggcctgccttcgccgctgctccgtccacggtctaccgccgccaccgctccgctggcatgcaccggtcaccgcgttgcacccgtcccactccgctagcatgctccaaccgctgccgctccgtagtgagactctacagaaggatagaaagaagaggagagaggatagagaggagagggggtagtgaggatggcacatagggtcacatgggccctacccttttttatcgttttatgtgtgatacttacatgtgggtcccacgggttttattatttttctagatcgattgccacatatttgtcacgtcaatgccatgcagaacaaagatctaatcacaagagccacgtaggcatcacattagccaaaaccagggacaatattgacaagggacctcgtttacacggttttttaagttggggatgcgttgtagccggttttatcatccagggatgaatttcgaactttgtgacaaattgagggacctaacgtgaacttattccgctttggaactaagggtgttgggccagctgaggttctggcccaaaaggagttagactttttgaaattaggcttttaattagttttattaattgtaagtcctagatttattgcttgttatttactggaaaggtcacatattaatattccccataatatatgtgggttccatctgtagtagttttatagaattaagtgataattgacattcttttttaaaaaaaattacatagtataacgcagacactcacaacgcacgcacactcacccctatgaatgcacgcacacaaaccctacccctatgagcatcttcgaagactgggccgataaatcatccttaaaattgacgaagtcaccataggcgtctcgctgtcgacgagtacgtcgcctaccattgaaagcacagtgtcattaaatcctgaaaaattcgctcccatggggagtcgaacccagaaactaaggtggccctactttagttttatacttcaattaggagaattcggaattgggggttgtacttaattcttattttacttgtataatctttactttagttttatacttcaattaggagaattcggaattgggggttgtacttaattcttattttacttgtataatctttaattcggagaatgtatgattgattcattgtttgtatttataagtatcggaaattaaaaatttcccttttttgtgttgtcttttatttatttgagattatcgaattatcttgtaattcaatttgtgattgtaagttgcttccttacttgggtcgattcaagcaaagcactcaaaaaagcaccatgttttaaaaaagttaacaagtttacacgtttttattaatatacgatttttagggtgttacagtttccctctccgactcggatccgaacttgctggggaggcccaagataaggactacacgccgatccaagaaatttttatggcctcaagagctgaggatgaggaagctcgccgattaagggagcagtgggaacgtgaggacaaacgcctttgcaagggggcagaagatgaagaacggcagggcctgcaatcaggatccgtgcacgagttcatgccgtgttcaccaaaactataatcacaactgtatgcttaattaagtgctatataaaaaataattacgcaagtatgagatgaggtggtgagagcctcagaataaggagtctagattaattaatttatgaattaggtcattggtatgtctagattgataattcagacagagtggtacatcagggttgataatttcagattatccgtgtaaacggtctatcagaaaatccaatagaaatattaaataatccgcatatgccggattttagagataccacatccacatccgaaagcgcaccatactatttggaaacatataccatatcctcgtttcggatggattcggagcgattttatctgatccgttttcaccccttcataaatgtatgattttaaatccatctataatctacgagactatgaaggtgacatcttcagcttatacacttcggttgtttgggcattcagctcagtgagtgacatctccaaatttgtgcacaaatagctatatcacggtagtgggtcttactatgacccttcccctccttcacaatttcgaacaagattctttaacatattatcttctaaatttgagtgactataccatatatatatataggccacacatacattactagaaaaactattttcgcaaacatccgctttattttttaggtggggtcaaaagaagacccatctgtgaaaattaggagagtcccttgtcaaggctcgtaaataaaaatcgattttacacgcacacgcttaaattgctcacctacaaattttttataggcgagcgtcttaagcatgcacctttaaaaatttattttcacgtatggaaacttaagccacttgcaacctcatttccgcaaacgggcggtttgagtgtgcacatgtgaaaatcgattttcgcagacatgcggcttaagccactcacttttgaaaaatcatttttttaagaaaaaacatgtatctacacctaactttttcatacaaagttggatgaagataaagtttatatcaaaattttttatcttgatgatatctacagttttgtagttgacaattttttatttgagattattttagaggctgaaacatttgttacaaaaatctcacatgtatttttacaaaatttaatatctatgcttcgaacgatctctgatgaaaacatgcgctacatcaaagttatagggttgaccagatttacaactttgtaatggaagactttttcatttaagattatttagagtactaaataaacgttttaagtttcactgatgtgaagttcaaaagaatagcatcaactccaaacggtaagaactagatagtgtggtggttaggagggatgcgtgtggactatgacggcctgtttggcgagagaagggaagaggaatgggagtttgaaggagggagttgagggtgggattggtcatgggagttacatttttagtcctcatcgcttgtttggtttcacgttgaattcccttcaagtctcacgaattaacaggcctcccccaggtaagagattggtgggagttggaccccttaattccccatcccgaaccctcttgaattcccaagtcttccaatcaaactatagacttaaactcccaaatatcataaactcccattccctatcactaactccctccaaccaaacatgccgtgaggtcttgagtttgagtcctatatacttgtatttagtaaaagaaaatgatgtgtattgtgattcgggtgtgcaaatgtttatggatggttactaaaattaaaaaaatatttttttattttgttttggtgcctaaaaaaattcaaaaatgtgaaaattcactttcaaaaacaatcctcttatgtcgtccacttgtgaaaatcgtttttctcatacggccgccttaagccacctacttgtgaaaaaacgatttttccactcgactggacatcccacctatgataatctctattttcacaaacacctaggaggaggcggggtcgctcagcctcttgcgaaaaatagattttggctgtctgtagagaccatttctatagtagtgagataaatacttggcccacatgtcagccatccaatcaaaaatacttaggagtatcacactatcaattctgggttggttcgggctgattgctattgtatttgttttatactacctctgttttttaatagatgacgccgttgatttttatcacacgtttgactatttatcttatttaaaaaattacataattataatttatttttttgtgagttgttttatcacacgaggtactttaagcataatttattttttatatattgtgtaaaatttttgaataaaatgaatggtcaaacatgtgttcgataattaacaatgtcatttattaaaaaactgagggaatatatctttcggcttttggagccggccccatcttcccattcgctccacaaggaaaaaaaatgtcttaaatggcattgctgcagtgtagacagttatactatgcgtgacactggctagaatcggagcaattatttccactccatagttgttggaagtatcctagtatatatactcgatttggagaaatctatctatatattcattttgaggtatattcattttgaggcaaatttgggagaattaaggatagtcgggatgacagacagaaatttacatggaaggaatcatccatcgatcagctaacaaactactagtagtaccggagaagtacaaaaaaaaaatgtcagaattcgaggagcgtggtggacatgttgagcagcggcccgagcgcgctgggcgcgaacttgcgggcgaacaggtagcacacggtggtgggcttgccgttgtacgcgcagcgcgtcccgttgttgcggatggcctgcacgaacgccggcgtgacggtggccttgccgaaccgcgcggggtgcggcccgccgcgcgaccagtccacccaggtgactgtgcggttggcgttgcgcgcgccgtggcggaggtgcaggtacgtcgggatgtagtgctcgtccgggtagcacgacggcgtgcagtgcttgcggaagatggcatggtacttccggtcggcgacgatgtcggcggcgaggtctcggctcatctcgaaccactcggaccccttccgccactgctcctccagcacgtcgggcgccatgcgcgggttgtaccgccccgcgcactgcggcacgtcgatgttgtacgactccacgtagctctgcgccgagttcaccaggtactcgtacaccgtcgggaagttgaacaccggcacgcagctctcggaggcgagcacgaaccgctcgttggagaagtccagcagcgcgttcgccagcagccgcttctcggcgtccaccagcgtgatggagccccacgacacgtcgccgctcgggatctgccggccgtggaacggcgacgacgacgacacgttcagcctgtactctggcagggcgtgcacgtacacggagtagagcccctcgtgcccgtggaaaaaccgctcccacagcggcgcgaacggcagcggcccgcgcgtcaggaacaggaacgccaccttgggcacgcgctggtacgggtactcctccacgcgcggcgccatggacgcgcgccagaacagct

SEQ ID NO: 60428 - DNA, 20143 bp, Oryza sativa
caagcactgatactatttttatcgtttgacttcaaactctgatagttcgattcctttattaaattcggaaggattgcagcaagcacattattgtacggtaaattgattgactaatactgtaggacttttagagtctgaggttatgaagaaaaaaacggatcgtcacatggctaggctatatatcttcactcattaaggtttactctaccttgtctatatatatgctcctctgactttcttgcgaatggtccatataaacctgtcctggtttgcatgatgactagggttttaacgtgttagctggtgatctgctttaatgcttttgttgatattttcagagcactgaagacgctatgattggctttactggtttttacaatgtggacttttttcttttcacattatcccaacagccttcctaggggttatgagaaacacaaaagaaagttgggcgacgaaccacgcaaaagctaaatggttgtttatatctcatgaaaggtagtttgcagttgtactggcatttaccacaaattatccaattcgcagcattaagccagccatcctctcggccccttcccctacagagaagtttaaaccaatttctctttgtttcccctacagagtgtgtctgatgtcaaattttaagatttgtcagcgcacaatgattatatatgcttatatcttctcatatactttgaagaataaaaattcacttaagccatgttgaccttttcatatgatccagaatgaacataaataatttcagttaaacctttaggcatctcatatactgttaatcccatggtttagaatatctctatttattattttccaagagcacagtcaccttttgggccatggactcatggaatttttaaaagataacttggatctttgagatcaataaacttcattgcatacatgtcaatacacactattgactatatatttaatcaaactgtcatgggctttgggccgggagtcctaggcccattagatagagttagggtttgttaggactagattaatgagtcatccatctatataaggaggagatcctatcctaggtcaattaggtattagatcaaaatttatcttagtgcccgtcggtctgccttctcagtgcgacggagagcgtcgcgccgttttggttcagaaccgttccttgttatttcatctactataatccaatctatccccattcttccctattcttctccacaaatccttgcacgtgacaacttggtatcagagctttggttctgtgcccatgggtcccgagatctctacggttcccaacatcagcgaaggccttgtcgagatctcgaagaagatgatggacttggcggcgcaactccgggccatggcggctcagtcagccaagccggcggctttcattgaggaggccgaaccattatactggcatgcggtggccttgcgttcgcgagggcgcgtcttcaagcagcacagatggcggcaatatttagcggtgacgctgcaaccacgcgggggcggcgtgactcgtggcgaggtgctcatgtttcctcttccggcggcgccaagtctgggagtggcaacgcaacctcgacctcgccgttgggactggcgatggcgccatcgccgttggcgccctcaacggcggcgatttccacttcaacggcgatacaacacggtacgggcgtttggttttcaggcgctattttccggcgatgcggctttgtttccgcaggtggaggcgcacgtaccagtgatggttggagcagagcttggcgacgtgcgtgcggcgcgattcgcaggcgcgacgggtgggtgtggcattcacgtgtcgcaatggcgcagatcgtgccggccccacgtgctggttcgcgaagttggcggatcgaccacggctgcgtcgctcctagcggtgtggtctcctgaaaggaaaggagatagggtttctgccctctcttagttgggctaggtggtttccacgttggcctatgatgcaaaggttgatctttctcatattttgagccaaggaattttggtctgagccttccgatttggatcatggaaggggcttttcctctccttaggaggctcaggttggggtcctcctgcgcatgaattgttttttatttttgtttttcataaaagccgagatgtaaaaggcttaagagttttagtttagggtatggtgttccgtttgagtctagccgggtgtgctgctgctcaaaaagagggaagtaatgtcacgggctttgggccgggagtcctaggcccattagatagagttagggtttgttaggactagattaatgaatcatccatctatataaggaggagatcctatccttagtcaattaggcattaggtcaagatttatcttagtgcccgtcggcctgccttctcagtgcgacggagagcgtcgcgccgttttggttcaggactgttccttgttatttcatctactataatccagtctatccccattcttcccgattcttctccacaaatccttgcgcgcgacacaaacagacagtgatgtcgatgccgagcaactcctggactccaagcctccaactctgtccagtccatacaggtgtatggcagcaaacagcaggtccagcttgaagagatgtggttattctgaattattcttagaaataagataggaatcatttcgctctaaaaaggccaacttgaacttgaagcgtgaacactggaaattgcagaccatgagtacacataacaaaaagtgaatttagctaaaaaagttaatatcacctatttttaggtcattgggcgggctggtggttatagtcaaaaacctggtgtaaatcttttcttctgctggttgttcggatcctaacttcatgttcttttgtggttaagtcaaattggccaatgtactgcttaagctttgcatctggtatggtttgatggcatttgatcgccaaatgcttcatgaattgcacactagaatttgacagaatttatgtatactgccacttttcaaatgcagtttgccatctggacccataaacgcagttgatgtactctgcttgcatatagatgttttaggaaaccaatacaattttggaatatgctaagcaataatcgactgatttgtatagaacatctgagttctgaaagagtaatgtggattagatgataaaagttggcatagtgtggaaccatgataggctgaactaaattattttttctatggaatataaatttttgtcatgccaatggttgtattaaggaaataacaaatgcactacttgtaaagatctttatatatcaaagtgtttgtgtatatagaatttataaagattttggtgggtttttattttcgagtcttttggcaatgggccatgaatttgtatatgacaatatttccaaattttacaagtttatatattatctagtgtatatatgttgtggaaatgtgcactgcacatgcttaggagggcgagcgtattgttgtagaataatgtgcaagcacgacgcctctttgcctcgcactttctggccgagtcaattatcatgcataactggatcgtaccaaaatcgcaacaagttatcgtacatacagcaatttcacgaaaagaatcctaccatgaggtagcagatgacatggtgtgatttatacttatgataatttaagtgatgatttcaaatgggtacatgcaaattttctcattgcaacgcgcgggcatccaactagttttacttaaaattattggcttggatggaacatatataacccgttggctatgtgtttgttaaaattctatacaacccgtttccgcaaattcaacccgttggccatatgtttgtttggatggaatatgtgtttgtttggcttggatggaatggccatgtatttgttaaaattcagatatatttttaatttattttccattggatatctccccttttctgcaaatgtgagcatttcaagagattattaaaactaggcaaattttgctacaggacactgctacttcgtggaattagctccaggacaccgcacgaaatgagttttgggggaagacactcccaaaacatagctatttgccagaggacaccgcacccatttgtttagtgtattcgtgctgactaggcttgagcgggcccacattttgacgggaccggaccaaattaccctgcacatctaaagtctaatttctgtccctcgggctacatcttcaacctccagctctcgtgcccgtacgccacaccaccgcctcccgctctaaattcggccgatcccgttgctcgttcaaacattgattgaggggatttcttccccttatccttctctttctttcccctcaaaaatcggagcaaatcccgttgaatattgcgtggattcgaagcggatttcatctcttatttttctggcactctaaccaatccgtgcaaatcccgctgaatatagcgtgaagcgtgcttctgcttctgctgccgctgctgcttactgccgcgattgccgctgccgctgctgccgctgccgatgctactgctgtgctgcttgctgccgctgctgttgctgccgccgctgccactgctgcttgctgccgctgctgctactgccgatgctactgctgtgctgcttgctgccgctgctgttgctgccgccgctgccgactgctgctgccgctgccgccgctgctactgctgcatgctgccgctgctgcttgctgtcggtgaggggaggggagagggagagggagagggagagggagagaagagagataaggagctgacatgtgggtccgaggatatttttgacatttcggctgcgttcttttcaggatagtcgttctcgttttccgttagcacgcttttcaaactactaaacggtgcatttttctgtaaaaagtttctatacgaaagttacttaaaaaaatcatattagtccatttttttaaaaaagaatagcagatacttaattaatcatatgctaatggatcgctccgttttccgtaatcactgttcctaagaagaaagaacgcagccttcatgtagtttctctctcctcttcaaccggaaattattattttaatgggtgcgttgtccgctggcaaataaccacgtttttgagagtgtttttccctaaaagtgactttgtgcggtgtcctggagttaaaaccacaaagtcacgatgtcctatagcaaaatatgccttaaaactatatacgcagaaatccctgattaaaataaacattattgtcattatatcttttttatgagcatttaatattatttttatcatttgtggttctgataaaataatttcagatgatggtgagccttctatcctaattggcgaaaattttaccatcatacacacatgtcatctcacaatatatcttcattactaaataatgccataacacatgcaacaatatgtatggtttcttctcgatcttaaggtggaacccactaattaagaaaaaaaaaactctattcacctatgatttcaaagatactatatatgttgcaaatgtataaaatacttttgtatttcttatggtataactttaagctcaaggttacccttaaaaatattatcttcatggctactctcccaatgatagaggtaaaacaaatatattactttattccttaagatcattttacatgcaacattgtggatgtggtaagtaataacaaatgattcagaataacacagcggctagcatagtaaataagtaaccttggattttgttccaacttcagccgttcagcttcattgttttgaagaactcctccaatgcctgatttgccgacgagccatgtccaccctcccgtgcagcttccatgatctccttgatcgctctcgcccgctgccgcatctcggccgccttcgctgttggagacatcaccgtctccaccacggcaaccagcgtcgctttgtccacaataatggcactcatgtccatgtccccccgtgccccctccacgcggaggcacaccccccactcctcgtcgagcatcttggcgttgtagtactgatcgccggcgagcggccacccgatgatcggcacgccgtgcgtcatgctctccagcaccgagttccacccgcagtggctcaggaacgctcctgtggagtgatgcgccaggatccccacctgcggcgcccatccatggaggaggaggcctttcttggtcgccgtcaccctctcctcgaatccgtcgggaagccacttcggctggatctcgccgtttatgttgtgcccgtccggcggcttcacggcccagacgaacggccggccggtggcctccagtgcggcggccagctccgccatgtgctctgcttggatggagaactgtgacccgaacgatacgtagagcaccgacgacggagggtgggagtcgagaaaactggtgatggcgccggcggtggcgtccgtctccggcgaggttgttttggtggaggcgcgcacgagtgggccgattggaattaccgggagcctgaaggttcgccggagcatggcgagcccggtgggctcgaactcctccacggtgttgatgagcagcgcgtccgtcttgtaccccagctgtatctgccgcccgaagaacgcctcgacgcggtgcttcacggccgtgggcgggtggagcacgttgctggacacctgcgacctgtggatgaccacgtcggggtactccggtaggaggatccggccggcctcgtcggggcgaatggggaggtggctccagagcgagtgcacgacggcgctgccgaacgcgccgcacgacacgaagaaggcgtgggcgcacccgcggcgccgcgcgacggtcaccgtccacgccaagaacgggtcggagacgacgcagacagcgacgtcgccggcggcggtggcgccggcgacgaagtcgtcgaaggccggctggagcacctccaaggcctcgaggaagtccgggaagcgattgtgggggacgccgtcggaggactcccagcccgccgggaggccatggtcggccggcacgaacggcagctcgtgtaatagaaaggagtcatgtcctgccgacgtggctcgccgcaggctggccacgttgcgtggcgtcgagacgagggtgatggcgacgtctgggagggcgcggtggaggacgccggcgaaggacaagaaggcggcgaggtgcccatggccagggaaggggaacagcacgacgacgttcttgctagttgctgccgtcattactgctactactcactccaacaagtctccatgtgacaacacgtacgtctcagggttgctggtggcagacatcactccgtgtttcttactccctcgtttaaaaaaaaaaaaaaaagcaaatcctagggttgcgtgtccaactttgactgtccgtcttatataaaaattttttataattcgtattttcattactgttagatgataaaacatgattaatattttatgcgtaacttgtctttttaatttttttcataattttttcaaataagacgaacggccaaacattgaacacgaaaattagggtttatctttttttttaggacgaatggagtatatttctattttgttaaataatagcgtcatttctcagcggtagttggcgacttaaatgttactaggcacaggacctaacgcgtgtggttcacccttctgaattatttctgatcgccatcggataattacacactagtacaaggtttgttgggagggtgtttgatttttcaacttaaaaatttgacatctattatcttctattatatcataaataatactaaagttcataaaacttcctacaaatactcataaacaaccatgtggaagtcctacaaatactcctaaaccaccgtgtgtcaccttaacaaatagttagacccaccattttaattaccattagaattgttttttttcacctccctctcctatcacccatcagcccacgtcagggcatccccaccagcccatatgcacgcacgtgcaaacttacgtaaggaaaaactacgcactatttgtgctaaagaaaaacaaaaaaagactatttgtttgaaaaaaataaaaaaagaacatatatgtatgcacgttttcacctacggtaaagaaagcaaccaatcctacacctttattttattttctctagttgttccatgttaaaattttataaagcatatgatgtattttatctataaaaatgtcacatccatatcaactatattttaattaattaaaagaagttgtcacgtgaaactattgtcttaatgattacttcgtttgtgtttcaataaccgggaactaaatgagctccttagccgtcaattaacacactaataaattagagaaaataacagaaattacgaagaaaaaacaaaaaaaacattgatttcaacttaaatatggtagaccaattattttctaccattaatttatcttagcaatataaaaaaaagaaaatacccacctcccaccccttcacgtcatgtatgtatgaatgtgcacgtacgtacttatgtatctctctctctccccccttactttctctcctttattaacaacatcttaactaatataaatattcggatttttcctttagtcaccaattttttcgtccgtgcgtaatttttttcgcccgtacatgcttttttcacggatccgattttgttcggtttttcacttttctctagcgccagcccagtaggccaggccagaagtccaagccacaagcccataaagctacaagtccaggtgcgcccacaagtccaggtgttccacaaacccacaagtccaggtccaagccacaagcccatagagccacaagtccaggtgcacctccacaagtccaggtgttccacaaacccacaagtccaggtccaagccacaagcccatagagccacaagtccaggtgttccacaaacccacaagtccaggtccaagccacaagcccatagagccacaagtccaggtgcaccacaagcccacaagcccaggtgcacccccactcctactccggtttgccccaactgcgaccaggagtcctgctcttgctattccgttttccttttcttctttcttccactatttttagcgctcacccgatcacgattttacagatttctcaggcaagacatacatatagaaataatagaagcacacaaaaaaaatacaaatcacaaggtttttcctctagggtgccaagccacctccaatcaatgtcgattccaggttatcattgtactcaacctgaatgcaattacaatttcattagatttatataactcaaaaaattctactccatgcatgcttgcctacttttttaatgttatcactaagtcataacatgcattggctcataataacttgctgatgcactcactgttcatggtacgttatactgtctttaattatgcatgtgatgtatctaccaaaatagtacattcgctcatgcaaaagcaagccgagtttaaaccaacaaagaaaatatttctttaccaatgtaagaatgcaagatcaatttcatctgagaaggccaaaaaactagacaattaatgcactatggtgatgggaaaaaaaatcaagaaatttgtttgtaacagctctaatttcctaagtcatataaatcatttagataccccatttaaactatctgaatattcagaacatttattttgaaggcagacacaaacgatagtaaaataaggcaaaagagaatgttatctctaaagaggtaccttagaattgtctattctatctatatataaacatctggaggtaaaaatcactaagaaggatggaagaacaacagacctgtatgtgcgacagcaatatttgctcacttcaattcaatagcacacataaaaaaacgcaactcacttagcaaatatgaagccttccctcaggatactgtgtggtataaaattaattagatgaacaggtactatcatcaaaaggaataagttcatattatcactgcatgtaccaataaaagaatcaattcaaaattaaatatgtttttgtaagccgcataacaaaataaaccttatctaaatcatgtttgctctaccttctcagattgcctatcctgattgcagaacttatgattgcattgtgcatgataaaccgatcgaacagtgagcataccagatttagtatgttgccatgctacaacatcctgagttcctcgctaccaggagtaagtgctatttgtatgattcgattagcatcaacggaccaaaaaatgctacagaccagctcttcagccgactgaccaactaaaggattaaacaaatcacttacttttgacaagagagtactttcaggttgtgactagagggaattctcagatgttgtcttaaaaaaaaagaatacctgggcggcagtggctggggttgacggcgaatcaaggatgtccgtcgctggcagatggagcgatggaggtagcgtccacccatcgtcgtcgtcaccgtaggggaggctaccggatccacccctcccgtcgtcgccggcgcgacgggatccgtgcgagaggggaagaggtcgccggatcagcccctcctattgccgccgacggcggatctgcgcgagagaagggtggagagacggtggaatccaggcgccgacggcggatccgcgcgaggggggcggagagacgaagggatccgtgcggactcgagctccaaggggccagcggagcagcagaggggcggcgctgccccaatacgctcatcaccgaactgcagcagtaagggaaagagcctggagcagtggtggatatggccggcgatagagagagacggagaaagacgaggagagagcgagagaaatgatggaagcactccgaccggctacagatatttgctctcggtaatgaactacgagctttcgttttttttaaaaaaaaaaagaaaagaaaactacaacggtcaagttcctagatagtgctaatccacggaattgatttccactaaaaaatgtttagatatacgtacaaacttaaacttcagtatcacagacgagtggtattttcttttattattgatttttatcattgacataaaacacacaggaaacttccactttaatatttgtttgacgtaaaaaaatgtcgattgtaaaaaaataaaaaaaaattcgtgagacacgacatattaagattatgcgcgctatcgatcatccaaatgtcacacggtcgatctccacccgagtccacatatgattttgggaactggatcacacgcaagagcaagtttaatagtatagccaactactaactctaattcatctatagccaatctaatagcttattcatacaatagttacatactacactattaatacctgaatacctgatcctacctgttatactcacactgtttcccgtgctacagctgtctataaatctgtagcccgctgctattctttctctatttaacttcttaaaatatgtttgcaaccgacttatagcctactattgtacatgctctaataacataataattgacagtaagaaagcataattgacagagtaagaaagcacgcatgaccattataaaagtattattttatccgtcctgattattattggtctaaaacttacctatttaatcaaacaaacttccgtcctctttttgcgtgaaagtgatcggaacattcactgtttattcctcccgtggtacaatcattatgttaacgcattacattcttcgaaccatacacgtgtacagtgcaataattattcaaaataaaaatacctctgcgattattatacaagtcacccatgcttatcgccacattggagtgctccaaacaatagttgagttaaactttatccaacataccacgacccggtgcaacgcacggacatattactagtatataaaaaaaatcaataattagataccttgaagatcgtaatttccactaaacttccaacaaacatttataatccattacgtggcaccctataaacactctcgagtcgtcacgtgacaccctataaacagaaaaatttggtcatcgattttcatttaaattagtgagccttttattttagatcattagatctatcttaaaaaaaatatcgctctgtccacacctctgtacggcgttctcacgcatgtacctaacataccctccctccgttcctttcttttcttatttccataataattaaaattatttttttagcctaaaaaatccatagatagacatcaacctactagatgtagcaagctctatctctatcctctatttttagtacgttaaacatcgtacaaatatttctaaataactgcatggccctcttaaattagagaaaataaaacattcgaccatcggtttctatttaaatcgattttatattgttagatctatcttttttaaaaagaaaaatcatccgaacctcactccacgcccctatgtgacgtcttgacaaagaatgatcaaatgtaccaagatcgcaccaacatatgacaaattattttgttaattacagaaaaaaattaaatgtgacaacgttatatctacagtatgtacattgtacattattattgtaaattcaatagaggggaggcaatatagttacacaaacacgcaactttatataaaagtccattaaactttctacaaacacttataatccatcacatggcatcctacatacactcataagccatcatatgatgctataataaattacaaaaatcatgtaaattatgataaagattttcacttaaattgatgatccgttatttgaggctattggatttatatttcatcaaaagagaacaacctgggcttcaaccgttagattagtttgatctaattaaccatagcctcatgcagtcaagcccacgtcacctcccccatgaatgcgatgcacggtggaaaaaaaattctacaacacctctcgcggttgtaggagattgtcatcaccatggcaagtttctctgatgagctacaactttatattgtaaataacacaactcaagtttatgaagatggatctgtccccatttatattgtactgtgctaaattgttcgtcgcttagaacaaagcaacaattgatatatactagagcatactcataaaacatgccacataagcaacaaaagtcatattaagcataccaagaggcaaaggtcaacgataaatcaacgaattcagtaaattcctaccctttaaagtagctgcatgggtttctccacaacctccatgggaatacaaaatcagtaaccttttttacagtaatatgattaaaagtcatatttttcctaataaattattattttaagatagggtctcacatattacaaagaaattctatataagatatgtatatttgatcaattaaaaagagagctagcatgatgtaaaaaaataaatttacgatcaattcaaatttttggagactttttaaataaaaagtaaacaatgaaaattcaattaaaacgaaagagaccttactttaatttaaccttattttgttagaactatttatgaaacaaaataatatacatacccgcgctaatgcgcgggctaccttcctagttttttaaataatgcgaacaagaaaattgaaattgatggaagctcttttcccaaaatttcttatatattggtccattattgtactatcgtcccatgtgggataaaagcaggcttaataatgtagctcgtcacggacggtaaaaataatcacgttagagcaaggtcaatggtatagctagtagtagctagtaatacccattgccatgtcattttgcagttaattgtaaggccagctagcccaatatgctagctatttgctcgctgcaccttattaataaaataattaattttgcatggacattttaacaactacaatcaaaagtgcactcagttgtggtttcatcaatcaataatgaaaaaaaaacttattatcgatttcccgatcatattggtttggaaaaaaaataaatatatacataggtggaccacattgcttaaggcccgccacaggcgaagatcattttcgctggcagcattcatcaaaggagcttctagtgaagagatatttcattggcgtttgccttatgaaatccgctagcggaaatggagtaaagctggtggttggcaaccacgtggaaaatacttcatcttcactagcctttggtctccagctgttagcccctgcgaaaacccattttggtcgtgatgagcacctggcagcaaagtaccctgaattttccctctcaatcacggtaccaacgataatcgataaattaattagctgatctcagaactgagtaactcaatagatatctaccagactgacttaattattgtattccaaaccctagataaatgatacttctaccggtgcttaagcaaacacgatcagaaaggagagaaacttatagaaccgagtagcaccaccaacagaaaacctcccacagcagttgctcttctaccaaccaaaccggtgacaagatctttcaatgaaagaaagatgggcgccatcttttgttcgctcggggagaaaccctcggcgaaaccaaacaaaccaatctaatccctctgctaattaatcgtgatcgaccaattaaaagatacgtaggctttcaggtcaggctctgaggctcgcagacctaccacagatggacaccgacgacgctagctagtccaaattggacccaagactcaggaactatcagaatacatgcataaaaaaaactgactcaacctgaccgctacatgcaagagaaataatataataatccggctgcagtgctaatgaccttggtaattaggctaatcaaacccgcaattgatatctcgggcagacgcgccacaagccaactgcacatgcatgcatgcaccttggtcttcatctgtgcagatgcattacacacacatgcatacactggtggagaaaccctctgtagtcccggttcgtaacccccctttaatcccggtttccaaaccgggagtactaatccgggactaaagatcgctatcattagtcccgggtgaaataaccgggagtaaagatcgatctttagtcccggttggtgttaccaaccgggactaaagatcgagctgaccttttttttttgcatggccctgttgctgcatggtttatatatatatatatataaaccatgcatatatatgtttcaatacatatatatgcatacatatatatatgtatatatatatatattatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatatcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaaatttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcaaaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgagacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagttcgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaatggctcgatctcctggtttggttgctctccaagctgagggactggtttggactttccagaagatgctcctcttgacagatgcagacatacccctaaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcaccttcttcgttgcccttgtgtgggcaggcagtggagctggggggggccttgactttgaaggtgccggaagaggagcttgcgggggagtaggtgtaggagcacgacgaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccacctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgtggccatgcgttcatcaaccttccttgccacctcctcttgcatgttgagttcgtagctcgatacccggaactctaggtctgcaatcttcgcctcgatatctctcttgcttctcatccgactcctgtacgtgtggatgtcctccttgaaaccaatcttccaaggaatcacccctttccctcgtgttcatcctggatgctctggagtctgcagggcgagtgtcagctcgtccctatctctgtctggtcggaacgtgccctgagaggaggcttccactgcatctgttagtcgtcgcgcagcctctcgtatctgatcaccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagccttctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaactgctgtgacgtacatagttcttggcggcttcggccggggcactaggacgtccatcttcttccacttccgttatgatgtgccgaccctcaagcttcttcgctgcacctcgttgcccgcgtgccctcttccgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaatatatatatatatatatatatatatatatatatatatatatatatatatatatatatatatattgcatttcacgttaacgttcgtcctcgttcgttcgctcgttctcattcacgttcgttcgcttgttctcattcacgttcgttccctcgttctcgcttgtcttcgttcgatcattctcgttctcgctctcgttcgttcgatcgttctcgttctcgttctcgttccgttctcgcggcaacgtacgttgacgtgttcgttctcgctctcgttcgttcgatcgttctcgttctcgttcacgttctcgcggcaacgta

SEQ ID NO: 60429 - DNA, 11204 bp, Oryza sativa
ttgcttagccctgcctaattggactgcataaaatataatgaacttagattggaacagtatggtagagatggttgatttccaggtggctagtactgttccaaccgacataaaactgctaagtacatgtgaagaacatacgagtacgaccgcaattcttgtatgggcatagacctagctgattaagttatctagcaaaggtggtacctctgtatagtggttcttcttaagtcctcgcgcaggaggcaaatttatgccgcgaagggcaactgtgatatttaccgaggcgcaggtaaatatatgagatgaattgtgcacaaattgtttgtgaaccctgattgcgatgacatggtgtcataaaatcagttctctctaaagacctcgggaatgccagaactcctctcgctgctgataacgttacgttcagagcgcatggggactagagttcatggaacaggtaccaatgatgttagtaaccgaaaagctttgcgatgacaaggctaatgtgtttggcacgtcatggattgcgagtaaagcgtacatctactgtttcttaaaactattcgaatagccgtgctcgtggttatcgggcaatgggactcacaatggcatcttggttagaaacataattccagattttattaaatactgttgcattataaacattatagactttctacttctacattctcagctttctgcaattaaacctagctctacacatacattaccatttcatgcattcattgttgattaatataatagcttgctgagtacgttgtactcacccttgctttaacccccttctttcagagttaatttggaattcttgccgaagccgggagttcaattatataagttagtcttatataagttagtctcatctcaacctaattcgcaaatatagattagatagatggtttaagtctatagccaaacattagggtcaagtcattctatagcttctgttgtaatagttagccacaaccttgtaaataccctattatatcacataaagaagtctcctttggagccttgatcaaatgtatgcaatgaagatccagattgttgaacctgtatcaatctactgatccagggcttgatacagttaaacatgtcggtttccgaatcattagttctgggacccgacagcgttgatatcagagcatatgttttactagagccttaaacccataggttttctaacccccttcatgagtaactttcccacctatatagaataatttggttaaaaactaaaaatttgcctaataattttgctaaggcctttattagaatgaactccccttcaccgttggttttatttttttgcttttacttatgcatcatatctctctttcaaaagaataactattttaacaataaaagtatattcccctccgaagacccttgtccttgatatttcaagaaagtcagtgggtacaagcctttgattatgccagcatgagctgagtttattgcaatccaagcaactaagaatacaagttctgaggaattatttggtgaagcaaatatgtgtccatattgtcaatataatagaagaatattggaatataagtggatttctttaagggggggggtagttcaatataagaactatcaggattcaaggagccgttatatttgaacatgaacaaagtcttgaagctcatatcgtgaagaagaaagaagggatgcatattacgaaattttggaattttgataaaagaatcctttgagtagtatttatgaaaatattgtctattcaggcagaaatgatcgaagacattctaacagtttacaagacattatatatatatatatatatatatatatatatatatatatatatatatatatatatatattggactagggaaatatgtgcaagatgaaaaggggatgtcatattatatgttttgattttatgcgaagaaaggatagtcttgatccgttgatatctatcaagatctatcattgacatatatacaatcaagaagacatacaatatgaagccaagtgacagttcaagtacttgagaagcatccagatatttccaaacaaataagtgactcagaatgaaggattcccgagattatagaaatctagttgaagaacttccaaatatacaagactcagaataatttgaaagattccaagagcttcaatttcagggagtagaagatcaacagactggtgatgacaataaacatgcaaattaatggacgcggtctgaagaaagttaaccaaccaagaaaacatttgttctgaagactattgatgtaatttagaagggaatcatctcttccatccatatatacaaaaaaacccctatgttatcataaatcataggtagagcgaattatcaaagaatacactaatatgaggttatatgtatataatgagagcggttatacctatagacatcatactattatggagcaatgcatggagtaacaatttcatgaagacaagagctcctattggttaagtggcacaaccaatcaagaagaataaatgaagcttcagaaggaacaaaatattcatggaatatttgttgccgcgctgaatgaagatattttttccaagtatacaagtacttacattaatgaagatagctctttctgccaagctaaaactatgactggataaaaaaaagcaagacctacaaagggagtctgaacagataaatctaagcaacataacgacattgtgtagagaaaatggaataaaggtttatacaagaaaataggatagtaacttatgtgccatagtaattacgacacataagcatgactattcataatttgaagattacatgataaagtggacacaaagaagacctaggacgaccgactatgaaggcctgaataaaagaggtattctattcaagaccctgatctggaaagatggatatgaaccaataattattcaagatggtagtactgaaggaacttattatactcatttatcctaaatatataaatgggtatatcagaccaggagaaaatatctgaagaaatcaaacgatacaaaaatacgggttagagacatataaaattccctcaaggcatgacagataatttcactactcggatacgtatgattggaggaagaaaatttgcaatttcgacaagtaccaagattctgaacaaatattgacaataaatttggattaaaaaaaaggatatgaaccatctacgacaaatttccttatttttagtcatagattgagttataattttctcgactcgagaagaatcagcatagaagaccaagaatcaacaagaggaaaataattagaggacacaaaattattggttgaaaatataccttgaacaagatctctccatggttttcgtgaccatacaaaaacttggagattcatggctagagctagagatttgtactcccgacaagcacaaggattttgaatggatatcggtggtatatttggataaaaagaacataaattgtttatagcaaattttgttacccacatttgaagaatcaagtcaacaattttctggacaccacgaagaccatgaattaaaaagaagaaagtgtctcgacaaacattttcaacccaaagaactatacaccatgccaatcatgttgaaggcaaggttatcaatgtatagcaaaaatagagatggccaataaaagtgcgactgaatggaatggtttactttaggaagcaatgattacttttatgcagtaatcaaacatgtgatataatttcttggagaaagagaagttctggaataaattcactactatttaaactctatggattctgaaatatttcatgatatttcctaagtacgggtagtgaattatgcacccggattgctatgacataccttcttatatgtgacacgcaataaggagctaacacatggatttgtactaaaggaaatggttagatatagttagagaatataacttcaatgctcgacactattcaacaagttgtaatcatagaaatacagcatgtagttaccgcaagaaatgccgcaagggaatgcataagaagaggatcggtgactacgaataattagagaattaagaaacaatacaaaactatgagtcagaaatctaagttagggagttacaaaaggttggaagaaaatattgtctaagaagacattgaagccatgaaacgaagaccattcatcagctctatttcgaggatacgagcggaagtccgaccaccccaatgaggagcagaactagaagatcatagtaaacctcatcgataggtatcatgactgcataggtgcaagaaagattcaaagtatacatccaagaatacaagttatctatcagcagttgaccaatcgggtatccgaaacttttgaaaggaataaggaaagaataaagttcctatacttctacttgtactcttcagaaatctcgaggacgagatttatttaagggggcaggtttgtaacatactgaaaattagctattttctaattatgcatcatgccggttcttatgttcttattaaccttctaaacctaggaaaatataattagagagagacctcctaaaactaacttgcataaaatccctctttgatatttaaaagcttttgtgattttcatttaaaattatcttgggatatttcttgatttggttttaatttaaaaccttctattgacaaaattccttttattcaaatttagtttaaaaaccctttccacttttatgaattatggtccaagaaattctccatcattgtcctagaacctaaaccaagtgattccaattttataggaattaattgtcgatccatcctttgattcgaaacctatccttaactttcttccaaatccaaattccttcctttcgatctagccactaatttaattcatgtggcttgataccctctttggcacaataataatatttttttgaataattgctcttgtgctaagaaggatatatttttattttatttccctcttccaaattaatctccttttagcctcaaataattttctaaatccatgtcaggcagtttgtggctaaaaatcctatttatttcctctctttgttttcttacctcattcccaaaaatattttgaggaattatattaattccctcccatttgagtctttaatatttagaccacattattgcactcaaatatttaggaaatatctcttttgaaagttatctccaaaaatagattcatttcaaaagttagccacctaaattccttccaaatattaatttggattcaaacttccttcctcaaatatcttccaaaattcaaaaataacttctatttgcttttgggccaaaattcccttttcttcttctatcggcccatctccctcttggcccaggacggcccagccaacccttccagctgagccgcccctctcctctctgtgggcgccaatgccaggtgccctgggcgccgttgtcgtgcgccgtgatttgcgccgccgccgacgccgtgccgtaccttcctctgccgccgccaacatccttccgtcgccgttaagaaatcaagtcggcgttgttagattaatgggctaggcccaattaaatcctaataaattccattggcccacattaagtgctatgggtaataataccagctttgaaatctaagtgaagagttctcaacttaaatacggagctagtggaaagtctctgttgaccggttgagatggtgcgcggacaaccaggaggggcgaggcgaggcgaggcgaggcagacaattgctgctgctgcgctctctcattttgtaacggacggtaataaacacggagaattgatttcgtatcaatgaacgcgtcggttacggaattaaacgccgtgaattaatttgattctgttggttacggaattaaatgccgtgaattgatttgattccgttggttacggaattaaacgccgtgaattgtttccgtattaacgagcgcgtcggttacgaaattaaacaccgcggttgatgactccgaacgttactctcgcgctcgcatatatatactccgcagcgaccagaacgacgacgaagttcttcacgactcttgcacttcgagttcctcctcctctgttcctgagctgcaaaatccttccccggttctgttcacctgcactcacaggtgtacaggacgagcaggtgcttctggaactccgtccgcttgagaacttgcacgggtaggcgggcgatcaagtttttaggtagcgcttcaagcgcgactgctcctgttcttcgcgactactactgctacatcgacgcctttgtcaacatgtcgacggagattggagacaaggaggtgaacgacatcaacggaggcaatactgcctcaaaatccagcggtgggacgttcttagggtatagtttcattctcctgattctattagatgtttctatgttgatgttctttgcaatggcagcgttgcgttactctgtaaatgttgatgcttatttcattttaagcatgctcaagttgtatacatctagcactatcgctagatctactcatattgcaaatgtcatgtttattgtcttaatattttggtttaaaatatgccgaattatgaccaaatttccaacaatcccaaaacttgataggtctttttcggtagttggctttgctgcatcactaaaaccacatgctttcgatggttcaaattataaaaaatggaaagcacgtacacttttatggttgacggcgatgcattgtttctttgtctcacggggcaaaccgagtgaaccgcctctctctccagaggaggaggctaagttcgaggcttcggattgcctgttccgtggagtattgatcagtgtactcgttgactatatagtggacgtgtacatgcacatgccttcagggaaggacatgtgggatgctcttgaggccaagttcggggtttccgacgccggcagtgagcggtatgtcatggagcagttctatgactacaacatggtcgatgaccgttctgtagtggaacaggctcatgaaattcagatgctggcaaaggaacttgggaacaacaactgcgagttgccggacaagtttgtggcggatggcattattgcaaaattgccactttcttggtcagactttgctacttctctaaaacacaagaggcaagagttcagtattactgatcttattggctctttgggtgttgaggagaaggcaagggcaaatgacaaccggggcaaaaagatcgagggaggttctagcgccaatttggtgcagaagaagaaccctcacacatcccacaacaacaacaagaaagtcaaacttgacgttaaacccaaggctacaaccaattttaagaagaaaggcaagggaaaggcaaaaggagattgctttgtgtgtggcaagcctgggcattaggccatggattgtcctgagcgcaaggacaagaagtctgcaaacatggttattagtgagggcggaggaacattgtggtatggtaaatttttacctacagttctctctgtctgtcactcacctgattggtgggttgatactggtgctaatattcatgtgtgtgcggatatttccctgttttcttcttatcaagtcgggagaggttcctccttgttgatgggaaacggatcgcttgtggctgttcatggtgttggtacggtcgatctgaagtttacttcgggaaagatcgtgcagctgaagaacgtgcagcatgtcccttcaataaagaagaatctagttagcggctctctactgtgtagagatggttttagacttgtgtttgaatacaataaatgtgtcatatctaaatatggaacgtttattggaaaaggttatgacagcggaggtttgtttcgcttttccttgaatgatatgtgtaataaagttgtgaaccatgtaagcgatgataatgatgagtccaatgtgtggcattcgcgactttgtcatgtgaattttggttgtatgacaggcttagccaacatgagtttaattccaaaattcactttagtcaaaggctctaagtgccatacttgtgttcaattaaaacaacctcgcaaacctcacaaggcatctgaggcgagaaatttagcaccactagaacttgttcattccgatatgtgcgaaatgaacggcgtgttgactaaagggggaaagaaatatttcatgacattgatagatgattgcactagattctgctatgtgtacatattgaaaacaaaggatgaagcattacattactttaagatctataaggctgaggtaaaaaaccaactggaaaggaaaatcaaacggttaaggtctgataggggtggagagtatttttccaatgagtttacttctttctgcgaagagtatggaattattcatgagaggacgtctccctattcaccctagtcaaacagggtagccgaaagaaagaaccgcactctaactgagatggtgaatgccatgttagacactgcagaactttccaaggaatggtggggtgaggcaatattgactgcatgtcatgtcctgaatagaattcctactaagcataaggaagtaacaccattcgaggaatgggaaaggaagaaattaaatctctctcacctacgcacatggggctgtttggccaagataaatgtacctatagccaaaaagcgtaaacttggaccaaagaccgtagattgtgtattctttggttatgctatccacaatgtgggagataggttcttaatagtaaattctggagtacccgacatgcgtgttggtacaattactgagtctagagatgccacattttttgagaatgaatttcctatgaaaaatgcacctagcacttctagtcaagaacctattttatcccctgagcactttgtgccgataaaacacattgatcaaacgcttgaggaaaatcctaaggaggataacattgtagcaactcgaaagagtaagagacaaaggactgcaaagtcttttggagatgactacattgtatatcttgtggatgatacttcaagaaccattgaagaggcatattcatctcctgacgctgactattggaaggaagcgatacgctgtgagatgaactcaattatgtctaatggtacttgggaagtcgtcgagcgtatatatgggtgcaagcttgtaggatgcaaatgggttttcaagaaaaagcttaggcctgatggtacaattgaaaagtacaaggcaatgcttgtggccaagggttatacccaaaaagaaggtgaggattttttcgacacttattcaccggttgctcgcttgaccacgattcgagtactactcgctctggcagcctctcatggtctactcgtccatcaaatggatgttaagacagctttcctcaatggagagttggaggaggagatctatatggatcaatcagatgggtatgtactagaaggtcaggagggaatgatgtgcaagctgttaaagtccttgtatggtctcaaacaagcgcctaagcaatggcatgagaagtttgacaatacacttacatctgctggctttgttgtgaacgaagctgacaaatgtgtgtactatcgctatggtgggggagagggagtaatcttgtgtttatatgtcgatgacatattgatctttgggaccagcctcaatgtgattgaggaggtcaaggactttctatccaaaagctttgaaatgaaggatttgggagtggctgatgttattcttaacattaaactactgagaggagatgagggtgggattacacttgtgtaatctcactatgtggacaaggtcttgagtcgctttggttatagtgactgcaaggcagctcctactccttatgatcctagtgtgctattaaggaaaaaccgaagaatagcaagggatcaattgagatactcccagattattggttcattgatgtacttagctagtgcaacgaggcctgacatctcatttgctgtgagcaagttgagccggtttgtttcaaatccgggagatgatcattggcatgctcttgaaagagtaatgcgctatctaaaagggacaatgagctatggaattaactacgctgggtacccaaaagtactggagggctatagtgattcaaactggatatctgatgctgatgagataaaggccacaggtgggtatgtgttcacacttagagggggtgttgtttcctagaagtcttgcaagcagaccatcttaacgaggtcaacaatggaagcagaactcacagctttagatactgccacagttgaggccgaatggcttcgtgagctcctgatggacttgccggtggttgaaaaaccagtaccagcaatcctgatgagctgtgataatcaaacagtgattattaaagtgaacagtttgaaggacaagatgaagtcatccaggcatgttaaaagaagactgaagtctgtcagaaagcagaaaaactccggagtgatagcattagactatgtccagatggctaaaaatctggcagatcagtttaccaaggggctaccacgtaatgtgatagactgtgcatcaaggaagatgggtttgagacccacttagagttgcacaatggtggaaacctgtccattgtgatcggagatcccgtgaatttggatggcgaaacaaactattgtgtaactgagagaagagaccctaaaatgggcttatcttcatgatgcacttctcttctaatctgtatggtaggatggtatacaccttaatgtgatccgagtggctttccataaagcagagatgttggcctacagaacatcttagaaggaacacacctatatgagtctgattgctagtcacaatctatgagatctgggtgatctctagatactcatgaaaatgccaggagtatgacttatacgctccaaacagagaggatgcaaacggcagcctagtaccagttaacggtttgagtgaaacctgaatcacacaagactgacaattcaaggcatagtccattgtttagttgtgatctggtgtagttcttttcctaggtggaagttcaacttaacagtctccaccgaaacactggtataacaaacaggataagaatcgagagcatttcctgtgagccatgaaatttggtggggattgttagattaatgggctaggcccaattaaatcctaataaattccattggcccacattaagtgtgtcggtgacatggggccgggggtatcgtgactagaggcttgggtagccgcggtcacccacgtggcctgaccccctcgggggggggggggtc

SEQ ID NO: 60430 - DNA, 34572 bp, Oryza sativa
tttagttgaaattggaacgatgagccgaaaaagttatgtgtaggaagtttcgatgtgatgtaaaagttagaagtttgaaaaaaaactttgaatctaaacacggcataactcaacacgtgagcttgttgaacagtattatcaattggaattcggagagttgttgatctctctctctgttcctcgtagctatattcttgctatccacgatggctgattggaattggtttttgatgttaactggacctccgcaaaccctttgtagtactagtttgtaattttctttagtctcaggttgtaaattgggactataaatacatgactgaagatttttatccttagtctcggttaaaatacccagaactaaagatttttttttattttgcttgtgctgcttactacctgattatacgtttaaatatgttatatatatatatatattgaaaatccgctctaaatttaagattgaaaatttaaattttagctgctaaatataagcatgagagaaagatgaggccgtctcggtcgttatctcgtgcaggacacgtgtctcagtcataatctcaatggctctcaaagcatcccctcaaaatcgtattaattagtaatgtcattagcaacaaaagtgactttgacgtggacttgttcttccagcgcatatggactttctcccagcgcggcgctagtcgcggcaccagcagcaattgcgtgaggacattttcgagtacagcagagtgccggcgataccgtgtgggatggcgatggcggaacattttcgacagcagcaaggcgctgcgcttggctcgtgttcggcacgggaggtcaccgcccgccatcccgcgctcccctttccagaccgagtcgccgccacacgccccggcaagcgaaggattctaaacaaagatgtcaacctgtttattgcatgccaactgaataattatgagaaattttcaaaaaaattgacaagatagatcaatatgtaatatataattccacaaacatacaagtttaaattcaacttctacaagttataaaaaaataacaaatttaattgtaaatatgcatatagtaatttaagttttgtttgttatttttattacaactagaaagatagcccgcgtacatgcgcgtgcacctaatttaatatgtgtgaaattttataacgaatgtccatgtatgttggtgatattgtattaaaattttattttactatatctaaattaaaattaaacttatttaatgtgctttgaatgttggttatgattttcttctaattacccatgcagcacataatttctaaactaaaattaatcgaaaccgtatagttttcaatttatgaaataatattatgtcgaaacaatagatgtagttcctatgagaaaagtttgggtattttgaatccccacagggatatatcacccagacatccctaaaaagtcccatttttttttgttatattctattcaaaattttagatattttcattctgtttgtcttgctaaaatatttgaatatttctatttagaatgggtttaaacccaacaatttttttaaaacatttacataatttttgaattcatttcatgtccatttttaaaattttttggagaattccactctatcaagcatctttgaaatgatttcatctctgcaatttgggctaaaaatatatgtgggttgaaccaacaacctcacatggggtaaagtcatatgttctaaattatctctcttcaattgagtaacaaatattaaaatagaggtcatataatacatacacatttctagattattctccgctaaatgttaggaatttactatgtagcgtagcaagttttaccaaaaagaaataaatgaacatggtctttaattcccatatggaattgactcactatattggtaaagccacctcatagttgtttcactgctaagatttcttggtacaactcacctgttcggaatgatcagtacgatgttcaaccgagcacattttaatttttaaaatggcgtctttaaaaaaaataacgctagatggggtacacaatatgatagaaaaattgatatcatttaaatatttttctctaaattattagtgacttcatagatcatatatataattttatctcctaaaaagatcagttattgataaacgcaccaaaatcaatttgtataggtaaatagcccccatatacatgttgagagaaattaattaagttgatagaaagtttataagtgtctaatgggatataagtaatgggtgtaccggcttaagatgagatattttgatttatagtgatgaatttaagttttttttatttagtggaggcctcaacatggatgtgggtctgtgtaacatactgaaaattagctattttctaattatgcatcatgccggttcttatgttcttattaaccttctaaacctaggaaaatataattagagagagacctcctaaaactaacttgcataaaatccctctttgatatttaaaagcttttgtgattttcatttaaaattatcttgggatatttcttgatttggttttaatttaaaaccttatattgacaaaattccttttattcaaatttagtttaaaaaccctttgcacttttatgaattatggtccaagaaattctctactattgtcctagaacctaaaccaagtgattccaattttattggaattaattgtcgatccatcctttgattcgaaacctatccttaactttcttccaaatccaaattctttcctttcgatctggccactaatttagttcatgtggcttgataccctctttggcacaagaataatattttttttgaataattgctcttgtgctaagaaggatatatttttattttatttccctcttccaaattaatctccttttagcctcaaataattttctaaatccatgtcaggcagtttgtggctaaaaatcctatttatttcctttgttttcttacctcattcccaaaaatattttgaggaattatattaattccctcccatttgagtgctttaatatttagaccacattattgcactcaaatatttaggaaatatctcttttgaaagttatctccaaaaatagattcatttcaaaagttagccacctaaattccttccaaatattaatttggattcaaacttccttcttcaaatatcttccaaaattcaaaaataacttctatttgcttttgggccaaaattcccttttcttcttctatcggcccatctccctcttggcccaggacggcccagccaacccttccagctgagccgcccctctcctttctgtgggcaccgatgccaggtgccctaggcgggataagttcactttgggtctctctatttgtcgcccagtccgattttcgtcccttggtcgcaaaaccgggtacaactggtcccccaacttacgaaaccgtttaaataaggtccctcagcggtattgtacctggtttttgctgacgtggcgtcgacgtggcttctttgactaggtcttcgtcatacatggcattaacgtggcgcttacgtggtaatttgatccctgaaaaataattaaaacagtgggacccacatgtcagcttcatatccataatctttccggtcagcgaagaaggacaagcggccgagccggagcggacgacgccgacgaccggagcaagctggcgacaagaaaggcggcgccaagggccgggagccactctcctcctccttgtcggccgcgggcggggagatatcggcggcggcctcgacggggagccgctctcgctaacggtggccgcggaaggggagatgtcggcggcggcctcggcgggcacaccccgctcctctcccgccgcctaccgcccaccgcaccccgctcctctcccgccgaagcccgtcggcgggcgcaccccgctcctctcccgccgcctaccgcccgccgcaccccgctcctctcccgctgtcagccgcccgccgcactccccctcctctcccgccgtcagccacccgccgcaccctgcttctctcccaccggcatcgttgaagcatacagagccacagaggtagatgaggttgaagaagtgggacccgctgacatgtgggtcccttttttattttttttactggcatgtgggtcccacaaattttgtataatttttttattttgaattttgatgtttttattttttttcggatctaattgccacgtaaacgccacttcaatgacatgtgagacaaagacccagtcaaaggagccacgtaggcgtcacttcagcaaaaaccgggcataataccgccgagagacctcacttacatggtttcacaagttgggggacctatcttacccggttttacgaccaagggacgaaaatcggactgggcgacaaatagagggacccagagtgaacttattccccctaggtgccgttgtcgtgcgccgtgatttgagccgccgctgacgccgtgccgtaccttcctctgccgctgccaacgtccttccgtcgccgctaagaaatcaaaaagacgtcagccgcacgtcacttcgctgacatcaaacacgagccgaaccgacatcgatgcccaatcagaggacgagaccgacgccgtcatcctccttctcacgctaccatcgccgtgccttcctcgtcctcctccggtgaaccgacttcccgactcctataaatagccggtgaaaccctctattttccccacatcatccgagctctacgagctctctcttctctctccaccatgaccggccaccactaagtcccggccgatctcctcccctacagctccacttctcgaatccttgcaccactaatctctcttcactccggcgaatccattttgtccatttcccccttctctctccctccaaactaagccaccaccattaccaccttagccggccgaaggtgagctagtgttgccgctgttccggccaacccacccttcctctctcccaaccaccaccctccccgggtgtgcgttgctcgggaacacgttccgccaccgacgtcaccgtcccccatccactggagcaccggcgtccctctctccctctcctctcgtttactcggctgaagaagaagaaggaagatacgggaggaagaagaagagaaagaaaaagaaaagaaaacaaacactgacaggtgggcccctgcacagtaactcttcctattttccctatttaattcaaatccaattctttagaagcccatatctcctaaaccgtagatccaattccaatgaaacctggatctaaattcatctaaattcaaagctatattttgatacctaatttgctattttataattttatttgaatttattcaaatatcatttgaatttatatttgcctttttcaaatactttcttttaccccaaaatacctattagccactaaaatgccgccgattggaactttacgtcttccatggggacgtttgcggtctattggccctgacgtcgaaccgttggttgtaaagcctgacaaaacccaaaccaaaggtcgaagtgctgctcctggcatcttacgcctcgctgcgtacaacggtcggagcttcactattccctcgaccaccatagcacactgcacagttagctttcgggccctgtgtgattctaaccgctctgccgccactcacggttgtcggagtaacacttccacctcgctaaacctgcacaaacctcccatccctctagccgttagattgtctattaataccggctagagaagataccaaacctagtcgtcatgctttagcgacgactagcgaacacccaaaccctagctgatatttatcttagctcgatatcggcttagacaattgaagccagacccccaccagctataatctcaaccatttaccctccaactacccatagcctatacatgaaatacgagccgatatgctatcgtatttcagcatcgactcgagaacaactaaatcctagccattcttctaccaaagccaacctcgatcaatactagccacatatccacttaaccagttagattattcaatatatctcctactctccaagaaaccaaaacccacacatgaaatataagcgacattagttgcttaatcccctctagcctccaaccctttagaacctccacatataatattagctcaataatccctatgtcctataaaagagataggctatatcctaaaaccaagccctctttaccgtttatcgttttctcgttattttatgacttttattgaatttggttcttcgtctttcttagtagagtctattatcttttggatggcaacctgtggtatttcgaggatcggataatcaggttgcttatcttgaatttatttgcgttggagcaaggcaagttattatctctctcctttgagcataattatcctttattctatatctccattatctcatgcattagtcattcatgatttcgaatgcgtaacctgaacatagcaaaccagatatgctagctttgcttagccctgcctaattagactgcataaaatataatgaacttagattggaacaatatggtagaaatggttgatttccaggtggctagtactgttccaaccgacataaaactgccaagtacatgtgaagaacatacgagtacgaccgcaattctcgtatgggcatagacctagctgattaagttatctagcaaaggtggtacctctgtatagtggtttttcttaagtcctcgcgcaggaggcaaatttatgccgtgaagggcaactgtgatatttatcgaggcgcaggtaaatatatgagatgaattgtgcacaaattgtttgtgaaccctgattgcgatgacatggtgtcatacaatcagttctctctaaagacctcgggaacgccagaactcctctcgctgctgataacgttacgttcagagtgcatggggactagagttcatggaacaggtaccactaatgttagtaaccgaaaagctttgccatgacaaggctaatgtgtttggcacgtcatggattgtgggtaaagcgtacatctactgtttcttaaaactattcgaatagccgtgctcgcggttatcgggcattgggactcacaatggcatcttggttagaaacataattctagattttattaaatactgttgcattataaacattatagactttctacttctacattctcaactttctgcaattaaacctagctctacacatatattaccatttcatgcattcattgttgattaatataatagcttgctgagtacgttgtactcacccttgctttaacccccttctttcagagttaatttggaattcttgccgaagccgggagttcaattatataagttagtcttatataagttagtctcttctcaacctaattcgcaaatatagattagatagatggtttaagtctatagccaaacattagggtcaagtcattctatagcttctgttgtaatagttagccacaaccttgtaaataccctattatatcacataaagaaatctcctttggagccttgatcaaatgtatgcgatgaagatccagattgttgaacctatatcaatctactgattcaggacttgatacagttaaacatgtcggtttccgaatcattagttctgggacccgatagtctggaatgtaatttttatgttagcatttaaatatagtcaatatggatattaaagtattgttttcactaaaaaatatagtagttcaaacatatcacaagttgaatatgtgatttaaaaggttataattattttatttatattgttcctataaatgctagtaagaggagaaagagaagaaaaggaaccatggaagagctggctagacctgatatgtggaggtccattaatggttttctccccataaagataatttaaatttcaattatcataaggataaaactaagagaaaaggatgaacgacgcacaccacatggggatagggagggccggatatttttcttaaaaaaataattgatatgatgacctaaaataatgcgttgcatgtttaagtcgaaaccgatagtcaggtgttttgttttttatcataattttgtacgattcttttaacttatgagagacctgtatagtggcttagaaatatttataggatgtttaatgtataagtctttaacattgtttgggtggggagcgtggaaagaaggtttggtattgtcttaaataaaaatctaataacaacctaaatggtacgtccatcggtttaagtcgaaaccaatgattagatgttttgttctgaaatttttaagatttttctctaatttagaagtgtcacatagtgttttagaaacatttataaggatggctaatgggttttaatgctgcataggatcgcggtgggagtttaggatgttttttttttgtaagaaaaagatatatctaataacctaaaataatgtaaacgttactcgaatgttttatttttttagattttctctaatttagtagtcctatatggatgtttaggaatatcccttctttctataaagttaagaccaaagctgcctcttcaattcgccacgtcatcaacattatattagccgttcgatcaatatgtacatcagatatacaccattggatcccttatcctcttgcccagcatgcatggtaatcaccttgctccttcccattcccctcccttaatcacatgcattaatttacagtagaaacagccaaatcaattgagccaggaggtgcgatggttaataagattcatgtgcctcttgcgattctcttccaaaccttttaataagcccctttacaatccccactataaccaagtctcttcccctttgcatgaatcttttcatcgtatgttggattctatttggtaagcctgaatttaacatttattttaaccagattctatttgagtacacattatgatttgaaccaagcatgagcactatgaaagttttgtccattggtttctctgaacttcaagaaagaatccctatcctatgcatttattgttgttttagtttcttaagaaaagattcgtcatacttgcagccaatacttatatgtcctatcactaatttatttgagtagttgggaaggatatagaggattacaatatagctgtcctgacatagcgagaagcagcttaacttgctcggtatgtattttgttttcaggttcaaacaatacaatctaattgtccatactaatatgcatatttacatacgttctcaaatgtgcctgcagcgaagcgcggggtttcatctagtttatatgatgtgtaatgaacttattaggagaggctagaggaagagctaaatagatctagtaggttaatgcttttaaggcctgtaatttttttaattttaattattatggaaataaaaaaggaaaagaaaggaaatggagggatcgtacctacattgctgtgaagatgaataatgcgtacgttgtggaggcgtacggtagggatgaaaaccgatcgaatacggtcggaaactagctctatcatatttgttttcatattttttctcggaatcgaaatcggaatcggaaacccggatacgaaaacggaatcgaatattatcgaatacagatacggagcgaatacgaatcgaaatgaatacggtaacgaataattatcaaaatatcaagacccctcaaaataagcttcttaaaacgaggaagagatgtagccattagttttcaaaaacaaaacaatagtattctcaagctgttgactgagttttcagggtggtagatgtctaagctaatctaatctagcaaggcgatttagccaataccggcataaaccctaaaacgagaagcagccgatagagctaaattgatatgctaagactagattaacagagacatatgataaataggtaggcaaatatatcatccaaaccagagcaatccaagaggtcgaatgtactgatgcagccttgaacaacgccggcatagacgatacaattgcctaggccgacggaatattgaacttaccccttcgccggagatcgaacaccgatgcagccccgcatcaggtgccaagtcccgccggacgataaaataaagtagaaaaggtaaaagggtggcgatgcgccgaattgtattgatcgtcgagatagattacatagaccccgggtgtacatatttatacccatgggttgatacaagtccttgttggacaagaaagaaactttcctaaagataaaaggaaaagataaagtccttataactaaacacactttcctaaagataaaaggaaactaacaaactattcctaattaatagataacttgccatgccgcattctctttgaactcggtctcttctggataagcttcctttagtagatcaatttccttaaccgaatatagcaagaatccgacaactgacgacttgacaactctcatcggctaatctcaggacttcgaagccgatgctgactctaagccgatgactacttcgggctttccaaattccactgttaacagtcatgtatcaggtcatggatgaaaaaacgccgaaggaaatttgggacaagttggcaagcctgtatatgtccaagtcgctgacgagtaagttgtatctcaaacaatagctgtatggtttgcagatgcaagaggagtcagatcttaggaagcacgtggacgtcttcaatcagttggttgtggatctaagtaagttagatgtgaaactggatgatgaagacaaggccataattcttctgtgctcgcttccaccgtcgtatgaacatgtggtgactaccctgatgcacggcaaggatactatcaaaactgaggagataatttcgtcgttgcttgcacgagacttgagaagatcaaagaaaaacgaggcaatggaggcttctcaggctgagagtttgctggtcaaggcaaagcatgatcatgaagcgggggtgttgaagagcaaggagaagggggcacggtgctataagtgtcatgagtttggacatataaggaggaattgtccgttactgaagaagaggaaagatggcattgcaagtttagcagctcgtggtgatgattcagatagcagtagtcatgagattcttacagtgtctaacgagaagtctggagaagcgtggatgttggactcagctagttcctatcacgtgacatcggagcgggagtagttctcttcatacaaatctggtgattttggtgttgtttacttgggcgatgacacgagttatcgtgttgttggaatgggcgatgtcaagttcaagatgtgagacacgtgccgggactaaggaagagtttgatttcgcttgggagcctacatgagataggttggttgtatcaggtggattctgataggaagaccatgaatatcatgaaggacggcaagactgttatgattggtgagaggacaagctcatgtttgtacaagttacaagggagtgctgttgcaggtggagtcatggaagatgggtatgctggtgttgctgtgcacgatcctgaaggcggcgagcctggcgtaggctcgtcgggcggctcggcgtgagctgcggcagaaccaactcaagtcctggtacacgaaggttcgagctagtaacagattcggattggcgtggcatattcgccaaggtggagtttgttagagtttgtgtcgaatatgtgtacgtagtcggttacagtttaggacttggagttgtaataggtattaggactagagtatgagttggactctatcctaggttctctcataaatagaggagcgtgcctgttgtaaccgcatagcgacttagcatagcgagagggagcggctgccggcggcgaccggccgttagtcgttgtaactctgatacgctgtatatgctggatcggggaggagcgcccgtaatcagtaccccggagatgtaggccttggctgaactccgttaccaaatatcgtgtctcggtgtcgtcatcgttttggatctcctatggtgttttcttccgcggtttggtttccggtgtgatttcggggccggttttataacaccacgcatgccacacgctcgcacgcgcacgcacgaggacgaacgacgaacgaatgcacggacgacacctccagcttcccgcctccgtatttccttcgtttctcaactagaaggctcaagactggaggcaaaagaagcgcaatttcaacctatttcacctcctcaaatccgcccctactcccactaactcaatcgtcgtcaccggaggaaaattccccgaaactctaataccggcgccattgattgagctccaaaattcatcgcatacatcgccaatcctctgaaattgaaggtaaaattggattctccatgccgagtactccatttcccctctcattacacatccaatccatcgccggaatgctgccggcgctgcctcccggcgtcgccgctctgttcggccgcagccagccgcatggcgcgccgccgctccagggcgccctagctttggccgtcgccaccctgggactcctctcgcctcactaaacctcaccaggccgcctcccgcaccggagtttgccggagtcgccgccaccatggccgcctccgcctcctattactgcccgccgccgccagcctcgccaccggcgcttctctcgctgccgaccacaaaaacggaatcgcctcgacccctagataacaaaatcggcgcccccttgtccaaaaccggcctcctctgccgccggcaatgtgggattccggccagttcatgtgcagaacgagaagaacaggaaatccaattttcctattgaaaaataaatcagaaaaatcctttttatttttctatcaggttgaccatccgtttgaccttaaaatcgaaatctgagacctattccaaactcctagaattattctgaatccatcagtatcagttttgttgcaatccgagcacccgttgtcgcgaccctaattttagccctagggttcgccattctccgaaattccaaaaatccctaaatttaattatttaaaatcctttccacccattgttgcactttgtgatactattttcttttgtttatctttgtttttctgttatttattgtggtgatgattgttgcgtaaatagaaaacgctgacgttggtccggtagtcgaagcgagtgaaatctccgcaccaggaggagacgatttgtacgactacatcgcgcccgaaggttgcaagacatgcaccctcccttgaacaatttaatcccagcagttagagagttattttggtagcgtacttgtcctttggagtatgatagactgcacgaattattttaaattaagtatattactattattgcattatattttctgttgttgttataaacaccttaatgagccttagagtctaactaacttaggataaaatttgagaaacacttaaacaaactgttaattatttaatatgatattgatttaatatggatattattactgcatatgaaaacatgcttatggaactatttatggctatatgctaagaattgatcacaccacatgtgagcgggtggtacacatgatagagttcatgtgtttggttttatggacctgcttatggtcatgatggatatatggatatatttatggttatttcttatttaaaattgatataataatcaacccccttgtgtcaataagaatgacatagtttcgcccatccacacgatcgatttgtcgaacctggccgtatattgctccaattgattgaacttctgcaggcctttcggtgcactggccattagctttcaagtatgtgaagcaaagtgacatggttcatgtttatatgatttatatatgtgggctcgatgggccccgagagttcagaattaccctatgggtccatgaagttctaggctgcccatcgagtaacgaacaatggtaagtggatgcggaggtaggttggcacacacctcggaccagatcactccgagcaacatcccgagcatcctttaacttataattactaggcagaagggagagatatatggagcaatattacaccttgttacttttcagcccggccagctgtgggtatcgtgtgggtaaagctgggcagacactgcagagtcgttgagtattcgaatacgccatgctcccggttaatggagatgtgtctatgggtgattcctgattatgggcacaagttaaactaaatggctatgaattaatatggttaacttatttattatttaatgttctattcatgttatttataagtaacattcatacttttatgctcgttattattgtttaaattaaatgttcaatagtgttgtttataacaaatgcttattaagataggctctatgaaataactgttaaggttagggtttaaaccttccagctctcaatactgcatgttgtatattgcaattattgtatttattatcataagcatgtcttgctgagtaccatttgtactcataaatgggttcagatcatgaagaggaagatgcatgtggagaacctgttgatctgttagagtgggacaactatggtttctaggtcatcctatgctcagacagttcctgtggtggagtctagcagtttatctgtttgtagaaataaggctttataggccatatatgtaatggtttgtatttatgttgtgttgtgaattaagtgacttaagtattgtatgatggaagtttatgcttttatatcatttcatgcgtaactgaacatcctgggcggttacgtattcgtgggtgcaccatgactttatcgggtgtccccacactcgagcggcgcgccgtgcggcggcggcgtcggcgggcggcgacgggttgtggcgggcgtgctcgcgcggcgggagggctcgagcgacgcgccgcaaggcggcgacggtggcgggtgggagccgtggccggcgacggcgtcggccggcaacgggcggcggcagcgggcagttggcacggccggctagccggctaggatttctggtttttttttttgctgaaaaatatctccggatatccgatgaaaaatgccagatagtttccgaccgttttccaattccgtcggatatcacccttactgtattcgttttcatatctgagaaaaaaaatccgaattcatttctgaatccgagaaattccggatatttccgaccgaatttttccgaatccgaaaattggtccggacggacggaaagcatccgaaccactttcatccctaggcgtacgtggacggagggagattttattttaatggaaagaaaaatctaacattaaaattattgggttcaccaatttaaatgtaaatcgatggtcagattttttatatgatgtgtaatgaacttattaggagaggctagacgaagagctaaatagatctagtaggttaatgcacattttaggcctctattttttttaattttaattatcatggaaataaaaaaggaaaagaaaggaaacggagggatcgtacctacattgctgtgaagatgaatagtgcgtacgttgtggaggcgtatgtggacgaagggagattttattttagtggaaagaaaaatctaacataattattgggtccaccaatttatatgtaaattgatggtcagatttttctattttattaaagtgacatgtggcgactcggggagagagagagagagagagttcaaattaatggatccactagtttgaattatctacacttcaaatctaatgtttaagatagtaggtttctggaaatggaaatggacagtaagttgtttcatttcttttatattttttctacattaaaattagtagctaccttcagaaattattagctatagaatagaataggattatataggaaggagagatgtagtactagaggaggaagcgtacatactacgtgtatgtccgtacgtagttgtagtactgtgggccggtgggagaggggataggagggagttgggttgtgggcttctttttttaaagataatctaataataaaaaataatgggtccacccatctattaaaatgccacgtagcgattgaggagtatttatagaaataacacgtggcagtttaggaaagtttgtaggaagtttaatgtacttttagtatataatagatagataatagataataaacttgtagaagttgaattttaacttgcattttgtggattgatatattacatattgatctatcttattcatatttttttaattttttttataactatttagatgacgcgcaataaacgggtgtatgtccactcaagctgttaaaacagtttccctgtatacgtggcaacgtccttcgataagcagagagactgacttcctaccaaattttcttcccttgcgaagcgtggctgatacgcggacaaggctttaccatttttcaatgctatagctgttgtgtattaaccttcttgcgaaattagcttttccaatacaaaacccaaatgcgtgcgttattcaagaacacataataggttatttcaggcaccacgtttcaaggttgggcaaattgctaaaacagaaaattatttctctcggcgtcagcatttcatgagcataatgtgaccatgcagcttcaagaattcctccaatgctgtcttggacgaaccaccgtcctccagagttcgaccaatcatcccctgaatctgcttcacactctgtcgtatcttgtccgccttcgccgtaatccccatcaccatctccacgacctcgaccaccctctcacgctccagcgccggggagtccggccagttcccgcgggacacctccacgcacgcgccccactcctccagcatctgggcgttgaagaactggtccgccgtgagcggccacgcgatgattggcacgccgtgcgccatgctctccagcacagagttccagccgcagtggctcaggaacgcgccggtggacgcgtgcgcgaggatgctcacctgcggagcccacccgtggatgagaagcccaatgttcttggcacgcatcctctcctcgaacccttccggcaaccactcggcgctgaactcgcggccgttggtggtctcgatgtcaaacccgaacggcggacggatagcccaaatgaacggcctgccggtgagctccagtgccatggcgaggtcaaccatctggtcaggccttagcgagttattagacccgaatgagatgtacagcactgacctctcttctcgggtgtcgagccaccgcttgacgtcatcgtcgttatggtcaccgatgtgatcggagtgctccgtccggcgacgcactagagggccgatgggatagaccgggacgcccatcgttttccggagcatgcgcagcccggtcgtctccaactcctccatcgtgctgatgagaatcgcgtcggtgtcgtacccggccgatgtctgccggcggtggtgggccgaccaccggtccgtgccgtcggcgtggagtaggtaaggcggaagctgcgaccggtggacagtaacctccgggtggtccgggaggcagaacgcgtcgtcaccgggcgcacgcaggtgcggcaagtggttccacagcgagtggaacaccacgctgccgaacgcgccgcaggagacgaagatggcgtgcgcggcgccacgccggcgggcgacgtctgtcgtccacgcgaggaaggggtcggcgatgacgcagaccctggcaccgtccgctccggcgtcggtgatcaagtcacggacgaagctgtcgaagctgtcctgtagcgagcgcgactcggtggcctcgaacagcgtgatgaagtggaggagcggcacggcgtcggtcgactcgatgtctccgggcaggccgtgctcggctggcgcgaacggcagggcgtggaaccggaggtaccgcgtctgggagctcgaccggcggcggaggtcttccacgttgcgcggggtggagacgatggtgatgtcggccgtgggctgggcgtcgtggaggtgggcggcgagggagaggaaggcggagaagtggccctgcgccgggaacgggaagaggacgatgcggaagctgccatcgctgggcatggtgaacacgttgttctttgacttcgaggttctccactggaaggaaattaaatttttgctttgtctgaaaggagaggaagcacgacagcaccggtcggtgtgtgtgtggcaatggctctgggtggacaggatgaacgatagggtggggagcgaggctgggaaggatgcgcttggcagttggcagacaggctttgggatgaacgacgatctcgcggcgtggggcagttggtaaggcttccgacgcgggatggggcagggaagcaatggtgtcgtggacttgtcctttggtttcctgtccgtgagatcgtgacgtgaggtggggccgttggatttgatggtcggggtacgacgcagcgcgattccgggcagaaaaagggcccttgccctgtttgcgccacagggctgatgcgaatgcgagggaggcgtcggcgtcgctcgcggctcgggtgcgacgtggtgctttgcgtgcggcagcggcgcacggcaggctccggcttggagggcgggcggtggtcaagagcgggaccggaggcgacgtgatgggacggagtcgtttgcccggcgtggtgtggcgacgagtgcgcaggagcagcacactggagtatagcaggcgcggcgctgcatcatgctcgcggtcgtgggcgtgcgtcggcgcgagactttggagggcgaccacggtcgacacggctcacggcactggcgctacagtccacacgattgagcgcgagactggttcgtcacggtgtagcggcggcagctcgtgctgctacgagcagcggcgcaaggcaaaggcaggcatggcccgcatgggcgcacggcttggctggcttggctggctgcttgaccagcaggcgtcctagccggcctggcttggctgtgggctgctagctgtgctgggctcggccagaaggtggcgacctggcctttttgtggttgccccgactggtattttaagaataactagcaatagtgccattgcgttgcaacggcaaaaacaccgtttgatagtgttgcaccttgaaaaccttaaatctgtaaaaatcaagtctaatttgatacattaataaataggtagaaccgagtctaatttgatcaattagcataggatttaggatttagttctagatttatttttctagactacttaagagtttatccaacggactttaatttgaaaaatgtgagccacattgtttgatcaattttgctttcggcctaggtcttcccaagccggcctaaacttgagctggcccatcttcagcgagttagagtcaattcgacggcccgcaagctgagcagctgagcgcggccgacgtatgcggggacggtccgatgcacttccgcggtccattgggcgcagcgtaatcaacggcagcaacggcctgacgctgggcgaatctgagtcgtccgatttaatggacggctccaatcgtccccgcaccggatgaagcgccgaccggggagaggggcaaaaccctagctcccaaatccctctctcttgatcacatttcctctccggcgacgagcgagcggaacgacggagcgagcggaggatgtttttttttctttttcatagtacaagttttttttctctttttttgttttttctcacctttatttttctccaccgaggagtcggatttttttagagtcggacattttttttgtcgatggaagttttttttctcttcgttttttgttttttctctctctttttttccaccggaggagttggacttttttttttctgatcttttgcttttatcgctttttttccggtctttttttcacctgtttttttttgcgcttgttttttagaatcggaaagattccctttttatttcttttcgcccttttttttttactgcggaatcggattcatttttcttttctttttttcgcgatttggtttctcttttcttttttttcgcccggttttttcggccgttttgttttggatcggacagattctttttgcccgttttttttttgacagtagagaatagtggtaaaactaaattttaagaagaaatagtggtaaaattaaattttaaaaataaacagtgcctcagcactatacttgatggcgccgagccgaggttgaacatcttagctttcaggtgttatattgaataaaatctggtggcaaggctgtgattataatcgatgtggtgtttgatgaacttgctcgagctaaccgatccttattaggaccaagcgctcagatgaaattcaagaagtgttgtgagtttttctctgtggttttattccagttggtataaaatatactcatacgtcccataatatatatatatatatatatatatatatatatatatatatatatatatatatatatatattgacggagcgttggggctcctcaccgggagaccgcgcgggcccccctttgccggttcggccgagggcgctaggtgaggttttaagccctcgatctgtggaatgtttcgcgagagagcaaatgcgcaagacacgggcgatgtagacaggttcgggccgctgagaagcgtaataccctactcctgtgttctggtggatctatgtacgaaggagttacaaggagctggagatcaaaagagttcaaactctagagaccctctcactctttctctctacgagctctgctctcctctttcttctttttcagctccctccagtctgttagtccgtcagtcccctctcttggtaggcatggtcctccttttatatctcaaggggataccacatataccatttctacctacccttcttttgggtggggacccatcctactttgaccaaaacttggctcgtaccttcgcctgacaccgggataaccctgtccttccttcattaatgggcggagatttgcaatggctgctctccgaatgaccctccgatgggatgggtcataccaacctccactccgccggaagcaggtgcaacgtgggagcacggttgtttgctgatgacgtgaccggcgtcagaccagtcacaaaccggtcattcttgtctaccacgcgtcagtttagcatgccacccgtcagcccttcttcgtaaaatgacttccttgtaatggttgcgatgaagcctggtatgaatctagccgggactgacgtgctaactccaggagttcccacgccggctctggctagggacgagtgtctaggggctctcatcattccgacgggacggggcgaggcgtgcgaaaggccgcctgttgccacctaacccgcgatctgaccggtctgtaaccggtcacacactgtgacctgtcacggaccgaacgagtgtgctgcgctgcattaaatgcggtgtgggacgctcgtccaacccgcgataaacgcggttaggtgagcgccgctgtgctcacctaacccacacacgtggcgccaaacccacagggggtcggggcgccccagccctcggggtcgaaacgggagcggcccgacccctcggggagacagagggaggggcggccacatcaccctcgggcccgacccccccgagggggtcaggccacgtgggtgaccgcggctgccccaaacctctagtcaagataaccccggtcccatgtcaccgacagtagcccccggcgttatgccagggcgatcgccctccacgaggaaaacgctcgggcgtgacgccactccttaggcccggtgacaggtggggccggtctctacaggcgagcaggaatccagtggtcgcaaatcgcgcgcatcggcaagggaaaaccgaccgacaataatgagcggctttcttcaagaccgctacattacttgagtagcacgcaaatcgggacgagccggttcgtttcgcctagagatgtgatgatggtgcatcggttggcgagcgtagttaacgcgcgcacgatatgtcccatctcgactgtcacggccgcacatccgcctcgtgcgccgcaaacgggcgaacgggattagtggagtagtgggcgcgagaaacgagggggcgagatagtgggcgcgggaagcgaggagccgggcatagcgttggcaagggtataaagacgccaaggaagagattcgtttccttcctcttcgccattattccccttgccttcgccgcttgcgctctaacttctcgtttcctgtgccctaccctcgccgcactcactcgctctcaatcccctcctctgccggcgtcatggcacggggctccgcaccgctcgacggtagcgtgctgccgccttctcgcatcgtgagcgagaggcaggccgggctgccgcgccgattcatgccggaatctgccaccggccgggaggtggttgcgctgggtgagggacgcccggcgccacactacccggggcggtccgtattcttcctttccttcgcaatggcagggctggtcccgccattctcttctttcttcatggatgttctggagctttatgatctccagatggcgcacctcacccccaacgcggtaatgacgttggccatcttcgcgcacctgtgcgagatgttcatcggggtgcacccatctctccggctattccggtggttcttcaccgtacagccggtgtcgccaccgtcggtagtcggtggctgctacttcccgccgcgggggccggtgctgaaccgctacattccctgcgtccttcgcaagaagtgggacgactggaagagcgactagttctacacccctctcgccgacgaagcgcgcctccgacttctgagccagcccccggcgcaggcctccagctggcgggcgccggtagatctgggagacggctacgacgccgttcttgaccgcctggctagtctgcgatcccaggggctcacgagggccatggtgtacggcgattaccttcgtcgccggatcgcgccgctccagcggcgcgcccggggcgcctgggagtacaccgggtccgaggactacatgaggacccaccagggggtcaaatgggactgggtccctgaagacttcaaggtggtgatccaacgggtgctgaatctcagctccgtggaggcatccttcatcccccaaggtgtcctccccctctgcagcgatccagagcgcgccaacatcctgaccatcatgcaggcggtcggggcgtcaggggagcgggctcctcgaggccacgatggcgcgggcgggagccgaaggggggagcaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagataggggggaccgaaccatgccggggaaacctcatctcccccccaaggtggtcgtttagccgacctcctcgcaggttcgtccccgcgccaactgcggctgtattcattctcccatctcccaaggcaagtttttactcacccgtttttcatcttctggtttttcttctgcctcagcgagatcccgtcgcgcccttcccgccattccaagtccggccggtctgaggccgaggagacggcgaccgcggaggcccggaggcgggaagctgaccggcgagaagccgcagaccgcctccgggaagccgaggaagctgcccaggaggccgtccgggctcgccaggctgaggaagccgttcgggaggaggctagactccgccgggccgaggagtccgtccgggagacggaggcggcgcgcgcacgccaggcggcctgccaagcccccgacccgactccgcccgaggcgacgacgacttccgagtcctcccacgacgaggccgcgggcgcaccgctcgggcccgacccctcgggcgacgctcaggatgagccaacttcgggggacgtccccgagtccggcacgtcgatcggcaggccgagccgtgcggcatccttaccgaggcgactctcccccatgccttccgctgccccactgagcgcggagccccttctgcaggccttggccgccacgaacaccacggtgttggacgggttaagtgcccagatggaggtcctgcaggcagagcgggcggagctcgacgcggcgtgggcgcgtgtcgaagaggggcgacgctcggtggaggccatggtggagacgggccgcaaggcacaccgccggcacacctcagagctcgaggcccatcggagggagctggcggagatcgccagggaggtggaggaggagcgggagactgccctcatcgccaccgccgtgttcaacgcggcgcgagacgacttctacctccaatacgggagccgggcggcggagctagagaagaagctcgacgcgtcccggcagcgcgaagaggcccttgaggctcgcgccacggtgctggaggacgcgcccgcgccctgaacagaaggagagggaactggcgggtcgcgaggccgccgtcgccatccaggaggcaacgctggcggcgcacgaggccgcctgcgccgaagaggagtccgcactccgcctccgcgaggacgagctcactgagcggaagcgagctctcgaggaggccgaggccgcgacgcatcggcgggaggagcaggcgcgcctgaatctggaaggcgcccgcgccgagagggccgcactggaccagcgggccgctgaattcgaggcgcgggcgaaggagctggacgcgagagcgcgcagcggcggggcggccgcgggcgacggcgacctagccgcccgcctcgcagccgccgaacacaccatcgccgagctgcagggtgcactggactcgtccgccggggaggtcgaagccctccgcttggcaggcgaggtagggcccggcatgcttcgggacgccgtctcccgtctagaccgtgccagccggcaggcgggcctctggggcgggcggaccgcgaaatacgctgccaaccaggggggcctcgcccagcgcctctcagagatggccgggaccctccagcggctccccgaggagctcgaggagacgatcaagtcatcctcgagggacctcgcccggggggcgatggagctcgtactggcaagctaccaggccagggaccctgacttctccccatgggcagcgctggacgagttccctcctggaaccgaggatggcgcgcgcgcgcaggtccgggacgccgccgaccacatcgtccacagcttcgagggtacggcccctcggctcgcgttcgccctcgactctgacgaggagggcggtgacggtggtgcggacgacagcgacgacgaggccggcgacccgggcgcgtcggcgtgagcccccaggcccccgccaatcttaaatagctttttctttcttcttctgaggccttcgggcccccttcttgtataaactaattcaatctgcaatcaaataaagaggaaatttttgtgtcaactctgtttgttgtgtgtatgagacgagggtggtctgtgccgcggtccttctgtgtcttggcttgaacgagggctcgtgcccaggtcccaacctcaaatggcgcgggtcggggctagtgcctggggagatccacgtgtcgagactggccaggccgggaacatggtgaccgagggttatggatgacccgattgtgggcctttgccgattcccccccggagttcaccacgccccagggcacggctcggttctgggccccgtttggcgattttagccggcccgggccaccgagggtagggtcgagcacgagcgtgctaattcaagccaagattcttcaaaaggaaacgatggcacagacacagtcctcaggaaatcgaaaatgcttttattgaaatacggaagagaaaaaagataaggatatgcatgtggtagcccccggccaaccctgcacgccttgggggggcgcggggttggcccgagcccgagacctgacacccgacccccactaggggtagaagcgacgaaggtgttcgatgttccacgggttaggcagctctgtgccgtcgcccgtggccagccgaacggagcctggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggaagcgcgcggctcggagggccgcgcgccgccttcgctcttccaagtagtcgaggtcatctctgcgacggcctgaggggacctcagggtgagctcggatgggagaaccgcctccgtgccgtagacgaggaagaaaggcgtttccccggttgctcggcttggcgtggttcggttcgcccagagcaccgctggcaactcctcgatccacgagtcgccgtgcttcttgaggatgttgaaggttttggttttgaggccctagaggatttctgcgttggcgcgctccacttggccattgcttctggggtgggcgggagaggcgaagcagagcttgatgcccatatcttcgcagtagtcgccgaagagctcactagtgaactgggtgccgttatccgtaatgatacggttaggcaccccaaaccgagcagtgatgcccttgatgaatttaagcgtggagtgcttatcgatcttgatgaccgggtaagcctcgggccacttagtgaacttgtcgacagcgacatacagatactcgaaaccgcccggggcccacctaaacggacccaggatatcgagcccccaaacagcaaacggccatgaaagaggtatggtctgcatggcctgggccggctgatgggtttgcttggcgtggaactggcacgccctgcaccgccggaccaggtcaaccgcatcgttgagagccgttggccaatagaaaccctggcgaaaggccttgccaaccaaggtgcgtgaggcggagtgggctccgcactcgccttcatggatatcggcaagaagctcgacgccttgttcccgaggaatgcacttcaggaggactccgttagccgcgcgccgatagagggtctcttccatcagcacgtagcgcttggagatgcgctggacgcgttcactcccttcgcggtcctcgggtagagtcttatctacgaggtatgcctggatctcagcgatccaagcaatcaatctaggagagccgggaacgctcccctcgggtcccgaggcctggactccgacgggcctcgggggccgttcaggcgcgtccgtctcccctagggggtcgggtcgcgccgacggctgagcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacataagcatccatctgcgggtcagagcactggtactccttggagacctggttgacgaccaactgggagtcgcctaacaccaggaggtggcggatccccagtccagctgccactctgagtcccgcaaggagtccctcgtactctgccatattgttggttgcccgaaaatcgaggcggaccaggtatctgaggacgtcacagctcgacgaggtcaacgtgacccccgcaccggcgccttgaagagacaaggagccgtcgaactgcatcacccagtaggcggtgtgaggcagctgcgaggggcccgagctggcctcgggggcggagacgggctcgggagctggggtccacttcgccacaaagtcggcgagggcctagctcttgatcgcgtggcgtggttcaaattgcaaatcgaactcagagagttcgatttcccatttcaccacccgtccagtaccctctcggttatgcaagatttggccgagggggtaagacgtaaccaccgtgacccgatgcgcctgaaaataatggcgcaatttcctcgaagccatcagaatagcgtaaagcatcttctgggcctgagggtatcgggtcttagcgtcccggagggcctcgctaacgaagtagacgggccgctgcacctttcggcggggccgatcctcttcgctaggggccgcatctccagggcgctcttcgtccgagaggccgcacggggcgcactcggcttctgtgccgacgacctcggggtcggagggcgactggcgcggccttcccgcagtggccccggggccatcctgggggtcgggggcacttggcaccgttggacaagcaggcggagggccagctccggccgtcgggggcctcgggccgccgttcggctcgggggcctctcctccctgctctctcccgggtcgagtcgacacagggtggggatgcgcgaggtgagggttgtcctcatcgcgctccacaaccaacgccgcgctgaccacctgcggggttgccgccaggtaaagtagcagcggctcatctggctccggggcgaccaggactgggggagaactgaggtacgccttcaaatgagtgaaggcccgctcagcctcctccgtccagataaacggcccggagcgtttgaggagcttaaataggggtagcgccttctctcccaacctcgatatgaaccgacttagggcagccatgcagccggtgacgcattgcacatccctaagcttgctgggggggcgcatccgctctatagctcgtatcttctcggggttggcctcgatgcctcgggcagagaccaagaacccgagaagcttgcccgcaggcacaccgaacacgcacttgtcagggttcagttttatgcgggcggagtggagactttcgaaagtttccgctagatccgagagtaaggtctcttggttgcgcgtcttcacaaccaagtcatcaacataggcctcaacattacgtcctatttgactacccaaagaaattcgagtagtacgctgaaaagtaggacctgcattctttaacccgaaaggcgttgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttaccgttcgccttgggaacgacgaccgggttcgccagccactccggatggataacctctcggatgaatccggcctccagaagtcgcgccacctcctcgcggatgaaggcttgacgttccggggcctgccgccgcactttctgccggaccggccttgcgcccggccgcacggtgagatggtgctcaatcacctctctggggaccccgggcatgtccgccggtctccaggcgaagacgtcggcgtttgcccgcaggaaggagacgagcgcgtcttcctatttgccgtccagaagaccactgattcgtgtggtcttcgacgggccgtcgcccaaggcaacctccttgaccgggacctcgtcgcacgtgatcatccgctgcctcggggcggctggaacggaggtgctgagcctctcgttgccaccctcgggcttggacgcggcggcgaggtggtccgcgcgctgctccatacaagcaagcgcgactttgaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcaaagttcacccgctccgtgcggaagttggcggatccaccgaaggtgaccgggaggtcgatatgacctagcggccaagtgtaccccggcgtcacaccgataatcggttgggacggccgaagcaccatccccggggccttgatggcgtcaaaggctgcgggggaaaggatgttgagggctgcacccccgtctatgaggacacgccccaacttcacgttgcaaacggtgggggaaaccaccattgtgatctgtcctccccgggcaacgcacggcgggtggtcggtctggtcgaaggtgagggcaacctccgaccaccgcgcccgccgagtcgcctcatgggtaggggccgcggccagaagctctcgcttcatggccttgaggctccgacgagaagcgtgagcgcacgctcccccatcgacggtggcgatggtggccccaggctcctggaaccctaggtcatcgtcgccatcgtcgatgtcctcggcgggggccttctgcttggcctcatttcgccggttgccaaagggagccgccggggccttgccctcacggcgctcctgcctcctctcctcctcccacctcctcgtccgctcagtcaaacttttgaccacgcggcagtccgcgaggtcatggagggaggtgttgtgcacggtgcaccacttgctggtcgggcgctccctgctgggagcaccggcctccttctttttgtcgctcgcaggcctcccctttcgggtggcccgcgaagcgccctcgacggcgaggacgtgtccctcgtcgtcggaatgggccgacctcttcttcctcctcctgtcccgccgccctgaccgagcggtggatccgggggcggccgaagctgccacaccggaaccggtggagttccaggtccaggcctcctccttacgagccacacggtccgcgagctgaaaaagctccgcggtggtctggggctccttggaggcgatcttttcaagcatgcggttgtgccgcacgccccccctgaacgcgtagattaccgcgtgtgcggggatgcatggtatggtgttgcggacttgacagaaccgctgaatgtacgagcgaagagactcatcgtcccttcactgtaccgcatgcaagtccgcttcttcacctgggcgcggatatgtgccttggaagttcatggtgaactgctggcacaaatcctcccaagagtggaccgacgcgggcggcaagttcattagccaaccccgcgcctgtcccttcagggccatggggaagaagttcgccatgaccctgtcgtcacccccggcggcctcgatcccggtcgtgtagacctggagaaactcggcggggttgacgcttccgtcatatttttcggtgatggtgggccggaaccttgagggccaacggacgttccgaaggctcgccacaaaggctcgacagtcgacaccaccaaccgggggcacgtggggctggcccccgcgcccgaaccgaagtggcgctccggacgaggaagcgccttccgttgcgtgggcagcacgacgaccattgcgccggcgctcgatactgaggcgggcatccggccccctacgcacatcttcttgggtcggaggcgttgacgagggaatggctgacgaacggcgggtaacggccgccgctcgccgcgccctccgcctcgacgacacggagccggcggtagcagcgccggaggccttggtggcggaggaccgcccaccggcgcctaggcgctgctgcgccgtcatgaccaagtcggccacgtcatccagccaacgtcgggctggagtctctggatcggggacgacgggcgggtgacgcaagagcgcgcccgcagcttggagcgcgccctggggcgtgctaccatcgccgtagacgaggaggcgatgctccccgtctcgccgtccttctccatcgctcgtgggcggcgaagtcgcggatctttcaaccccctcgagcgcctcctcccgcctaagacttcggcgagaggggggcggtggagtacgagctcgacggcgcgggttctgctccccgtcgtcaccgctagcgctcggagagaggttgtgcgccactgcccgttcggccattgggctgaacgggagaagcttggcgcacacgaaagaggacgagagcttagaaaaacacacgcgccccctacctggcgcgccagatgacggaccgttggggctcctcaccgggagaccgcgcgggcccccctttgccggttcggccgggggcgctaggtgaggttctaagccctcgatctgtggaatgtttcgcgagagagcaaatgcgcaagacacgggcgatgtagacaggttcgggccgctgagaagcgtaataccctactcctgtgttctggtggatctgtgcgtgaaggaatacagagagccggagagcgagcgagagttcagggtctagaacccattcgctagagtcccaacccctcttcccttttttctccctccccctctcctctcctagcgagcgagagttcagggtctagaacccattcgctagagtcccaacccctcttcccttttttctccctccccctctcctctcctaggcctgggcctcctttttatctggtcaggggtcaccacaagggcctccagctgcctaagaaaggaaacatgctttttacaatgagggctagtctacagccggaagtgacctctgacaagcagagcacacgcctcctgcccccctcgccagctttcccggtggacgcccatttcaaccttcattcaatggccagcgacttccttgccatgcttgcgctgaagcctggaatggatctgaccgggactgacataccaactccaagagttagcacgccggctccggctagggacgagagccaggaagctctcatcattccgacgggacggggcgaggcgtgtgacaggccgcctgttgccacctaacccgcgatctgaccggtctgtgaccggtcacacaccgtgaccggtcacggaccggataagcgtgcgccgcgccgcattaaatgcggtgtggcgcgctcgtccaacccgcaataaacgcggttaggtgagcgccgctgtgctcacctaacccacacacgtggcgccaaacccacagggggtcgggacgccccagccctcggggtcgaaacgggagcggcccgacacctcggggagacagagggaggggcggccacatcaccctcgggcccgacccccccgagggggtcaggccacgtgggtgaccgcggctgccccaaacctctagtcaagatacccccggaccctcaattttctgttttatttcctccgttttactgtgtaagtcattctaatattttccacattcatatgaatgttaatgaatatatatatatatatatatgtatatatatatatatatatgtatatatatatatatatgtatatatatatatatatatatgtatatatatatatatatatataaaatatatagtaacactactacaaaagtaatttttttgtacgaggacccttatttttgcaaacggaccataactagtggcgtctgcaaaaattgagggtcatttttgcatgcggcccccttaagtgggccgtatggaaaaatcgattttcccatacggacctcttaagacagccgcatgcaaaaatgagctcatttttgcttgcggctcaattaagcgcccgtatgccacttaaggaggcgtatgtaaaaataaaatttgaaaaatttgaaactagtgtatctcactcatataaattctaaattaaatgattcttttttctaaatgtttctaaaatcatgctctatcatgttattgtgttcttactgctattattttggcctttttttcttgtgactttattttatcaattaaaattttgaatttcaaaatttcaaataatattttgaagcggtaattgatttcagctgaaaaagtcatcaacaacaaagttgtataactcatcaagatatataaattctattttggtcatttattcatccgacaaaaatatttgtaagattgtttacaaaatgtacatgtctcttatagttttataaacaatataagagatatgtacattttatgaataatcttataaatcactttgtcggatgaaaaaatgatcaaaataaaagttatagatcttgatgatttatacaactttgttattgatgactttttcagttgaaatcaattagtatttgaaaatgctatttgaagttgttataatttgaaattcaaattcaaactattcaaacaaagtcatatagaaaaatgaccaaaacaaaaattatagatcttgataagttatacaactttgttattcacaacttttccatttgaaatcatttattgcttcaaaatattatttgaatttcttatattttaaaattcaaattttatatatctcaatcaaacttggatggagaaatgaccaaaagaaaattggtagatctcaatgatctctacaactttgtttttgacaactttttcacatgagttcatttaataccacaaaattagatttaatgttcatttttatctagaagtctaatttgtctcctctccctctccaccgcttcagaattccagcaaccttatctccaaccttatcttctctccaccattatttctcctcaactccctctatctctctctccccctcacacacagcaaggtcgcggcgggcgtcggcgacaccgaggaggtacgcaggggcggcggccgagggcggcacgcactggcacacggcggcagcggccgagggcggcacgcggcggcagggggcgggagcggccgcctgcgtggatctgccgactctacctccctccgtcgtcgccggcgactcccccgccctcc

SEQ ID NO: 60431 - DNA, 13450 bp, Oryza sativa
ctgccggccgtggaacggcgacgacgacgacacgttcagcctgtactctggcagggcgtgcacgtacacggagtagagcccctcgtgcccgtggaaaaaccgctcccacagcggcgcgaacggcagcggcccgcgcgtcaggaacaggaacgccaccttgggcacgcgctggtacgggtactcctccacgcgcggcgccatggacgcgcgccagaacagctcctcgtccttcatcgagtgcccccatggcgggtgcggttgcacgaaccgctggaagctcagcgccgcgccacacccgtcgtcgcgacaccgtgaccccccttccccgccgcctccatctccgcgccgcgcctccgcctgcttgccgctgccctcgacgtagtagcaggacaggctcgcgctggtggccaggccgatcagcacgccggccatcaggatcagcagcgccgccacggccttgaggagaatccccaacgaccagcaccactccttccgtgtcgccgtggggaggccgccgctgccgccagatccctcctcctcgtccccggcgctgctccgccgagacttcagcaatcccggcttcatggcggaccacgaaccgcggcggccggcgacacccgcgtggagtaggggcgattcgatcggatggacgacgatgactgctcaccgtaggcgatggccagatgatagctggcgatgtctgcccgtgcccggccggccggagatggtgcccggtcgtcgttgctccgtccggtggtggcaatgcaacgacatgcacgcgcggacgaacactctgggcgggcagctgctagcgattgcgaatgcgaatgcgatgggagggaacggccctgcgtgcgtgcatgtgtctgcgcgcgttcctcggctcattggccctctctctgccttgccttcccttccctctaatttaatttgcacctctatttatttttatcttgggaaaggccatttaatttacctctatgtcatctcttacatactagcatccaaatggtcataacaaagttataagatacaccatttatgaataagtgacaaatcgtctttttcaaataatttcaaaacatttcagaaacgttaaaatattaaattgtattttcaaaatatttataatttcttaaaaaagtatggcggcactaatacgcgcgcaatgctcgaaacagtagttcgagcgccgcacaacgttccctccatccggtttttttcgttttttaccagcccacttttcctccgtacaccatctttccctgtctgtttttttcaattttcaccaccttaccttgtgtattttttttcttctttccatctcatccgtgcttcatcaaagggtccgataaaatattaaccatccagatttttatattttctcgttccatctcttcagatttttgtgttttctcgtaaaatatttaccatctagtttttcttttcgagttttctatttttctactgtctccccacatttcaaaagtaaaaaaaaaaatactatacggagttttccatttgctcccaacctcctagctctgcaccttcaaaagtaacaatttactcctatgaatgcatcatttaaaagtaacaaatttacttgcatgaatgcccccacatcgtttggcactgttcctagatcgctataaaaaaatattaccagtgttataaatattgtttaggcgtcgtagtctacaagtaaaacaattactaccttcctctctatatagcccatgttggcaaggagttaactctgttccttctccactaactctgaaccctataaatcaaagccaattctagccaatgttggttatcactgctcgggctagcaccccccttgaataatcaccaacattcacacgaagcctagaacagatggggagcatttaggatttggactagagggaataaagtgggcgtaatggggaatgagagcgagaagaagaacctggagtgcgccgtgggaagatgaccatcgccgtcgatgccggcgcagcgctggatatgccagttccttcccccacgccagtcttgagttttgtttgaaccaaaaagaaaaatcccgacaacttgtcccagcgtaaatgagatagacgcgagtgattgcgcaactagaaccataaaaatagctagtcccgtctggacgggacaccggtaatagcatttccgtaaaaaatacatatgatgtattttaaaacggatgattgattacttcattattagtctcccgcaacaaacttcatgtttgtttgtgatatgtctaaggagcctgatgctctagctaatgcatcagccgttgttgaacagtctggctcaaataatgatgcgaaatttgttgcttttaatttgggtgcaaaacacggggaaatgataaggccaaatcaaattatttaggtgggctcattatgtgtggagattgttccatgccaagagtttggccatgcttaataacttaattaagcatctaccattagtaacttagccgctacgtgatatgtttatgttaaaattttgtacttgagaggtgttctggttgtttctttctttcattttttttttttgctatatgcattttatgcaaaggccagggtacacagtgattcaatttgattgcatcatctttatgtaattaactgagtctaaataaagtttctattatctaaaaaggtaacttagctgcaattttttaatatttctgcatatagcttatatagatgagtttagtcagagttctcgttgtgtacgttagacgcatatacatgggctggcctacgtgccacatacatatatattggccttttcttttgtatcaggttagttttttttttttgggcggtgtttaccgtcgaaagaggtatctaccgaggtccatggcggcgaccccgtcgttgctttcttgaagttgtgcctccacattggtttggtgtggagaataactttgtaaaagtcatattttaaagctgaaaaggctattatattttttaaatatatatttttgatataagttcttatactttattcttatggcaacgcgtggggttgtcgactattactataactaggacgaaagcccacacacatgcatggacatattactaaatgctatataacagtagttactctaaagatgtgaatatttatttatttatttattgacaaaaaccgcaggagagactatgcacatgttgagcaaattcctccttaaaatgaaacttccaagaaatgaaagttggattaacttttctaaaactagtaatatgcccgtgctaaacgctacggtgcaattcaaattgtctttaataatttttaatatttcatgttagcaaaacaaatatttttatgatcatattacgtggacagaataaatctttacaataattagttatatataataatttcagtatacaatatacttcagtatacaatatacgagggcaatatacgcttaaaaaatatgttaaaaaagtatagagttgttccattatttgttgcggacacaaaatagagcatttaatacatatatataatatactaccctgtaggtaaataaccatcctagtgtttagcacttgtgacacacttcagaaatttttcttccccgtactacaaattgttaagagatcgtgcaaatttagttaacaaaagtcacccgtttctgtctccataacctgcaataaaagaaaccatgattgtaaaaaatgacacagcaattttcaattcattcatttcttccaaggttcatatctttagtctatttcccatgaaaatcaggaaccacatgaacaaactatttaattatatcattggttgtaaaaaggtcagattcgacatatggaaagcaagaagagcttaaatgtaatatggcgtgctaacactacatacaccacaatttagtaaagcattaagtttttctaatttgatagcatctgacgatgtcacaatcagagcaaaattgacacaactgaacgtctggtatagatccaagctgaaacatcactcatgtcaatggagaatatgtatggatctaaattctgccaatttatgaagggttctacaaccatgcaatatttggataccaaacctaatatcaaatttactggacacagtattatctgatcatgaaagactgaagatatggaaagtagttagagctgactaattaaactaatcatggacatgattttacggattaacagtctgaaactactctaacaaccaaaccatgatgaattatgaactgtgatatcttaacagataaacatatgtgatgaacgagagcaattgtttttattctaaattccagcacatgcaaaaaaaaggaaaaataatatcttctaatatcaatcaatcaaggaaaataggaaaaaaaagagagaagaaactgcttttaccttcaattgaggcatgaaccaaggatgtcgactggaaacaacaggatatgggcacaggagagctctgattggcagggttacgcatggcaatctgctaaacttgttcaaattagcgaaatttctgagaattgaaaagaagctaagacatctattttcagttatttacttgagggtagagaagagcaatgcaaatagaaaactatatgagcctaaaacatttcatcccaaaatacaccactgaatcttgtctagtaatttgttttctcatccttctccaattcatggcattactaaatgaagtttatcttccaaaaaaaaaatactccctccatactcgtaaaggaagtcgtttaggacagcgacacggtcaccaaaacacaactttgacttcttaaatctataaaaatatttattgaaaagtgatatatgtatacttttatgaaagtatttttcaagacaaatctatacatataatttttacattttcaaactcaacaacttgagagttattcatgatttatattcccaaggtttgacttaaacattgtcctaaatgacttcctttatgagtatggagggagtattgatcagtggttaattgggttagcttgttaacatgaaatcaacaataaaatgatatgattgggccagccttactattgaaaccaagaataaaatgatatgatgggtgaaatggtctatttcctatgacatttctcaataatactaatctacaatttggctgtcattctatgaaagattggaagtgagaaagcacctggaaagagaaaaaccaaatcatgcgaactcttagttccaaaaatgcatggttgtaccttcctgatagtgtttttattttctggcagggctcttaataggatttgaacaattgaaaatggccatgcgtgtgcaacaggaaatgtaaattcagtatgaaccccacaatagatacaaaggaagaatctgtatagcaacacttctgaacatttttgaagatacaaacgaaaatataaattcagtatgaacccagtaatagatcataggttagctcttgcaaagtacaagtacaaagaaaatcagaggaacaaagatccctcttggaattcagaagatctactccaatattcagaatgaccaataataattcaaacagtagatctcagaatcaactttttgtacaatacataatatcattaggtttcaataataaattatgagaataacattttttttcaaactaaacagtagaccaccatatttttatcctaactgaacagtagaccacaatatttccatttcatctttccccgggacagcatatgctttctctgatacggcatgaaaagaagaggactaatggttgaaaaatctaaaatttgcactggaaaatagaagtgaatttgacaattggcatcacacggaaacactttattcaatcatccagatccatttcaccccaaatccaatcattttacttttctatcaaccaacaaaacggtcacagtgcacggcttcatatggcacaactacattatctagaaacgtcataactcaaggaaacatctatcaccttgagaagaggttgacggtgctgcataaatgaaaatatacatgtcacatttcagttaaaaaaaagtgttctttcagtccaagttgcataaacacaaagtcaggaattgtaggattttgtaggtacagtttaatgtttcttaaagatgaactgacattcatttactcaaatcgtaggtaaaatctgaccccgacgcaagcacaattcacatgctatcttgcgtgcaaaatggaaaccttgacatggtagtgctcacatgctgttgacatcaataggaggaatagagagcaggagatagagtaggcagtgttttacctgtttagtaaatagtcttagggaggtgagtgcgccatggacgaggttgccggtggtgtagtctgtgccacgtgaaggattatcccgtgccagggcaaggcacagagtatcttggcaacagatgcagtttcagagtcttgacggcaaatgcagttacagatcgcggatcaacagatgcagtttatatagtcaccttgatatgccttaggagatctttcttcaaagcctaaatcccagtgacgctgacctatttttaacatttacctcatgaggaaaacaggaatccacaaagcaatgcatacataaagcaaaagtcaagaccaaggacaacactttaggttttacatcaacttataactcacaaataactacaaaaggtgcatgcatgcatgtagattttactctaatctagacaccaaagtgttgcatctgcattttctgtcttaaaatgctttctttttcgctgaatagtagccactgatgcaatacaaggatcataatggctccgtggttctcacttcctagtggggccctgcatttcaacaacgtcatgtcctaactcctgatcttaacaattgtctaaaccatcttaccttgactgctgggatctcacattgtgacacaaaagagagagatcattatattttctttaaatagcaaatatgggataaataaatgaataaagttcagaagtgacactgccatggcacaacccacagcagacggtcgcccgctcgagggccgcctcgcactccatgacaaggaaccactactacggaaatcagtataggcgccggttaggaaccggctatagatgacggtttccccgccggcaccaattggtgggcacctatgctggttttagaatcggcagctacagagattatagatgccggttattacccccaaccggcatctatgggttagggatttttttttaaaaaaaaaaacgtcttcaaggaatataggaactgaagcatcccggtgatctcaccacaatcagaagcaaaaacttactccaaggaagcagaaacttgtaccatctcacaacaatctcgaacccaccatacatacgaagtagaaacttaccactaatcatcaatctgatgagctgctgctcctcatgaacatcccgcgcttacgagacgaagccctcctcgcctaccagggaaccccacctccagatcgatcggcagggcgtccagacgtctgtcgctagcggcacgcaccctgaatgaacagaaaccaaatcagagaaaaatgaatccgcacctccgccgctagcggcacaaaccatgaacaaacaaaaaccaaattagaaaaaaaaagaagaaatcccttgatcataagggcgcacgcaccttcgtccctggaagcacacctccaccgatccgcctcgcccatgcatcaatcgatcagcctcgccctgagcgaatctcacgagtcaagagatgcggcagaggagggattgctacgagggaaataggagtaccttcgattcgactcgaactgagacggagggcagaggcgggaggggcggaggccgggcaccgcgtcgcgccctccaagcctgctcgtcgctggccgtgcgtgggcgcgcgtgacgcgaggaggccgcgcagaagggaggaggaggaggagtccgtcgaacacctcgcccgcgaagggagaagggatttgggccgcctcgccggcgacgagcgcgaggggaggaggccggaaggggaggggagccggagggggaggaggaggggagggcggtgacggaggaggcgagggggagggagccggagaggaggggagggtgcggcggaggagacgaggggcgaagcgaggaagagtggaggtgcggcctggcggtgatctgacgacgggaggagcgagaatgggcggcgcggcttcggcggcggtggcgacctggcgacgggaggagcgagaatggcgagttttttttttccgggataatcgcgagatttggggcgaccgtgggggacgggagttgcggggagaggaggcgcgggtgggtgcgggagggaggagagggatctggttcattggatttgagagggtgattttggaccattggatatgtgattcgacgaatgatgaatgattaaaagaatttgttgaagtatatgggtagaattaaatgattcctcctacaccataaactctataattgagctattgccattaaattattacaataaaaaataattcgtagcaatatattgtaatgttacaatgataatttttctgtggcaaataattatattttattgcaacgatctacgatcgttgttttatttagtacttttgttgcaatagaaaatgagatatcgccacaaaaaatcttattgctaaaaaaaacatgttctatcgccacaattttaattttttggtaatttacatagtacatggtacttttcactatttttcattgccacgatcagcaaattcattgcaataaaaaaattgtcgtctcataatttaacttaaatttttcatatggacacggattgagacaaattttatatggaaattatagctctcgacgagatctataattttataggtgataacattttcatttgaaatcttttagatattcaaaactatgattcaaatctcagttaggcacgctcaaatggaacgatatgtatttttccaatagaattgatgtgtaggtgagttggtaaatgagagtatgtgtgaagaataggtcttgggctcgaatccttgccaagacacaatatcaaaaaaaaaatagataggatgatagactaatatttgaacttttaatttggtatatagaactaatgccacattatagagtggtggcaatcatttttattacaacgatgtgaagtgttgcaatatgatttttttgccacatccattccgtgacaacatcgaaatttattaccactaaataaaaatcgttgcaataacctattactacgctatttattaccacggttagcaacgattttaaaattatgacaacatgtatctattgtcacaattttagtattgatgccacgatttttttcgtggtaatgatttttctagtacagcaaactatggcgacaaattccacgattgctgaatatttgattttggataattttaacataaaatattctttaagtttattttatacttataattctaagtagataatgcgtaccaaggatccactaataatgcaagtctaaaaatcatagcctgattttctctgatttaagatggtgcgctgtggcgtaacatgtcataatttatttagtattgaaacaaaacaaacattattttgacttaattaaaatgctacaacatttaaaccgcttgtaaagccaatgtaacatacactatgatcaactaaagttcgcttatttataaaaataccaaaaccaatggaccctacatgtacgcatggtgcatgtggcattgggccattgaagttatagatggccatcataagacctgcccggcacggcctggcccaggcacgggcgaggcacggcccaaggcgatctggccggcacgacacggtcggcacttcgggccatgccgtgccggcccacgggctgcaccttaggcccagacacatcccaccagtagtcgggtcgtgccgtgccggcccgaaggcataggcagcccatcgtgacttttttaaaataagtctattttccttccatcctctttgggatgtgacatatatatagctaaataagtctattttacgtcccgactctttgggccgtgccatataatatatctattttgcctccctattctttgttatgtgccttacatatggttgagaataagtatgtttcgtatccctaaacttcgggccgggacgtgccggcccagcgtgccgaggtagcagcccaggcacggcacggctattgggccccggccgacacgggcatgaccgaagtcgggctgtgctgggccaaaattaccgggtttgggtgggccatcgggcctcgacccatatgaccatctataattgaagtccatagtcggtgtatttctaaaccatctacaataatgaatctactaatttaagtgaaaaccaataaccagatattttaattcttttcaaaatttataggattttataatttattagaataatcaagagaagagaagtcatagaggactttaaagaatgttttttattgaaattactattgggcctcgtccaatatataaaggtaaattttgctatagtacactttggtttcgtggttttggccgtaggacaccgcccaaacatacttttgggggaaaacactccgtaaacgtggtaatttgtcaatggacaccgtatcgattagaataataattttcggtcgaaggggggagagaaatcgcgtgaaatgtcaaaaatgtccttggacccacatgtcagttatatctcttctctcacaatcctctccttccagcgccgcaacgcatgccaccgtgttggagccccacgtcggagctcgccgtggcctcggaactcctccttctcctccacgccccaatccccaggcaacgcggacgacgacgacagggaacggcggtggcagcaccgatccaaatctaatcggcacagcttcggcaatgccgcccttgtcgttctcttcccacgcccgaccttctcagacctgctccgccgtgggcgacgtgcgcccttccttactctgcttccccgcgttgcggcgcatgccaacctcactgtctcgctcatcgtggcggaggagatggcgaggatagcgggagcgactgcggcggcactcgcggtgggagcggcggaggacggcgaggacgtggcgaagtggcacggggcgacgtcggtcaccggggctcgagcttgtcgcggcagaggagatggcgaggatggcgggagcggcagaggaggcgaggaggagagtcgcgtcgtcgtcgccaactgcggccactcccgcggcggaatgtatccatggtgctcgtcgccggcttcacctccgccttcatccgcgacgtcgacttgtaccgcgctgagccctgggacctcctgctgccgtcgctgccgccgcgttagtccattatcttgcatgctctggcctgagatcgattgcgacgacattgcttgcgtgcgtgcgttggctttgatcgatgtgccgtcgttgttgatgtgtgcaggtgtggcggcggacggagctgaggagtaggaggaggagcggtgcggttacttcttctgcacgaggagcttcaggtggccatcgggaacgaggacgaacagggccacggcggcatgaacaggggcaccctctccttcatctcccaaggcgtgacatgtgagagaggagagatagcagtgctgtcatgtgggcccaaggatatttttgacatttcccgcgatttctctctcttcttcaaccgaaaattattattttaatcggtgtggtgtctattagcaaattaccacgtttatggagcgttttcctctaaaagtgagttccgacaggcgaagtgtcctgtagcaaaatttgtcatatataaaatactataggatgtttgatggacttttaatgtgtttcctctaatttcttgggaggcggcatgcctctcaagatagatcagataatatcattttgaggcttcactatttaaaagcattgggagtaaatgttgtaaataatagatgagtatccagccgcgttgatgcgggaaatcaagttacataatatgtataaataagatgtaatataattattaaaactaaaacaaattgatacttatgaattttgagcctaaaaataattgaaattgcatggtgttatgagagaataaagaagagacaatttaaactatagatctatcgtataaaggctagaaataattagggtgacgtggcttaatgagaaaagagaaatagcgttaacttagtggggatgaactatataagtatataggattactcacaatcagatttagcccctagcaacgtatgtccaaaagttatatctacatatatttacatacttcccctattccaaagtataagtatttctagctatgaatctggacagactattttctagtttcatagctaaaaattgttatattttgggacggaggtaataataaatattgtaaatgttattatttctttcaagaaattttatattttatttagctacaaatatataaaatgataatataatctatatggtcaaatgacttttttccttacctacttgaaggtatatgtgcacaccagatctcaaatatagttgagttgatgtacaaacacctcattacactactaaaaaataattttctcaggcgagctgatgtgaccaaggcacctatctcttttgccggtgattctttgcaaatttgtgtcaaccaaattgaagagagaaaatcaattaaccctgctactggtttgatgcagaaaaaaactaaaggagtacatatatgttgggttaatacgtgtggtggtttgatttgggattcctaacccgcgcgtacgctgtccagtcactaaccatgtgattagcactaatgataacgtgattagtgattagtgctaatcataattaagtacctacaataactttttttttctaataaattgaaaactttcaagttagatttaaaaactttcaacttatgatttaaactttgaagtcaaattttgaaatctttcaactcaataattttaaaaatttttaactcgaaatttaaatttgcaagataaaatttgaaaactttcaatttcaactcggatttgaaaactttcaactcgagtttttaaatttgaattataaaaaatatttttttattaaaaatatcttataataaaaaaattgataactttcactgcatcctaaattaatcaagataaaaacataaaaaaagaaagatcgtatagatacatgcatgcatgtgtgggaccaaggtgcgcactggtggagaaaccatctttcgccggtcggccgatttccacaatagtcccggatgcaataaaaaccggggctaaagatgatctttagtcccggttcaaaagggtaacgggcatatttgatctttagtcccggtttgtgttaccaaccgggatctttagtcccggttcgaatgctgtcagggcctgtcaggcccccccgggatctttaatcccggttgg

SEQ ID NO: 60432 - DNA, 16039 bp, Oryza sativa
tgacggagcgttggggctcctcaccgggagaccgcgcgggcccccctttgccggttcggccgagggcgctaggtgaggttttaagccctcgatctgtggaatgtttcgcgagagagcaaatgcgcaagacacgggcgatgtagacaggttcgggccgctgagaagcgtaataccctactcctgtgttctggtggatctatgtacgaaggagttacaaggagctggagatcaaaagagttcaaactctagagaccctctcactctttctctctacgagctctgctctcctctttcttctttttcagctccctccagtccgttagtccgtcagtcccctctcttggtaggcatggtccttcttttatatctcaaggggataccacatataccatttctacctacccttcttttgggtggggactcatcctactttaaccaaaacttggctcgtaccttcgcctgacaccgggataaccctgtccttccttcattaatgggcggagatttgcaatggctgctctccgaatgaccctccgatgggatgggtcataccaacctccactccgccggaagcaggtgcaacgtgggagcacggttgtttgctaatgacgtgaccggcgtcagaccagtcacaaaccggtcattcttgtctaccacgcgtcagtttagcatgccacccgtcagcccttcttcgtaaaatgacttccttgtaatggttgcgatgaagcctggtatgaatctagccgggactgacgtgctaactccaggagttcccacgccggctctggctagggacgagtgtctaggggctctcatcattccgacgggacggggcgaggcgtgcgaaaggccgcctgttgccacctaacccgcgatctgaccggtctgtgaccggtcacacactgtgacctgtcacggaccgaacgagtgtgctgcgctgcattaaatgcggtgtgggacgctcgtccaacccgcaataaacgcggttaggtgagcgccgctgtgctcacctaacccacacacgtggcgccaaacccacagggggtcgggacgccccagccctcggggtcgaaacgggagcggcccgacacctcggggagacagagggaggggcggccacatcaccctcgggcccgacccccccgagggggtcaggccacgtgggtgaccgcggctgccccaaacctctagtcaagatacccccggaccctcaattttctgttttatttcctccgttttactgtgtaagtcattctaatattttccacattcatatgaatgttaatgaatatatatatatatatatatgtatatatatatatatatatatatatatatacatatatatatatatatatatatatatatgtatatatatatatatatatataaaatatatagtaacactactacaaaagtaatttttttgtacgaggacccttatttttgcaaacggaccataactagtggcgtctgcaaaaattgagggtcatttttgcatgcggcccccttaagtgggccgtatggaaaaatcgattttcccatacggacctcttaagacagccgcatgcaaaaatgagctcatttttgcttgcggctcaattaagcgcccgtatgccacttaaggaggcgtatgtaaaaataaaatttgaaaaatttgaaactagtgtatctcactcatataaattctaaattaaatgattcttttttctaaatgtttctaaaatcatgctctatcatgttattgtgttcttactgctattattttggcctttttttcttgtgactttattttatcaattaaaattttgaatttcaaaatttcaaataatattttgaagcggtaattgatttcagctgaaaaagtcatcaacaacaaagttgtataactcatcaagatatataaattctattttggtcatttattcatccgacaaaaatatttgtaagattgtttacaaaatgtacatgtctcttatagttttataaacaatataagagatatgtacattttatgaataatcttataaatcactttgtcggatgaaaaaatgatcaaaataaaagttatagatcttgatgatttatacaactttgttattgatgactttttcagttgaaatcaattagtatttgaaaatgctatttgaagttgttataatttgaaattcaaattcaaactattcaaacaaagtcatatagaaaaatgaccaaaacaaaaattatagatcttgataagttatacaactttgttattcacaacttttccatttgaaatcatttattgcttcaaaatattatttgaatttcttatattttaaaattcaaattttatatatctcaatcaaacttggatggagaaatgaccaaaagaaaattggtagatctcaatgatctctacaactttgtttttgacaactttttcacatgagttcatttaataccacaaaattagatttaatgttcatttttatctagaagtctaatttgtctcctctccctctccaccgcttcagaattccagcaaccttatctccaaccttatcttctctccaccattatttctcctcaactccctctatctctctctccccctcacacacagcaaggtcgcggcgggcgtcggcgacaccgaggaggtacgcaggggcggcggccgagggcggcacgcactggcacacggcggcagcggccgagggcggcacgcggcggcagggggcgggagcggccgcctgcgtggatctgccgactctacctccctccgtcgtcgccggcgactcccccgccctccaacggcggcgcccacccccgcggcgacgacgacctcgggcagcgacgccaccgccatcccctcctcactgccgcggcgacgacgacctcgagtggcgccgccctgcgcggatccggcgccaagggcggcggtggcggccgatccggtgccgatgacgacggcgagcggcgggggcgacggatccggagccggtgatgacggcgggcggcgggggagacggatccggtgccggcgacgacggcgggcggcgtgagcgatggatccggtgccggcaacgacagcgggcggcgtgggcgacggatctggtgccggcgacgccggcgagcggcggtggcgacgaatctggcaccgtgcggcggcatgctagggtttgggatttttggattttattttttttgtttgctgaatttattttcgcatgtggctggtataagcaaccgcatgcaaaaataggattttcgcatgcggttgggccggccgcatgagaaaagggtgatttttgcagaccttctctcccatgaggttgcctcaaccgcatgatgccttttgcccgtatgcaaaaagcctttctgtactagtgtaacatctaagtatttaaaatttatcataaatataataccacctacattattttctcaaccgagatcacaactctctcctatttaatttttctacctacgtcttcttgttaaccaatcataatccaccactattcgatttcacatactttttatagttctcatgttcaaacctagaacttcttatatttggaatgaaggtagtaaatgcctatttacttacagataatcttagatgcaatcatttgtataattgtatgtcatctggtgtataattacatttaggatctatttggcagggctccaactcataaaattaactttatgaattgggtctaaaatatagttgtggagcagccaaaaactaggtctatttttctagtttattttgtgagagcaatgtagccaatttcactcccattttgaatggagttgaaactgtttggttgggctttagcttcaagagctctaccaaacagacccttaattcttgttccaatattaaagacatgtcagttgtaatagattaggcctaattagggatggactaggagcgtaattgaggaatattggatccggtggttacacaaatggagcaaacatgctgtgtgtggtgggcaaaagtggaaggaggacgatccaccagcgtatctaggatttacggtatgggtggtccgactaaaaaaaatagataaacaccgtaaatataataatgctaatatatacgaagtagactacaagtacaccatgatatattaataagacatcttaaaaacattttaaaattaacagttaagtaaaattttgagttagagaagcttatatacctagagaagtttgaaggagattgctatacaacaaacgaggacgaaggcaactcagaagcattcttctttcatgaatgtttccgaaaaaaagatacaatattttcaacaatagtataatttaacatcaaaactcagaagggttaaaactaaaaattaagagtaagtgtagaggccttaaatacctttgcatcgaccgtccatccatatacaaccataaaatagacactgtagtccaaagttggacaaaatgctaaaaatagtaaattattcctcttggtttcataatttcatgggcatagtacgatcccgcagcgtcagcaaggcgaagaattccttcaatgtgttcatggacgaaccaccgtcctccagtgctggagcaatcatttcctgaatcttcttcacgcactgtcgtgtcttggccgccatctccatgctccctatcaccatctccacgacctcggccaccctttcacgctccagcgccggtgagtccggcgcgttcccgcggcacagctcgacacacgagccccactcctccagcacttgggcgttgagtggccacgcgacgacgggcacgccgtgtgccgtgctctccagcaccgagttccagccgtagtggctcaggaacgtgccgatggacgcgtgcgcgagaatggccacctgcgggagccaacccgtgaatgaggagccccgtgttcttggctcgcatcctttcctcgaacccttccgggaaccactcgtctgtggccccgctgatatcgtcaccattagtggatgaggagccccgctgcttctgtaaattcatagtcccattcccagcaaccccatttctagcatcaattcacatattccatcacagccaattcatatagacccattcccagcatcatatcagccaattcacattcatattctatcacagcacagccaattcacaaaatcaaacacatatacattcacatccacaacccattcacatatatgtcattcacatccatttttctctccaaaccgccgacatgcatcaaaacctgcaaaaataagttataaattggaacaattttatatgtaactagaaatgcaagtatatacagagacgagctacctaggactttactctgaagaatataattgtattacaaagaatatttacaaaaatcaaatgtttgtctcatatgcattgcaaatgttctgccattccgagacgagctacctaggacttcactctaaacatccctttcgatgacaagatatcatctagtatgaattgtgctatctcctctctaatgatttcgaagttgatttccggaatccttgaaataaattcctgcatgttcggcgccaagttagtctacatacttgtaaatttgtcgtcctatgtgtgtataaacaattgaattacacacctcagggtcgagcaatgtcaccttgtctgcgaagctcctcatgttatggcagacatggaacccacactggtcgctaacttgttgacgtattgggaagtctttcttgtgaccgagtttgggatgcccatccttatgcctcccgcctcttgccacgtattggtcccatgcctcgttcaaggcagattcgatggccgaccaatcgtatatttctggcttgatattggagttaaggtagtgtaccaaactccacttcggcgttattaccagaagaatccaatgtcgcctgcgaaattattaaattgccagttacatactacagttgtacgcgttgagtatttgagtataagtacggtacacgcttactattgattgtaggcgcacataatgaagtccttgtcttgacgggcaaataagcagtccttgatataggccaccatgtttgctcgatcgtttttcagcattgtctcgttgacgacagctggatcgagtaaggcaacatggggtgctttacgatggacatgcttccaggttaacctacgagcaagacaagagtcagggtaagtgtaatttatggacagtcactaccatatcgcgtaccaagaaatacttacaaggagtagcacttaaggaggttggtgtcgatcgctcgcaccctgtagaggtcccatagatctttgaagtctacggcgatgaaggcagtaggcccgaggaacggctgaccatcgtgctggcccaacatggaggtctctctattcttcctccttgcgttggacttctccatgtagtacccgtgcaacaccttgcatgcagggcccatcttgaataaggcatcgtctccgaccaatggcatgcccaatgtgaattcggctggaagctttggaggagctactggcgccttgccaagatcaagcttctttggggcaaatggcacctttatttttcctctccccgttccagcagcttttctgcgtgtgtcaagcttgggtggagaagatttcgccctcttgctccttttggcaggaggggggaggtgcggcctgctgtcaacctccataccgtcgtccccaaaatcagtatcatactgtaattggagatcttcatctctttgttcaacggcaggagggagagatacaacagtttgatggggacgcgtcggcggcggacgagaacttggcgctggccttggagttatattgatctcaatgctgtgcttgggccattgaataaaggtcccacgtgcagccccaagggtcagaatctcgtcattaggtgtgtcggtgacatggggccgggggtatcttgactagaggcttgggtagccgcgatcactcacgtggcccgaccccctcgggggggtcgggcccgacggtgacgtggccacctctccctctgtctctccgaggggtcgggccgctcccgtttcggccccgagggctggggcaccccgaccccctgtggtgattggcgccacgtgtgtgggttaggtgagtacagcggcgctcacctaaccgcatttatagcgggttagacgagcgcgtcacgccgcattcaatgcggcgcagcgcatgcttatccggtctgtgaccagtcgcggtatgtgaccggtcacagaccggtcagatcgcgggttaggtggcaacaggcggcctgtcgcacgcctcgccccgtcccgtcggaatgatgagagcttcctggttctcgtctctagccggagctggcgtgctgactcctggagttggtatgtcagtcccggtcagatccattccaggcttcagtgcaagcatggcaagacagtcgctggctattgaatgaaggttgaaacgggcgtccaccgggagagctgacgagcggagcaggaggcgtgcgtactgcttgtcagaggtcatttccggctgtagattagccctcattgtaaaaagcatgttcttttctgaggcagagagaggcccatgtggtgacccctaaccagataaaaaaaggaggcccaggcctaagaagagaggagggaaggaaggggaggtcggacgctggcgacttgatcggagagcctgaactctctctcgctctcgagctctctggctctggagctctctgtttaccttcacacacagatccaccagaacacaggagtagggtattacgcttctcagcggcccgaacctgtctacgtcgcccgtgtcttgtgcgtttcttctcgctgacattcctcagatcgagggcgaagaacctcacttagcgcccccggccgaaccggcaaaggggggcctgcgcggtctcccggtgaggagcccccacgcaccgtcaaggtaggtgtgggatagtgtagccaacccaatcgggcttcagtaagtccacttgaactttggcattgccggcttgcagctgcgccccgtgcactcgggtctccggggtaggcttgaatgcttgaccctctgcggcaggaattgcaaatcctggtgtcaccctaacaactagggtacacgatgtgggttcctgcaatagattcattagtgtccttagtatatgttgcaatgtattgtggtgctaatataatatatgcgttattaagttgtttttaccgttatgtggtccaccgtggcggggccttcaggctgttctgccggagcctcaattgatgcgcagctgctacgcctctgcgtggggctcacttgtactatgggaccaggagtggcatcggtcgacctatccctgatgcgtgcctccatccgagcctccatacctaacagctcggcagtgagctcttctctaagctcttctttaagctcctcccgaagttgggccttaatgcgtgcagctttctgcgccttggaaagcttgtgcttcttgtactgccacacgtattggggaaacccaaacttccatggaacattggagccaatgccccttgttcgtccacggtgttcttcgtttcccaacgctttcgtgaggatgtcatcctcgcgtttttgtgagcatacctcttaggaggcctgtctctcagcattcagttcgacctggggtacacttaggacactttagacgaagaacaagatacaacataatgaaacttattctatgtgttcaacttacgattttctggtacaccacttgatcttcgggatttgggaacgaaagagttccgtcactattcttcttcacccttgcccttgcccagttccttgcccgctggaccgggatattagcaagcacttgcggggtgttagattccgctgcagcttcatcctccttgtcccattctgcctgtttccccgcgtagccaccggtgccaagccagtgcgggtgaaggttccttgcctgcagatcacggtaggtctggctttttttccgagactctttccatgatttggcggcatggaactcatcccacacgggttgggtgatgaatggatatttcccaaatggttctggctgggcagggttgaggacgtactccgtgaccagcgttgtcttgaaatttttccaacaattccccatcttgcggatagcctgccgcttcagtcctaccgcggcctctgtaggatatcggaagctttccttgaactacctctaggcctcttctttttcttcttgagggaccaaatcgatgtggtccttcagaatagtgaagttccgcctccctaggactccgcatatcgtagggaactttttgacagctttcgtcggagccgtcggatatccaacatcgtccacctctgttatggtgtagacttctttaggaatcttattctgggtcctaggattccggcacgatgtagtcccagaagtggtcgttgacatcggttcgccttgctgcgacatgtcctatgtcactgttgtacggggagaaagtactttttaaacacaaaattgcatccacacacattctcttatggtttgatatacctctatatcctacctacattcgcctcgtcgacgaaaccatagcatccatgctcaatagggctggagcagccgggaactcgacctcgacatcagtataccactcgaacttgctatcaatgtcactgacataagatagtggcaacggtagcaagttctagtgggatatggatgtcgaggtcgagatcccgtctgctccggctctaaggagtatggatgctacatatctgttgacgaggcggatgcagatagaacacacaggcaatcaaaacccttcctatccaagatccctaacgttatcatcagcaaactcctagattgcatccaagatcatttcgttatggaacccttattcccatagatacagcaaccatctttggatactgaatttatgggaatggggttccataaagaaatgacgttgaaaacaatctaggatgttggtaacgataaaagatttctagaaatgatgtatttgaatgaaatgttctgtttaccaatttgtcttggtcggtaccgtgcaggcagtaacccgaccaaaccagatttggcaaccaggacacttcgtattctcctaaatgccataatttcagtaacttcatttaataacatatttctatgcatatccatcccatttccctcaaaatgacccaaaacagcccatactacacaagtcacatatatattatttttgtacctaaaaaaacacaagtcatgacatataataagtttggcctcaattttgctcagaaattatgcttcaattatcatcatttgcaactgcccccacccccaaaagaaattaagaacaagtgtagagggtctatccttatgcaaaaaagaaacagccatataaaaacagccataataattcaaccatcacaacccacatcaattcatccatcccattggaccaaaaatatcccaaaaattttgcaaagaaccatataagaacaagtctagagggtctgtccttatgaaaaaaaacagccatataaaatgatcccatattgccactccccccaaataaaatgaacaagtgtagatggtctgttcttatttaaaaaacccaaaaatcacaagtgtatatggtctgttcttatgcattaaaaacccacatttgaacctaaacaagaacaagagtgaggctggcccaaaaatgcatccattttgtaaaacatcccatactgccactccccccgaaataaaatgaacaagtgtagatggtctgttcttattgaaaaaacccaaaaatcacaagtgtatatggtctgttcttatgcattaaaaacccacatttaaacctaaacaagaacaagagtgaggccggcccaaaaatgcatccattttggaaaacatcccatactgccactcccccccaaataaaatgaacaagtgtagatggtctattcttattgaaaaaaccccaaaaatcacaagtttatagggtctgttcttgagcaatcatcaatggccattcatcataaatacatccatcacatcccacaacatcccaagatggcatttcccccaaaaatcacaaattaattccatcacagcccactgcatcccaacatggcatttcccccaaaaatcacaaattaattccatcacagcccactgcatcccaacatggcatttcccccaaaaatcaagcaaaattcatccactgcatagcaatatctaattcatccaactatacaatgcaaaaaacatccactgcatccactgcatccatacatctaattcatccatacactgcatccacaatgcataaaaaaaacgagggagaggaagcgtacctaggaggagaagaagcggcggagaggaggccagtgacggcggcggacttggcgtcgggcttgacgtcggtcttggcggcgggcttgacgtcgatcgctgaagcggccgtggcgtcggtcttgacgacttggcggagaggaagccggcggcggcgaacttggagaggaggctggcggcggcggtcttgggcgtggaggaggcgctggcggtcggggagggcggatcttgaacctggaggcggcggcggcggtcagtaaggccggatccacgactatggaggaggcagcgatggatattgaaccgggaggcggtggcggcgtcgaggaggaggcggcggcggtcgggaggcgacggcttggaggaggaggaggcggcgtcagcggtggcggaggaggaggaggcgacgacggcggtggatctgagagagtgagagtgtgagagagtgagaggcggcgtcggcggtggataaggacccgtggatgaggattgactaagtaaaccctagtcaatcctcatctctatcgggcagactattatacccgatgcagatgacactcatccgtgacgggcgttagtactctgcccgatacggatgatacctatccgtgacgggcattagaactaagcccgatagagatggaataatctctatcgggcatagtactaaagcccgtcacagatgacttattaaaatattttgaagttataaaaatcatttataattatcttctacccgatttaaaattgctattacatttgatctatcacatataattaacaaatgtcttatttacatagtttaaaattcctattaattttttaaattcatataattgacaattgcctttctcacatatagtttaaaattcctattaatttttttttaaaatcatctaattgacaaatgcctttttcacatatagtttaaaattcatattactttttttaaattcatataattaacaattggctatctcacatatagtttaaaataacaagtataattttttaaaaccacataattaacaaatccatttcttcaaagagttttaactcgaatggcatgaaacatatgcaattcattcattaaggctccaatacaaattaaatacatcattcacagtgatatgccttccgaatggtctgaacgaacgtaagccacttcgtcttcgggatcatcgtcaaggtcaatctgaggtctgacatgaagattcttgttgtattcttcttcatcggcaacattgtccacccccacaattcttcgcttgccatccctaacaacgtacatcttcttgtttacagggtcttttatgtagaaaatctgttcgacctgcttcgctagtacgaatggttcatctgcgtatccaaccttggccaggtccactaatgtgaagccttccttgtcaaccttgacacctgtgcagatattcacccaactgcaacgaaacaaagggactatgaagttcagatagtttagctcccatagctgttctatgcggccgtagtatgtgctcgatccaacctgatcctgatatgcatctatacggattccactgttttgcactgtgcttttctcatcttgtgtgacggtgtaaaatgtgtattcattgatatcgtacccttgccatgtgtcaacatcccaagatggaccccttgccaacctttgtaatatctcacttgggccatcggtcgaccgtgctacacgatccttgaaccattcgttgaagcgagcaccatgttctctgttgatccaaatatctgatcgaccaatattgtcctgtcggaccttcgctaaatgctcctcaaagtatggggttacttcagccatatgttgcagcactgcgaaatgagcttgcgcgtaggaagcttgatcgggaacaattctttttctgccagttgtgctgacacctgccaaccttccttcatggcgagacgtaggaactccgataggatcagtctcggccacgtaatcgatacaaaactcaatggcttcctcggtcgtgtcaccttcaatgatgctcccctctggttttgctctgttccgaacgtaggacttcagaattcccatgtacctctcgaatggccacatttctctcataaaagctggcccacatatttttgtttgcttcactaggtgaacagtgagatgaaccatgatatcgaagaaagctagtggaaaatacatctccaagtgacacagggtactgacaatatcggtctgcaacccatctaggtcttctggatctataatcttctgaccgattgcattgaagaaggcacaaagccgttggatcgtgtgacggacttgtggtagtagaatgcctcttatagcaactggcaagatctgtgtgattagcacgtggcaatcgtgagacttcattccaaccagcttaagatcctccaatttaacgtacttacttattctcgagcaatagcccgaaggaactttaatatctgccagacatgatagcattgcgatcttctcatccttcgacaatgtgtggcaagctggtgggaggtacactcttcccatcttctcatctgtaacaggctgaagttcactgcgaatgttcatctcctgtagatcgagacgcgcattcaacccgtcctttgtcttgccaggcatattcaacaatagccccagcaagctatcgcacacattcttctctacgtgcatcagatcaatgcaatgacggacctcaagatcttcccaataaggtagccgccaaaatatggattttttttcttccacatcctcttcttgtcctccttgctacgttttcttttcttcccaaactcattattaatgtccttcaccatgttgtgtacttgatctccggacaaatccgcaggggcagacccaagttctttcttaccattgaaaattttcttctttcttctaaaggcgtgccgtagggggagccatctcctatgacccatgtaaatcatctttcttgatttcttcagccacctactgcatgtaggttccatacagtcaaagcatgccttctttcctttcacggtttgtccagaaagataacccagcgcgggataatcattaatggtgcagaacaatagaactcgtagtgtgaagttctcctgaccatatgcatcccaagtttccacaccctctttccacagaatctcaaggtcatcgataacaggctccaagaacacatcgatgtcattgccgggttctctcggaccttggattaacaagcacaatataatatatttccttttgaagcacaaccatggcgggaggttaaagtttgcaatgagaactggccaagtgctgtgagaactgctcatgtctccgaaaggattcatgccatccgtacacaaatatatcctcatgtttttggggtcgacagcaaagtctttgtgctttcgatcgatattcctccattgaatcgaatccgcagggtgtcttagcaaaccgtcattccttctctctgtggcatgccaacgtactaactttgcttcattggggttggcaaatattctcttgaaacgatcaatgattggtagataccacacaaccttcgccggaccaccccgctttgacttctttccctcgcccgcgctcttctttcgcttgtatcgagaagccttgcagacaggacaagcatctaagtccgcgtattgcttgtggtacaatatgcaatcgtttggacacgcgtgaattctccggacctctaaccctaggggacacagaacctattttgcttcatatgtcgtctcgggcaatgtgttctcctgaggaagcatgtccttcagtattcccaaaagttttgtaaaactcttgtctgaccatccactactagccttcaacttcattaggtctaatgttgctgataatttggtgtgctttggcttgcatcctgcgtatagaggagtctccgagtcactgactaacctgctaaacttcatgaaatctctctcgttcatagctgggtcatcaatgtcacgtaacatgtcttgcagcatatcaaggtccacatcaaccatttcatcgcccaatggagatgggacaaacatgtcatgctcttcttcatctccttcttcatgattgtctgcaccacttccgtctgcagctgcaccatcagtacccagatcttgctctccatgcatcacccaacatgtgtatctctccatgaatccccagcgtatcaagtgagcgtgtacttccttttcatcttcccacaaaatctcattcctgcaatcgctagatggacaacacatgtacttgtcgtttcttcttatcctatcctcctctgcggctttcataaaacttaatacgccatctccatactccttgtactgatgcctcaagccaatcgtgtacatccaactccgatccatcgctgaacaatgaacaaaatattagttaacatctcataacataagtactactaaattaataggaaatgtttagtacccttttacttacttttatgattttcctgtttttgtttgcaaaaaaattacaaaaactcgcccccttcaacctcccaccaaaatagtgaacagtgggataaactacagacaacggattgctggagtatatatagtgtgcaaagtatatctcaatcgggccaaaaaaaatgtcatctctaacgggcgcacactagtctctaacgggcacaaatagaaacccgacacctataaaagtcatcggtaacgggcattaaggccatctcaatcgggccttctttggagcccgtcaccgat

SEQ ID NO: 60433 - DNA, 8106 bp, Oryza sativa
ttgccaatttgggctttgggcttgcataaacagacgttttcccaatttgggcctaatcaggcttatcggaattctgaaggaagtacatgtgctggatctgcagggtttgctcctcttcagaagctgatcgacaaagtaatttgtgctttgttcatcacgtagaacacccaactattcagggaaccaaaaactaataatttgcatgaaaatataattccatctacaggtggccggctttggcaacatgcactgctaggtagtcatttgtttccacataatcaagtgttggctcttttgacagaacttacaaagtaaacgatgctagctaaaccagtatacaaagttaagttatcaaattcctgcattttctgtgtgtcacacattagaaatactgaccctccctttctttccaacaaaaattcttgtcatgctgattgatacacgaacgatagtattgtttcatatatatatagctcattaagttggaaacacgaatttaactacggttacactgattaagaacatgtttctttacaggtgaaatatatgataaaacaaagtccaattcccaattgtgaaactagactacccagtaatgggcaaaatccacatccctctttctgaatttggagcttcgatgagatcatactcgtcagtttctccatcctctaccttggatacctcaaaatatttatcacgcgcaaaaatagcatatacacaatccttctctagcccacactcatcagccgaacgtgaagcaccaaaataacaaggagctatcaagaacgtacggccaccaatgtcctcggctatgcaccattgatgcttggagaaatccatcttataaacagtgacgtcgtagacagtcttgaagtcgtactcaagcagctgacataccatgtaaagttcgctctccgactccaccaagaatatgcatgctgcgcccacaaaatccatggggtcggtgattgcgatggagctgaacgtcggctctggggtgaactccagcacactgatgttgtggaatctggcgttgaagtagaacttgccttggcaagctgcgatcgagcatatcagtactttctcatagtccttgccattcatgggtggatccaagtgctgcgtgccaatatcgtactcgtgcctaacccactcctcatcttctccgacgtgacagtaccagatgatggtgtcttcgggctcgacgaggagcacgatgcagccggggatcgtcggcttgtcggagagcgagcacgcaagcacatctgctgtgcaggacttccggtaggtgcggcagatgaatcttttcgtcaggatcctgtgggttctgcagaaacatggtggcgtcgtcgcggatcaggatccatccctgctgcgtcggccaggcgttgctgttcgtcatcccgggtatgtaggcatcgatggcctttttctccgagatgctgaatagcgccggcttgtctgaatcggcgccgtgcttcagggcgttgcaaggcacagggacatgtctcgtcttgtccatcatggtgatcgatgtgagtatgcggcgttggatctctgcaggtagcaacgcttttggctctcttacatacatactctaggcgaagactccgattcagtgccgtgttgcagacgacgagacgagtcggcttcagagtcggttcacaactcacaactagtcacaagaagatcgatcgccttcctatagcagcggtcatgtggttcagtttttggtaacaaggaaacggatttgatgtcttctgttccttttctgattttgattgtgatcgcaagagaggaaagtctctaaaagtatggttaatatagttttacagataatcacagtaatagcgacgggtgtgagtttctcctaaatctccaatccctccaaagaactgccccttttcagaggttttttttttttgactgataactttacagagtttcagtatttaaaatatttggtgcattagacatctttgagacaaataagtaatttatgttttgtgataagtaatttataaaccattaaaattcagataactggtgttcactcttcagaagttctggttgcaatgcgctgctactatcaggttcttgcgttctcttcttttccaagtccaattctgaattctgaattctgaagcgacttgttctgatgtcctcacctctcggtgctgatcatcaacaagtaggttgcagctctcccatcaagtaggacagctaatgctctaatctttcggcttcagggtggaaacaagaacaaattaacatacataactgtttacctgtaatttcacagcctatccctcttctacaagttcaaatatatttaccaagtgtgttactttcatttggaactagggagagaatttcatcctcacatgtaactgggcacatgcagtgtgacattatccaagaaaagtgttttaatcccttaatgggacatcaacttatttcttgcatgtgcactaaaatattaaaaaccaattaacaagatagtttaatataagatattttacagcacaaatatacaagttaaagtaacaaatatgactgaatgtatatatttaatttgttatttttatcacaacctgtaaatgtcgaatttgaccttatatgcttgtggacaatgtgcctcatattaatctattttgttaatttttttaaaaaaaattatggttatttgggtgacataaaaaaacgagtattcagctacgtgcagtattttctttcccctgaatccactacttggatgttttcgatagacatgcatcttaggaatatgaactaaataatgctaagtcattactacaattgagatgagtggcgccaaggttcactactcagtttttaataaaccaaaataaaggtcatcaattttccgtgtgttctctctgtacatagtcccctcttttaacgaaatatcttctcatgctttcaatagatagtacgatggaaaaaaatataaaaatgttaatttcatgagatttgttacggtccagcagatggtacatcaggtaccaaatgaaatccaaccgttcaattaccgtgggcatgattggaaacattgtcaggtcgacttaacattcaggccgccgtcgccctcgacgccggccccgccggccgccgcgcaccacagaggccggcggccagatccctgccagcccgtcgacgccagctaggttcccccatccgccatcgacgccggcctcgcgcacaccctcgaacggatcctgcagcccgctgccgcttcgcatcctgcagcccatcgccgccgccgtcggcttcgtgcactccgttgacccggatcccgcagcctaccaccgacccaaatcctgtagctcgtcgtcggcccaaatcctgtgggctgacgccgttgatgccgctgcaaaaaagctcagaacctgggatggagaacgggcaggcggctggctgagccgatctgatctgaactgaggctacgcgaaattacgaaaatgcccttcaggcggtggtactgcatggaatcgatcggtggtactgcccggtactgaatctgtctcagccatccgatcaagttaaatgaatggtgtagatttggtacctacccaggctgttggaccgtaaaaatactctaatttcatagataatgcactcatcaagcagaaacaaataataaactaaagttgcattaggagaaaaaaatcctttacattctttcaactaggcttgaaaatgatgacagaaactttggaccaaccaaataaattttctagaagtgacagccatttccaattctagtcttatataattttttctgctttctgtgtcaacccgtttccacagagatgatatcatttcaggcagtttccgaatattttcatttctacttattttcaacaggcaaaatccacatccctcttcttgagtctggagcatcgatgagctcatgcacctcagttgcatcatcctccaccttggatacctcaaaacatttatctagtgcatacgagacatacacagaatctttctcaagcccatactcatcagccgagcatgaagcgccgaagtataacggagctagaaaaaacgcacggcctcataggctctgcgccattgcaagctcaagaaatccatcctatgaacggtcatatcgtatatggcgaagtcgtggtcaagccgcagacagatcatgtacaattcgtcctcggattctaccaagaacacgaccgccgcgcctatcacccctaatcctccggggataggatcgacgatctcaatggtgctgaacaccggcgtgggggtaaactccagtactccgatgctctcgaagaagcagttgaagtagaacttgccccggcaagcggcgatctcgcatatcggcaccttctcgtggtccttgccatccatgggtggatccaatggctgggttccaatgtcgtcgtcgtgtctcgtccactcttcatcgtcgccgatgcgacagtaccatatgttggtggcgacgggctcaacgaggaggacgatgcagccagggagagatggcttgccggagagctggcaggagcatctggttgacagaccttctgggagatggatcttgtcttggggatcctgagggttctgcaggaaggtggcggtgctctggcgtagtaggatccacccctgcggggtgaaccaggcgttggtgttggtcagcccagggatgtcaccgtcgatggccttcttgtctgagatgctgaacagcgccggcttatctgcagcagactcgtcgtgttgctccatggagaggcaaggcacggagacgcggccgctcggcttgtccatggccggcgtggtgttgtcaaccttgtattcctctcttcttagttggatctgcaaatcgtgctctgtgctcctcttatatgggcgaagctgctacctaagcagggttgattccgactcagagtcagtcacggccggcgatccctcatcagagatcagacatctgaagtaatcggaattggaggcaaaaggccaattttcgtggtgaggtaaaagagacaagaaacagggatgctgttgttgttcgtcagggcatcgatgtcgcaggcgatgtcctgtccctcgaagatgttgaacagtgtcgtctttactgattccaggccgtgctgctgctgctgctgcaaggcgagacagggcacagggagaggatccatcccaaatatcgtgttcttatacttcatctgggcagggaacttgcagccgaatcggaatcaagcagccgtccggagtataaccggattccgaacggctcctggacaggagtaaaacgtgctcatgctagatttcgctcatcaggtaggaacatctaaaatgctccaagcctccaactattcatgggggaaatgggaaccaacaactaacaatttgaatgaaaatttccagcctgcacatgtagttgcagctttctcatcatgtacgcacaatgctctaatctttcggtttcaggttgaaaacaggaacaaaaaacacatgactgttaacctggaattttacagctacactgaaaaaaaaattcagctaggtacagtattttgtttccagtgaatccactacttggttgttttcgacagacaacttacgaatatgagctaaataatgctaataaaccattaaaaccgagatgagtggtgccaaggtggttatcaatttaataatcgaaaaataaaggtcatcattttcttgtgtgttctctctgtacataaccctttctttccaacggaatatttatgctctcagtagaaagtaccccaaaaagaaaagaaatattattttcatatatagtgcaggcatcaagcactgcaaaaacaaataataaatcagttacattcggaaaatgattcttctttacaacctttcaactagggttcaaaacggtggcggaaatttccaaccaagtatgttttgtacaagtgatgccgcttccaattctagccatatataaattttgaatttttcaatttctatcaacatcgatttcatagagattatatagttttccgactgtatccaaacattaacatctctatttttttttcaacgggcaaaatccacatccctcttctcgagtctggagcatcgatgagatcatgcacctcggtttcatcatcttccaccttggatacctcaaaacatttatccactgcatacgaggcatacacagaatccttctcaagcccgtactcatcagccgaacatgaagcgccaaaatagaacggagctagaaagaatgcgcgacccccaatctcatcggctctgcgccattgacggctcaagaaatccatcttgtggactgtcatatcgtagatggtaaactcatagtcaatccgcaagcacaccatgtatagttcgtcctcggactctacaagatagacgtgcgccgcgcccgtcacccctaatcctcccggggtcgggtcgacgatctcaatcgagctgaacaccggtgttggggtgaactccagcactccgatggtgtcgaagaaaccgttgaagtagaacttgccatggcaagcggcaatctggcatatcgccacatcatcgtggtcctttccatcgatgggtggatcgaagggcaacgttccaatgtcgtactcgtgtctcgtccactcgtcatcgccgatgcgacagtaccatatgacggtggcgatgggctcgacgacgaggacgatgcagccggggagagaaggcttgccggaaagctggcacgagcatctggtagacaagccttctggtagatgagggagatggatcttgtcttgggaatcctgagggttctgcaggaacgtggcggtgctcaggcggagtaggatccatccctgcggcgtgaaccaggcgttggcgttggtcagccccgggatgtcgccgtcgatgatggccttcttgtcggagatgctgaacagcacgggcttatctgcagactcgtcgcgttgctccatggagaggcaaggcacagggacactgacgactgggcttgcgttctccatagtcagcgtggtgttgtcaacctctattcctctcttcttttaatgttttatctgcaaaaccggtgcttatataggcgaaaactgctgccagaggaatgttgattccgacacgaacattatcagacatcagaagtaatcggaatcggaggcaaaagatcaattcttcttcgttcgaaaaaaaaaagatcatacaacgcgttgcggcccacttgacccagttagcccacgtgcacgcatattggagcctgtatgcacatgtgtagcctatttaggaaaaagtccaatcaactcccttaatatacacgtttaacttcatcggttatgcttcatccaaagagctaagataaaattaggttacaggacctccggcattgcacatgcttgtgtaagtgctattgaacgataacaaatcatctgcatgaataatgctcagatcatgaatatagaaaatcctaattacccaaattttaatgtaattttaatttttcccgttgcaacacacgggtatttttttctagtgaatgaaaaagttggtagcagaaattcaatttttagatgggtaatagaaacttttgtatttcttagcatgtactcaaacagtcctatcaccaccaacgggtggctttgttctgttcatgtcaaactgttgttcacaaaagcatcattagagctcttcggcttcaattgagcagttgcccaaagtttaatatggtgtacttgtccatgttatgaaattgacgatggatttagccatcgtatcactaaagattggacccggaagagtggaatacaattcctcaaaattttgctggtgaatggcaatatgaaattggtcagctgagtgcagtatttttttttaaaaaaaatatatcattatgttcagaaacaatatctaatctaaagttgcaaacttgctgtactaatcaaattgtgacaagtgatgccatggttcagtccaattcatgaagttcctggttcagaacaatctctgaactaaaattatcagtgtgaaaatctgtctcagggattcctgaaacactgaacatttcctttccaacaaaatttgtctcagggattcctgaaacactgaacattttccttt

SEQ ID NO: 60434 - DNA, 8787 bp, Oryza sativa
cttaatcagtgtaaccgtagttaaattcgtgtttccaacttaatgagctatatatatatgaaacaatactatcgttcgtgtatcaatcagcatgacaagaatttttgttggaaagaaagggagggtcagtatttctaatgtgtgacacacagaaaatgcaggaatttgataacttaactttgtatactggtttagctagcatcgtttactttgtaagttctgtcaaaagagccaacacttgattatgtggaaacaaatgactacctagcagtgcatgttgccaaagccggccacctgtagatggaattatattttcatgcaaattattagtttttggttccctgaatagttgggtgttcctacgtgatgaacaaagcacaaattactttgtcgatcagcttctgaagaggagcaaaccctgcagatccagcacatgtacttccttcagaattcagataggcctgattaggcccaaattgggaaaacgtctgtttatgcaagcccaaagcccaaattggcaaaacgtaagcatctggtctctgatttttcatgtcgtgtcaggctgcaattcgtggagcttcaggcagggattgctgtgaccgactcgtaatccaccgtttgtactccgcaacatctgaccttgtgactcgtctgcaaccagctagcaatcccctacataagagaggcttcggttcggttgcagatccaacgaagaggataggagatagatcagccttgatcaccatggacaagacgagccgtgtccccgtgccttgcctcgccctgtacctaaagcatggcgccgacacagacaagccggcgctgttcagcatctcggagaagaaggccatcaatggcggcgacatccccgggctgaccaacaccaactcctgggtgacgtcgcaggggtggatcctagtccgcgacaccgcctccgcaaccacatttttgcagaatcctcgcgatttcgacgataagattcagctaccccatctaccccaggacgtgcacatcagttccacatgtctgctctcctgcaagcccacgatgcctggctgcgtcgttctcctcgttgagccagtcggcactatcatctggtactgtcacattggagacgacgagaagtgggtggaacatgactacgacattggcacgcaggtcttggaccctcccttggatggcaaggaccacgagaaggtgccgatatgctggatcgccgcttgccagggcaagttctacttcaatggcggcttcgaaagcatcggcgtgctggagttctccccctcgccaacattcagctccatcgcaatcatcgaccccatcattggaggattaggggtgatgggcatggcaagcctgtacatggtcgagtccttggatgaactatacatggtttgccaaatgtatgactctgaaatggagaccatctacgatgtcactgtttataggatggatttctcgaagcagcaatggtgcgtagccgaggacattggtggccgtgcgttcttgacagcttcatgctattttggtgcttcacggtcggctgatgagtatgggttggagaaggattgtgtctacgctatttttgcgcgtgataagtattacgaggtatccaaggtggaagatggagaaaccgaggagcacgagctcatcgaagctccagattcgaaaggagggacgtggattttgcccgttgaataaagtagagatgaaaattgtccaaatcagtaagaaatgacgtcgtctctatggaaacagagctgatagatattagaatgtaagtcaaaatttatatacggctagaataaaaaacttggtaagttgggaatttgtgccaccgtttcaactttcaaccccgttgaaagattgtaaatgtttttcttttcagtatagctattgtttattactccctctattctaaaatataaggtacaatcacccttaattcaaagaccaagaaacaattattaccacctctttatttgaatcgatccatacatgcacccaatagaattaaacatcttgtgagtgtatgatttaaaaaataataatttaggagagaagatatgctaattaattgtcatgcatgcatgcacgccttatattatgaaacacctttaaaaagtcgttgtgacttatattttggaatggagggagtacatgtttttgcaacgcttgatgagagcactatctatgaaatttacatttcgttttttttttgcgtactgtctactgcaagcataacaagatatttcgttgtaaagaaaaggttatgcacacacgaaattaatgattctggtgtattaaaaaaattgagtagtgaaccttgccatcactcatctcagttttattggtttagcattagtcagttcattttcacaagttgtctgtcgaccagaaccaagtagtggatttattggggaaactctaataatcccttaacgcgatatccccttatttttcgcgtcgcttaaaaatcatgaaaaaaattaaaaaaaagttagagcaacatgtgatatatcacttcacaagcatgcatgttcaaattaaacttatataattaaaataaaaacaacaaatttgacaatgaatagaatgcgcaattcactattaaatttgttatttttgtttcgaattgtataagtcgaattttaattgtgaaaagatatatcatatattgatctatcttaacagttttttataatttttttgatgactttcaaatatcatgcacaaaatgaggggatgtcccctcgagtgataaaaaaatccatctcgatttattgaaaacaaaatactgtacctagccgaataatgtcgcactgcatttgcccagttgcctctgaggatgaaattctttcactagttccaaatgaaagtgacacacttggtaaatctatttgaacttgtaaaagcagaggataggccgtaaaattccaggtaaacagtcatgtgtttttttatttcctgtttccaacctgaaaccgaaagattagagcattgttcctacctgatgaacaaagctggtatgcctgcttttactgaagtcctcgtctcggcgcgttccatggccgcctcctcctttctccgcagctaagctcaatccttctccgctgcgctcgtgctcacgggcgatcgcctccatggccgccaccgctagccgttgccccctctatgtcaccgctccggttcgcggcgtgggggtggaggagaatgccgccgcctgcaaggaatgggatgtggggaatacgatcaactcgtgcgtcgcgtcggcgtgggggggacgagatggacgcgatctcacctttttttctcgccggggaaggaggggagcgcggcgtcgactcgccttgtgcggggaagaagacaagaggggtggggtttgccaggttaaatgcctctgatcggtggcaatgaaaaaaataataaaaaaaaagtcgatcgtattttacattacactatttaccatccatatctttagataagatataggtccctatgtgtatatgacatggcaaaagttaaacatcatgataaatagttaagttaaatatctagggtgcgtgaggtttgacattggagagaggcttaggcggaggttaaggccctatttgagagagcttgtcacagctgcagctttttgctagaagctgccccaaacagtccacaacttctgagaatctgtagttacatattatgaaaaatgaactaagaagccagaagttggagaagctgagtttcagagtttttccagattctcagaagctgactaccaaacagctgtttttcagaatctaaagctcccccaaataggccctaagtttatgaacatttgtgaaataacggggtggcatgtgagaatttggttttttttttgacttctactttactttttagttgtataattacatattatcataatatatggatgaacaatgtggattgtttggggaggttgagattctcccaatctagatttttttttatttctagtctatcttttgattttatggttacatattttcagaatatgggcaagaaacttggaccgttggtgaacctagagattctagcagaagctctctcaaacatggccatagattgggagattgtgttcctgtgtgttcctgtgttggaggtggtgggttgagaatgcagtggcggtatggagatggcgttagagggaggaggtggattgagaatacggtggcggtatcagtttgtcactagaggatcggaagaaggattatgcttttcttacttgttggttccctatagcaatgtacttcctccgtttcacaatgtaagactttatagtattgcccatattcatatatatgctaatgaatctaattagcatctatattaatatggacaatgctagaaagtcttacattgtaaaacggaggaagtactaaccaagagcaagaacaatatagtgtatgatatcggcgttttggagagaatgtcacattatgagcgaggatatatttatataccattcaataaaatatttaatacactatttataccatttcgtacaatacatctgttctaaaatatagcaacttttggctatacatagagatatactcttgtttaaattaaatgtactgtggaagttgtaatattaaaagaccctcattgttatttaacaaaatagaatacaaagaaaacaaaattttggttttattaagggtagcgcagtaatcgtacaaaatacaaggacttgtgtgcaaaatatccttctctccggctctcccacaccaaatcctctcaccccccacctgcgccccgcgcctctcgccgccgccgccgccggcgacgacgaatttcttccacccgcatccccctcctcctagcaagctagccgacggcaacgcctcccggttccccctatgaactgacgtcgagacctcatcccggccgccaccagcgccaacgccgctcctcctcctccacgagccggtgcctggatatttctggatctgaggccggcccgtggctgcaggactgcgtgcaccattcttccgacccgacgttctgccgccgcgcgcctccatgccctccggatcaagctccccctgtattagggtggggttttttgcctgggttggcgagcgaggcaagatgctgtggtgggacacgctgctctgctctgctctggcgtacggcgtacctatacgagagaaccaagtgccgcctccgtcagccgtgaggtgctcatggagggcaagcccatccccaccgagctccgcaacaaagacctccaggaccaggaaagagcaggttagtgagctcctgtttctcaacgtttccgctccatctccatcgctgctgccttttctgcttcttctttttcatctatatggctgggtgtgtggtgaattttgcttcagccccaagtatccgcgtagacaatgagtattgacggtggcacgctccacgtgccaagattctcctggccatgtcttgcaatccgagcacggcttgcaatccaagcgtgcccctgatttagtttgtcgaggtgcggcggcctttgaccaggcaacaaattgttcttcacaagttgaattggacacatttggttgacaatgataatcagtaattactgtccattcgctaggaagtcaaacccataattcctgtctcgcaaagactaaactatggtagtcatatttagtatagttcaaaggcaaccttcacaattgaatctattctaaaaaagttcgaagcagtcactaatgaaaatcttgaactactttaattctaacatagttccagaaaagattggtgaagtatactttgaactattctagaaaaagtaatgctgaaggctgttgatgtgcttgctagcagtgagtgtgtcaatggtaccatctttttttttccctaagagggggatgataattcacaaacaaactgtgaattttggattctattcttctgtcttatttgggcataatttatcggttctcatatttaggtttgatcactgtaaaggaaaatgtctctggactcaagccagtgctccatggctttcatgtgcatgcacttggtggcaccactaatggttgcatgtcaatgctacattcatttctttcccccttttctttgtcaggagaaatggattgtggtgcgcgagttggggaaattgttctaaaagtgtaggaataatatactccaatccaactaggaaggaacatggggggcacaagaaggttagaaacgtcatgctggtggcgttggaaatataatgatttgaattggagcggatgcttttttttacagctcttttattgcttacattccaaaaatattttagtacacactgtctgcattggatgaaaatttgatagcttaactacaacgctgtgctatcttaacatttattaggtgttttactcaggtaggttctacagagacctagaaatctgagggacattagtgtgtctaagttatcttgaaatgtttcacgaaaatttttagtgttcaccccaagacatcattagtgtatgcctatgcttaatgaatgtcgttatccgcttgaatgaccaatgtttcttatgtttccttgtaaatcaaatgttatatcattgtctcttgtcatttcatgcagattttcacaccacttagcccaaccctgtttcatgtaatggcttcttgcttaataggccttccaagtaaagatggcataggctgagttgcaggatggaaatttatcaggagtcagctccactttcagtgaatccatccttctcctggaggaagagaagatacatgatgcagtgtatgttctttttattcgtgttctgacattgcatgaagtaacgcttcttatattttatttggaaattggaacgatctctatttttttccttctctcagtgagttcagttttctgaagaaaaaatgtgttttagtttaaacacaaccatttgtttagtagttaatccattacacgtttctgtgaaattttgatcattcgtaacactgttaaattttactttgtgatttgtaataatttcttctgcttctttttctgcagtggacaagttggtgaaaaaaaaggaattgaacttttgcaagatatactgaaataaagtcagtggttaagtctgataaattatctgctgcattgaagtcccctcatgcgtttctgcgcaaggtatgtagttgcatcgtttcctctttacacgcactgaaaaaagacatgttggaaagcctacaaccatagaagtttacattgtccatttttggattatatgttaattgccggaactgatagtcttcagatataatgcataagaatttatattcttgctagggagaaaaaaactcttcatggttttacgaatttcatcacttgcaaaatggagcagcaagttagccactatgggcacattcagttttaaattaggattctgatctgaggatttaggcttgcagggtacagaaatcagaattttcccatttgctctgcttctactggaaacataaaattttaaatgcttgtcctagaaccatgttatttcatatttaagcactatgctttatggtattccacatttaaactttttatttagggattggaggatattgagggggattaattccacaccttaatagatgtggaattaatccccttcgaaatcccccttgattcccttgtaggagggattaactgaacaatgccttagtggtacactatcatccattgaaggaataacttttggaaacaagtggccgtgaacttacataataatgcttggctttgttgccagatgatggagagtacaatggatgactggtcaatcagaaagggtcttcaacaaagtggaggtgtggttaaattatatgtacattcaaactaatatttatcagatggctttggatgggatttcatggacaatgtttatatacattgtcactatttaggttagagaatacagaacaatacacactgtgtcatatttgggtacagggaccgctcatattctgggatgcattcttcagcttttgttaactgtgatgatgtagccttgagctgcagtcaacaacggttcctttcgattctgtcatgccaatttccccatccctgcactgtctttcacaattaagtcatccctatttttgtacaatgcaatgaacagctgcaagcatagttgcaagagtgatattttggttattcactaatatggtcatattatggtttgaagtttggtcaatttaattaaagagcacctatgttaacaaagcttccaattgtttttatattgttatgatcatgacattaacctgtgtggttgtacttttaattaatatgcacggggagtatttgcacgagcaaatttttacatgaagtttgttcatttgacatttggcgtcactgaatacaaatttctgactatgtatgtactatgttttaagattaccttttttaggttaattgaaatgaaggggaaacattcaatcaataataactaattggcatttcatgagacttttgcttgcgcagctgtgtgcggtagtagcaccgcgcttttcccttctaatactatccgcacactctatttcttttgaatgaaaaagacaggtggggttagaggctacacatgtcaaccactttttttttaccaactctctattttttttaattaaagtgattatatagggctaaagggtccacatgccagtaatagaaatacatacaataattaaaagatgatatacataggaaatgatgataatgcagattaatgatatttttgaaatcccattgcaatg

SEQ ID NO: 60435 - DNA, 11549 bp, Oryza sativa
catcaccagcttgctcatctaggcgccgtggaactccttgccgccgctcgtcttcgcgaagactccggcctccccgtccttcttgacgacgccgacgacctccgcgccgccgctgctgctgccctgcctcgcgatcgcctcgccgtcgcactcgccgccgccgccgcccctccgctctgcctcgccgccgctgcccctccgccctgctcaccgtgcgcgtgagagaagagagagagaggaagagtagtgagagagagaagagagagaggggaagagtgggaggagtatgacaggttggtcccacatttttttaataaatagaatgctgactgaactgccacgtgtgcgccacgtagaccaaaaccaccgcggattggatcgaggggggtaattcgtccggtttgtaaagttgggggtgaagaatgtccggttttatggttcagggggtaattcagacgaccgcgatagtttggggggtaatttgtactttttccttatttgagggcacaaattaaatgaacaaattgaatatcaggaagttgaaaattttgttttaaaactaacgttttatatgaaatgccaatgaagaaagttctcgaataaaccataccatttagctttttaattaggaagtattcccgcgataataatccataatccacctacagttccaaacgggattagtgagtacgatcacaaaatgtacgatgatttgaacaataatacctatggagaactgactgaactgtgatgatacataattatgcttgcattactgctaccaatcagtactatatcgataatagtggcagccctataaaaaaagctacttccctaatcataaatagttgacgtttcgaataagttttggtcaaatttcaaccatcattaacacctcaaattcttgttttttttaaaaaagactacatgtgtagatttattttcaaaagcactatcataatattttaaaccaattagattttataaaccatttctcaaataaaactgattgttatttgatttgaaaagcactaccataatatcataagcttattaaattttataaaccatttcttatataaaattgattgttatagttttaagggtttgaccaaatctcttattctaaaaatcaaatacttataatcaggaggatacaaatttcttgagataacgtcgatcaagagggagaaaggagttatatatgaagtataattctataattctataagtttcaaaaaaaaatctataattctatatttccagtgatcgatgtatcttaacctttttctgtatactcgtgtgtttcaaagacgtgcattgatttcaggaagcgtttctgtgtttagtttgacagcgcaaacaaaatcatccatcctacaaatctgaacattaagaagcattagaaagtacgtgaacatacatgagtaccgaaagttgtgtgatgagagcatttgatgtcaacgtatttttaccgggccagcccaaggagaccgaccaatttcattaagctacaaatacatcgataataagatgtcgaaaaacagggtcccaaaagtaccaacagcacctcccgcaagtaaggccctatttaggttctaaacaaaaaaaattttcatcatgtcacatcaaatgtttagacacatgtacggagtataaaatatagataaaaaactaattaaacatattgcatgtaaattacgagacaaatcttttaaggctaattgagccataatttaacaatgtggtactacagtaaacatttgctaatgacggattaattaggtttaataatttcgtctcgcagttttcagatggaatctgtaatttgttttattattagtctacgtttaatacttcaaatgtgtgtccgtatatctgatgtgacacgccgaaaattttcatccgcgaattaaacaggtcctgagaactaacaggaactgctccaagtcgatatcattcttaaggactcacattcttaaacattctaactttttttttctaaatggtaagtaactactgaataccaacaatgcgttatattttagggtagtgatagtagaaataaagtatcactcttcctgttttatattataagcagctttgatttttaaagttaaacttatatgattttgatcaaatttatagagaaaatatagcaactctcttataatacgaagttagtttcattaaacctaatattgaatatatttttacatcgtgtttgttttttgaaaatgttggtatgtttttatataaatttagtcaaacttaaaaaatcaacttaagaaaagttaaaacgatttactccctccgtcccaaaatataagcatttatagcatacaagtcaaacatttttaactttgaccattaatagcaaacaaatgaaaaaatcaataatgcaaaattaatgttgctatatttatcattaaacaaactatcataatatgcaactctttttttatttaaaacatcttactttagtaggtattattggtcaaaataacatatcggagacagtgtcagggtctaaaaatatctttattttaggacggagggagtagtttattactcctacctatatctctcaggctgtgatccaaacttcagtccttttacatcacatcaaactgtcatacatacacaacttttcagtcacatcatctctaattttaactaaaatctaaactttacgctgaactaaacacagcctcaatgtgtaatgtttagttaatttgaactaaccaatgttaaataaaaaaacagagaaagtactaaactaacatagatgtcaacgtcgaggccgacgtggtcgtggatacccgagctatagctcccaatctcccatgcaccacccggcccacgggccaatccaaaatttccaccacgccgcgttggtgcacaacgcggtagccggtagggggcgctgcttccgccccggttgagcgccaccgagagagagccaggcacacgaaagtttcgtctccaacacgacaacccccacatttttcctcttccctccacttcgcccaatcccctcataaaagcgtgtgcagtccatcccactcagaatccatcgcccaccccgccattcgctgctgctgctgctgctgctaccaactactaccaccacaccacctccgcttcgcttcttccccaccctcccaaaacctccccaaaatccgcgcgcgatgtcacggaagcgcgagcgcccgctcgaggtcgtcgcgccgccggcgaccccgctctccccgagcaagcggctgcggcgggcggggctcgtcgttatgtggctgtgagttcccgctctcgtccctccccccgcttctggttccttccccctcccccttggaatagcgactcaccagtgccggttgcgtttggttcgcgtgggatctgtgctcttgcaggcgcaggaagccgaagccggtcggcgtggagcagatggcggcgcgcctgattcggcaggtgggttgtggtctctgcatttgggatcgtctcccaattagttttctgggtgatggttcatgttagttgattcagtttttttttctttggggggtgaagttggttttgatttaattaatttctactacttcattcgtgcaatagatgcaagtgcagatggtcaaattgtttatgcttctcatgtttctcgtcgcgcgccttggcaacgtggagaggctgcttctcgagcaaccgtatctgatccgaaggttgcttgaggagcactttggtatttttcagaggtttgcttctgtttactcgagtggaacacatacattttttttacaagcatgaaattcgagattcattgtcgggtttagatgttaccagtgaacgctgccagctcgttgtcgacaatgcatcggtaatcattatgggggcgtgacttgggggaagtggaggaggttggattgggggtatagtatagggtctcaacacgctcacaatttcttctatttatttgagaaccaagttcctccttggttgccatcattttattggatgtgtgttgggggtagtagagagaatttaggggtttttatttttgaatgatccaaaaagtgcgtgacacttttttttttggaaaaaagctatatgcttgaatctgatagcgggatggtctgtttaaatttggttggtttacctgcaaatcctagaaaagtactggaataagtggaattcctcctctgtagaaaccaactggagaaacttgcttattaattgcataattgcagtaataactgtcagaaatgaaaggcaaaacattacaaagctccactaactacttcccgagaattatctgaaacagttcttgaccatttttttcttggcacttatgattttgaacatcatagtcctgttttaatttcagattaccaggttacctacataccatctagcaaataaaccaggatagaacttctgtttttccccaagtaacagaaacaccaccaaaatatggataaagcgttgttctcttgaaattctttctttgtatctgatctcaaactttgaatgttacggatgtgatagataaatgctaccatcattaatttggtctcttattgtttcttatccaaaagatctttgatggaatccatacaagatacggttcgcaaggctgtccactcagaggccagtattttggaccttattcacgtaaaatgtgtgatctatctatacatatgctttgtcttaactccttttgatatgtcatacaacagatgaaggaaagacagacaacattactttctggaggtgcttatcagcatccaaggtatctgccatttttgtatcttctcctaaaatgttgaaaactagatgggcatttaaattcctctattaaggcactttaaaagtttcttgatccatgtcatgatcctaaaaaccaagaaaatgaagtcgtgttatgcattctaacatttctttggtgcacaaatgaacctgagtgcactgcaagttctacctatgaactgcaaacatgtccaaaaggaacataataaccaaaaggaacataggaaccaaaaccgtgcgaggagccctaccaaactggccctaaagatacataggaagaatgcttaagaatgtgctctgttgttgcgatggagtgaaagtgtactatgatatgtattccatgtacatgtattaatctctcattgtatctcaaattgtagaccaaatatatcagaaggttttccacaaactggagggagcactagaatggttaagttattttttgttgatgttgagagaccagaagacccacttttcacaggttctccagtacaatggcaaaatggagccaacgctaaagttgcaatatttgaaaatgggagtcaaatcacacagggtggtctttctaaactacaaatcgagattttaccagtccatgatgatttcttcactgagcgaggaccagcaaatttcaccaaagaggaattcaacaagcagatatacatgtgcaaagggaaagagtcagtattgaaaactgtcaatttaacaaatggtgaggccaatcttggttccttcttctttacagagagttcccatgggaaaaggttaagattggcagcaagagtaaaatatcaggatcttgcagtcagggttcaggaagcaaccagctattcttttgttgtcaaagaccgtcgtagtaaatgtgagtatccacctgttcattttaacatcagaacccttttgaccatacatgattggaaactccaatacacgatgtatgtttctcacaaaatgcagcattttctatgcctaatcatctgaagaacatgatactcgcacaagtggctaccaagataatatagacaaaatatttataatgaacatattatatatatttcattagctattctggtctcgtacatgcaatggcacttttctagtgaaacgaagtttgccacttgtcttgcacttttagaagggaacacctccaggtctgagttctgaaataaacagtatgcaatcctagtcctttgacgtctgttatacttttgttgatcattggggattttcttatgacttacaatgtcttgcgcaatggaaaaaggttcagatcgctgtaattttgtacaatagacggtaaattaacagtacgcacagcaagttgtttcactttgccaggtacacatgtggtaaatacccctagaactaattgcaaagatggacaaactgaaccaattgcatactagcaaccagcaataattgtgtacatacatcttgtcttgacacagccaaccttattgcctactttcagtaaataaaaagagcaattctccatctaaggaagaagggattcattgtttgaagaaaatttccctaaaaggaaaacgttgcaatgaccttgcgggcaaatatattactaaggtgaagcatttgatgcgctgttaccacagagatccagctggtctccaaaaggtaattatgcaattgctatgatgtttctacagttaccgtttcttcaaattacctgcaaaaagtatatactatcagtttgtcagggaacagtatattgttcatattccaactaaaaaaatgccacagaagtgaactgcgagatgctacttatcaatttttgggaaatggctgtagcttgcaaaaagatacctccgcctcctagccttcagtagaaaagtcccaagatattttataacttaaatttcataaatatgaatgttagtgctataaacaatcggcctgtacttgctattcgatatagctcctatgaaccatactctacggaagtttctgtaattaccttttctcttttcttcttctgttccttgtgcaatatttgttattagtattaggtatgctgcatgtagtttaaacaagatttaaaacacaaatcatgtgtggaacacaactacttacctttcacatgctgaagggttaaaacgtggcggtacttgccgcttgcactaacgttaacccagacattcttgtaggtgcagtacacatcagaattattataataatccaatttattaaagattaaaccaagttgatctattttacatttcatcattcaggtatactaattggaataaaatgttcagtgaacatcagttttgtttatttaccaagttaattgcttactttaccttgtaataccatgtttgctcctgaaaggaaaattgctagtaatgctatatatattcacgtgctaagaaactcacatcttcttgcaaccagcttactggcatgaagaatgaagattggaataccatgattagtcatgcaaccacgtctgatcctggggatgagatccattcttacagagttgagaaaaatactataatcttcttcaatgatttctttgctctagtcggtatgtcggttgatggctcctatgctccttaccacgccaacaatcttaatcagctacagcaggtatttattgaacaccattccgatgcaattaaaatattgacatctgtttatattcacaaaaatagtactccctccttcccaaattgatcatcatataacgtaatccaaaatatctcaaattgatcatcatataaccgcatggacacaaatttcatcggaatacaattaatgcagcatgagagaatgtgtgcatgctagggtgtaattggcatggtgttttaatcgatgcatgcattatgggagaatgtgtgcatgatgtcttgattgatgcgatttaaattatctttgatcttggtgcataaatatatatgatgatcattttgggatggagggagtactagtatgctgggcctactaacaattgcaaatattatcaacttgtacatcaagatgtaatgttggaacacatgactaacctatatgtggcattgctgaacataaacatgggagagtcatatagtcaatttgaagaccaatgcataaaacaatttgggaacattatttatgttaaatcagatatttatttgtgctatggagtatatcgttggccataagttgataaacccactcaatgatgattaaaatgtgttgttgtctgtgagtacttttgtagtgttccaccctacctatataaacgtaattccaactttgaatcctagccatttataatataatgtgatggaatgacataatggagtattttgttacagcgtaaaatgaacaagtggaaggagtctgcgtatcagaaatttgaggaactggagaagttggggtgtcttattcctgatcatgtcatgatcaatggccaacctgttcccgtgtctccaaaaaatgatgccagtcattccatacaagccaacccaacatgctttaatcaccagattgcacttgaaggtcttttatatattcattatgatccatacaaaatcctagtcatttcattttactcaagattcaagtcgttgcgtaattaggtcagggacatcgatttcaacagcagaatggattttcagcagtacacgtatttactccatacaatgttgctggaacttccacacaactaaaagagccgttgcaacagtatccttatgaacaaagtatgcatgaaggtcaatactactccctccgtttcatattgtaagactttctagcattgcccacgttcatatagatgttaatggatctagagatatatatgtgtctagattcattaagatctatatgaatgtggacaatgctagaaagtcttacattgtgaaacggatgaagtatatacctgcttaattttcactgaacaccctccaagttactataactgttcatagtttcaacttgcttcagaatctggtcgggagggtccttctatgcagcataatggaacttcttactctctgactgaggaaaacatcttgaacggtctaggctctggcttagtacaatcaactatcctatctcaaaatactgcagtagtaagtaaaaacgaaattgaaatattaggacatgatattttgtcgtgtccatctctttctaaatgaagattgaaattctttagttggtaatttctcgtttatgacttgaaatgtttctgtatataggtcccaggtgcagatccacggcacagtggatatgccagcacctctacagctgacgctgctggtacttcttgtcctgtaacaggtgtgcagctacactgaaactcttatagttcaacagtacatttgcagtgaactcgatcaactcaaaccacttttctacattatgtatttgctgggtgatgaaatgttgatgttggaatttcctcagatggagttggtccatgggactatccgattttcagtgatctgtatccaaatgtagtaagtactttgcgctgaataagttgaacatgctatgggatttacttcaaagcaatgtgctcaatctgaagcaatgttgtcagtggcttgtttggtgttttttcctttgtttgtcatgacatttgtagatgttccaggaaccgtcaggactaatctatgggcatgtggtggaggcagaccaggcctttctcccagatagccacggtatgtgtacccacggagaacatggcagtagagtatgaatactttcgtaacagaagttttggtgctgttgagtttctatttgtatgcttcttttaaactgctttgacatgttattttcaactaaatatagttccaatttcctaaagtgtgcaaaataatgtcttatattcataataaattgggtgaactcaatatgttattaacaataacagaattgcttcgcccccttttgataccagcaacctgaaacagtatattattcgttacgagaaactgctagaacaggttatacatctagatctaggactgggagggaactattactccagttcatggcactctgaatttgacacgctcttttcagcaatactacgagcatctgctttagctttcctcaaaatgaatagaagttgaattgtgcgattaccaaattgctgatgtacttactggctacttaagaattttttgacacaatactagccacttaagattaggattgaatttaatatcaacctttcgtttcgtgccatgacagtgtgtttctcatttcagaactggcaaatgccgacaaccaatttactggaggtaatgatgatagtgctccatttgactgaaatcaccgcaacaagttattgtctactctcaaccatactaaagtgttcagtacttccagtgtgattataagtgtgtagtagttcgtaaatatagtagggacatattatgtcagctattctttaatttgttccgctcacgttaaatttgctgcctgcacatttggcatagtttgtttgtactactgaatactgagatcaaatattgatattgatgcactacgcctaattcaattcaattaatctagtttgtcccggtcagatgagtttctatctactttatgctggagtacatacgattgaaaatctctctgcagctgcagcgacaacagcacgagaattgcacgaaggaattgttctcaagaatcttaagatggtaaatacacacaagagagaggtacggtatacaagacttagtttttcttaagtacaacagatcttccattcctccatgatcctatcagcttctacacccaaaccacacaaatcaccatgcacgagccctcttcctccactgccaaatcaactgcaaaacaaacaagaacacatgccacattactcttccattttcatgagacaaacaaggtcacaagcacatcatccaccatgtgatggtgcatggccatatctcacctcacctggggcttgagtagccaagcatccatgtggtgatcagtagccgatgtcagcgtcgtcgacgacgaggttgccggtgatgagctcacggtaggcggcgacgggccagatgaaccccctcgggaggagcttgacggcgagctcgacgtcgatgatgatctccctcatggccggcttcttctcgccgctgatggcgatgaggtagctcctgccgacccagccgatccagccggcgatgtagaggaagagcaagcccggggtgatgaactcgccccagtgccgctggtcgccgctgacgatgaggtgcgggaggccgtcggcgccgcagagcaggccgaacttgccgtagttctcgaagcggcgcttcgtcttctcgatggtggcgttgatggcgagcgccggcgcggagtccggcgcgtacttcttgagcgacgactggagcttcttgatggactgcttctcccgcttcgcgaacgccttggactccttgcacggcgtcagcccggcgatgtcggcggcggcggggggcggcgacgtcgccgccgaggagagcagcaccgaggacagcgccagcgccgcggagaacgtcttggccgacgccgccagcgactgcgccatctcgccggcgccgccgttgttgcccgacgcggagcacgacacggagaaccgcgcggccggggacgacggcgcgcgcgccaggcgcggcttggcggcgaaggcggtggatgcggcggcgagggcggccattgctgctgctgctgctatcggcgagagagagtatttgcgatcggagtgggtttgcgggtttgtatcgtgtgggggggggggggggggg

SEQ ID NO: 60436 - DNA, 96046 bp, Oryza sativa
caatataaatatacatggtgattattttttatgaaaaatatggtgacacatttatagcaaatcccatcataatattgagctccagctcttaatagggatggaaagactcggtgtacaagtcgactgcaatacatagacaacaaaatataagacatctcataagttaagctctcgatataacatccgtacatttccccggctttcgcttccgttgaacattatttgttctcctttatctgaaattcagacgaatgcaattatttttatagtttattcataaccaattaaaaatataatggtttgaaaatatttttcatgttgaatcaaccaaatgcatattcttatataaaaaagttttttttgtgtgtccatcaatttttcaaaatattgggttgtctagccgatagatcgactaattgcaattatttagttctcattccgttcgatgcagctgcggcattgttgtcttgctgatccttgagcttctcgaacagcttgcgttgcacgtgctgcttgaatgtgcgcggcgcgaagagcggcttgtcggcgccgtcggcgagcagctccggcaccggctgcagcagcacggactcaggcggcggctcgcagaagacgacccaggagaggcgcacggcgtcgcggctgacgaggccgcggtggagcacgctggtgtaccggccgttggtgaggatctccagggcgtcgccgacgtggacgacgatggtgcccggctcggggcgcgcggtgacccagctcccggcgtggtgcacctgcagccccggcacgccgttgtggaggatgaaggagagcgcgctgacgtcggtgtgtgcctcgacgccgacggcgaggtcaggccgcgggcacctcgggtagtagttgatcttgagctgaaggagcaggtcgtcgtcgacgccggccagctcatgtcctctcaggcggcgttccagcgtctcttccggcaggccgaggccgagggagaggatggcgagcagcttggatgcgagggtccggacgcggccgccgaagtcgcgcgacacggggacgtactccggcgggttcgccggccagagcgagtggtcggcgaggtggtccgggtggacgaggtggaacaggtagtcctcccactccctcttcccgctggcgttggcggcgagcttgctgccgtacccctgcagccgccccgccgccgggtcgttggcgtacgcctccttctccgcgatgggcagcgcgaagaacgcctcgcccgcggcgcgcaggcggccgaggacgtcgcccgggaggccgtggccggcgatgtgtatgacgccccactcctccgccgccgcgcgcaccgcctccacgcacgcgtgcctgccgtcgccgtcgttgtcgaacgcggagatgtcgacgacggggatgcgggcggtggcgtcgtcgtcggacgcggcccgggcgagctccagggcgtcgccgaggtcggcgcgctcctcctccgggcggacgtactccggcgggatggcggagacgccgctgaggctgagggcctccactctcagctccacatccgtcatgtcgccctcccgaagtaggctagtagatgagctgcgtgcgcacgtactcgatcggcggccggtgatggcgaggcaggcagagcgcgggtagatttatactccggcgctgccgccgctttgctccatccatggatcggtgcatgcatgtgttacgtttgtagctaacaacaaccagcggtgtcgggcacgcgcggttagctccatccatcaatcacgtgcgcgttcgtaacattggttgattggtccctgtcaataatgcccctgttgtttcttaattcagatgatacgatccgtatgtataaactcattgcatgctcgttagcctatataaggcataacaagaatttgacttttacaagttagaaatttaaattgtagaacttattttgtagttgaattttttctattgttttctagtttccaaccttaattagcatatatttggacagtgaagaacgaaagtttaaaagtcttaagcaccatttctactatgtgaaactatgattgtgtacgcgcacgagggcatgaacaatataggcccactcctatccaatggcctcaaataacaggtaggcgctgaggcaacacctctaaaaaaaacctacccttttgggcacttctcattttagtcctcgtgcttctaaattttacaagaagatttaaaattttacactactagtaatctgtccgtgctaacgctacggcactataaaatttgtgttaataaattattaaattcatgttaatcaaattaaatttcccaaattctgtccatttgatccatgtcatatatgaaatatatttaagaaaaagtacaaaactatcacattgtctaaaaattaatcaaaaccatcagcaattgtatctactcagaatcatctagcaaatagtagtactaaaaagtctggaaaaactaaaagcttcatatcacgggtttgatttatcatccacagattgccatcctaaaatacaattcaacaaacttatagaatgtacaagggatatgacaaaaaaatatattactaccagagttttttttttgtttgggaatacgcaaggcacgcatatttgtattaagagaaataaagagtatgtacaagcgaagccaaacaagaaaattaggagggggatgcgaaaacaggagaacaataaaaagcttaagcctattctcgcgacatcagaaggaaacgacctagaacaagacctaaatggttagcaccggcagcacctcgtgtgccaaccgccagagagtcgcttccgtcatagctcgggctatctctgaccagggcctttgctgagagttgaagaccctattgttcctctccttccagattgtccacgcagtaagggttgctattgtatcaaatccccgcctgctagccctccccactttaaggcaggaattgtagacccagagataaaaggaatcttcattcaaggggagaaactatggcaaaccagtgctggaaaggaggacccaccaaagctgatgagactccggacaggcaaccaagatgtgatcaatagtctcttcatgttggtcgcagagcacacatccatccgggtgaggcaaacccctagaacacaggcggtccaccgtccaacagcgcctcattgcgaccagccaggcaaagaaccggcatctcgaggggggggagtcttctagatgggttcggagtggaaaggagccctacctagaaagagtgcacgggtatgccgaacgttaagagtagactcccgatgcttcccacttccaaatgaaagagtcggggtggtcagagagccgcaccgacgacctcaggagactccagagttgaagatattgaagaatagcttgcaaacccagcgctccggtgcagtctctaatccatctccggtcttgaagggccttggcgaccgttctgcgacagcgaagccgtgttgggacagacgcccaaaccgccggagatatgtagcgaatggaggaaccctccaaccagttgtcctcccaaaaaaggatggactccccattgcccaaaacacagactgttgaaactaccagagattagatatgcacatctagacaaggagcaacgagatacacaccttcttgccgctgatcaatggtgcttaaacacacagaaatattatagcaacatgtaacaaagatgcacacctaaaaacattgctcgtacttgccggctcgtcagccgtcagatggttaggaaccaaaatcaatattaaccagtattgtggccactcaaaccgttggattagaagggtcaccacgtttgcatccatgacagctgacaccctccaatgaagtttccccttgatgcaatcgaccaccgcaagcaagatacggagatatagacttgtccaacaccactgtgtcatcctcatctctcacctgtactaatccgctcttcatcctgctaccatcacaaaaggtggctgctataaaaataaattaaacagagtgtgagctacaaaagaatccttcgtaatagcatccgaagaacattcatctctagaactgtcacaagtaaacctccatagagcattttttgaagtgttggggctattgcataaaagtaagggtacacttacaaatttaatcgtaccttcaaaaggtcatgatcattccatggccctctgttagaaacttagaaccaaggcaacaccatgactgcatgcacatggaccacgaatgaactatggcaatttactgctaaagaacaatatgttttcacgaaattggtaagctaaatagatattgttgtataaatacgtgcaggctaagcgtttcaataaaggttgccaggcacagctagtaagtatgcacgtggaatccatgtggcataatatttgtgataaatagattaccctaaatcaagtcactcaaatttcgtaaaaaaacgttaagtggtctctctgggtgaagcaaactgaaattcatgcaacttcagagtcaagccacatttatatttcatctttcagtcttgtacatacatgttactaaaagcacttttgccaaaacttgcaagtgaacttcagaattaatgcataagtacataccaattcatgctacacagcaaatggctataattaaatctatgcaaattgatctcactatgtgtgtggggtcctcctgattggcatttcatcaagcaggatgccggagagggtacctgcataccagggcgtgctggaagtgggtggttgtgttgtcccatagtggacttggaactggaggggggcgcaggtgatggtccccagattcctgggttggcgacgtgtttttctctctcagtttgcagttgttcttcagtaacagagttgggagaatggagtggtcgagctgtgaattccacgaaaccagaggttcaagatttggcctgcacagaaggattcatctcatcacaatgcaaattgagagaaaaagaaacatcacaacagattacctgttcacgcaaagatctgatgtttgccatgtttaggcggaaggcataactggcttcgtcaacagaatggacacggtgggcttggagtgcggctgtggaggtctcgacgcttccacctgtgtggaggtggtccgcaacagtttcaggcgatcgatcttattattttatctgccgatgcaactggagagaaggtgatacagcttcagctcgccgatctccttatcccttctatatgagagacagctaacgagcgaggagatatcagacatatatagaagtgagaatcacaattagctttcagaatagtaaatccacatgcacatatgcataaaaaaagactctacattaagctgcattgccatcgttgatagcaatatagggctgttctccttataagtcgtcacgacagtaaaatagcaaaaaaaaaaaaaaacagattaattcctgtgcaatttgatgtggcaatgaaatatagaccatgaatctggttactgactgatcaaagccccctatcataattgaccatgataaagagcgtaatgggtgtaccttcaatttagggaaggaggttgtgtgggtgcgaagcagctgttcacggtgatgtgggaacagataatcggtggcggcaccgtagtctgtgatgacggcgaggttcccccttgacagcagtcctatactgaaacaaataattgagcactcaaccattccagagtactacctgatgtagatcagaacagctagggatatttgttggctgccgcggaggagattggcgaggcagtcgtacggacgcggaaggcggcggcgatgaggattagggcagggagcgcgacgtcagggcgtggacgccggggtggcggggtgcgggcggcattggcggatgccgtcggatgtaaatcatcatatcattctcgatcgttggatgtgtcacatgatgaatgagtaaaaacatttattgaacttatagggtagaaacatgctaaaaatatacaaactaatataaaatctctttttctctcctctccccactatccacgtgactgttcccctctcctctcaccactgagctcactcgacggcaacaaatgcatcctcttcacggtgatcacaagcttgcgttgtctcccctccacctccatttccactcgacggtgaccatgagctccccgctgttattgaattgctactaccgcttgtccactttggtagatatcgctgccttttatttctcactcactatctctttatagtgccaaggacaccatagacaggtcaagaaggccatgcttgtggttgagaccttagtagtggttgagtcctcgcttcagatccaatagtgattgcggaggccattgcagcttcagctcagtcacccccacgcctcagatctacttgtttcccttgcaaattggtcaagcaatggcaatagctcgtttgaggacaccgccaccctccccccttgccctcttctcatttgtcggccatcaccgtgctccgtagtggtgcaggccaaggtggcgtgggctggcgcaaacaaatcgagacggctttggtaaaggggccgagacagcgagtgcagatccaatggcgggccgggcctgggtggcatgtgcaaatccggttacgaggacagcggattgaatgagaaactcctagcgacggataaggggaagggcgagatagatgggaacctatcgcaaagatatgacttcgctaacacaaggctccaagcatgccttcgtggttccctggatagggcaagccgagctcatcgtgccatgcacaaggcacaaatgacctcatgtgcccacccgaccccaccctctcttttctccatatcgatcagcatatggcgtcgtgtggccagatgtcattgtgttgttcataacatgagtaaatccatagacgagaagctcatttctgtccatagtactttaaaatatagtgatggtaacagcgaatctgttgccatacctattttcattgtaattttaaaaattacccttgaacttagtattaaactcaataaaatctcaatggatagccatatataaaatcaaatgaaggtcataataaaacacatttcaaataatatatatttatataacatagcaaattacgggcattaaggtagttaaactttacttatattactccctccatctcaaaatacttgttgttttgactttttgttcgtaacgtttgaccattggacttattcaaaacattgtggaattattatttgttttgtttgtgacttgctttattatcaaaagtactttaagtatgacttatctttttttatatttgcactaaatttttaaaggaaaaagtacgaataaccctcttgaactatcgccatcgaccgaattatcctcctaaacccaaaaaccagacattgcttaccctgaactttcaataccggacgaattaacccccttgacccaatccagagtggttttgtcctacgtgacgtacgcgtggcaatccagtcagcattttatttattaaaaaatatgggacccacctgtcatacccctcttcctctctctctcctctctcttctctctttcacggggcagtgtgcaggggcagggaggtatgcggcggcatagggacggatagtgggcgggggcgggcggtcacgcatgggatggggaaggtagacggaagaaggagggggagtggaggtggatgggaaatgggaggagatggaggtggaaggggtggttggtgcacacggcggtggccgtggtgggcgaggcggcgtgtggcggagacgcggacagtggctggaggcagtagcgaggtgggactttggcggagaggcaggcagtggccacctcgtctccctttcgatctccctcccctcccacccacgtggacaacagcagcccggctgctccccgcgccgccgccgccaacgtgttgtcgtcacccagcaagccagacccgtaggcgcgtaggggaggcggtgacacgcccaaggccgtcatcgtggtcacctccgctgccgccgccgccgtggtcctcgcactgctcaccatcgcggccgcgttcctcctcacaggccgtatgcgccgaccgccagcccgcccccgtgcaacgttgcccgccttcgccttcgttgccagcgccaccagtgttggtatttcttaacgacattactagaaatataaattcccagcaatgacgctagaaatgatcctggtttaaagaaagaatccgcaaacgcacggatatactattgtagcatttcacccgaagtattccaaggtatcgtattaatttatttaatcctaagggaagattgtaatagagaactatgctaataatgtatacatgccacttgtataatcaaagtctaggcaggggttaagatatggcaaacgggtagagtgacacgaagcaaagcactcatatatctcatttaatcattcctaaactaagtggaagaagaaatagaagaacgatcaattcctataattctaatatacactcaactttagtttacacctgctagtatacaaccatatagccagtaccctctaacagtgacctcctagtgcttcgagagaccactccaggttgccgagtttcttacgataacctgtcatggccgttcaatcggggctaaatacgaaggagtaccctcctaggaaagtttcttaggaatatatactatcttggaggaatacctgtactgagctgtcaccatcagcgacccacctcaactgacccgtagcatatgtgcctacttcataatctagacaccacgtctacattattaaatactactctacatcccccgagatgacatatagtaaccgagtaaacgggcattaaacacacaccactacacctctctggtaggctaattatacgactgtaccgatacagatataaagtaaagacaacacttggatgtattaaaatatcgaaagtatataaagaataatatttcattaattccaaaagtcttacaaaagaaagaaggaaaactactaaagccataccgaaattcctccgaagagtccgaggactccgagagcaattctattctactccacttagcactagaatactaaactaaagtgtagaagagatatcttgagcttgctcgagtgtgtggaagaacgaatgaagtgaccccttcatatagccttggaatgacggttaaaacggttggaattgttggatttaccctgcaaccaccattgagaagtcatcacaagcgtacacgtggaggcccaggctgatccggcgctgccagggttcggcacctaggtaggctcagtaggcctccacacttcctaggtcactgacaggtgggtccctatgacggttgcgacagttatgacagtttccgagacggttacacctgacatgtgagcccatcttatccttaagcttgcttaagggtgagttttcttcatttcttctccattttatttgctcaatcgctgcaatcaaataaaatccaagtacaagtggaaatagattattctaaaataaatatgcattgcaagcatagctagttctcctttattttagttatattgacggtcgaaattgatctataacgaccgtcaacaaccagcgacctccacctccgccgccagccgcccgagcaacctccatcgacgccgtccgtggccatcctcagtgccaccgtgctggtgaggggagggagaagagagagagagatggggaatagagagagatagagaggggtggggaactgaaaggtgggtcccaccaattttttattaaaagaattgttgagtgcactgccatgtggaaccaaaccaccatggattgagtcagagagttagttgtctgattttgagtcgaggagttagttgtccgatttatatagttggaggtgaagaatgtccgattttgtggttcagggggcaatttggtcgaccacgatagttcggggaggtaattcatacttttttttaaataagataaatggtcaaatgtaaaaagaaaaaagtcaaaatgacatctaattttggacggaaactgtaattgtttgtccaagattcaaagaagcaggtcaaagccgaaagctgccatgctgattttgcagcgagccagcaagccgcggttcgtacactatgctccgacagcgtttgattgattttgtcaaaactgaattaccaccggccgatctttttctgaattgacatgctagaatccataccagtattaaagtcggctcggccaatcgatcccggagcaaataacttgctttaaatcgtcggccgttaattgtcccaatctggagtttctcttgtagagttcaagggaaaaagtacgaaagactagattggctaaacaacccttatactattatagtagtagcaatattttgaaacataattaacacttaaagtagctatatttaggagggagtatctatcaagtagcttgcacattcgtagaaaatgtagcggttatgacttcaaacctgcaaaaccacgttttgtaacaattaacgagtacaaatagatcttgctttgaacaaaacttctaaaatgttcaactatcgcaaaaatgagtaaattggtcgttcatatgctgtagtggcaaataactaaatacatggtgagcatctattacaaccaagctgacacgaaatatatcagtgcacatttgtagacctgaaattgaggagctaacaggacagcgagaagaactttagaatccagctttctctggttattttagagatcagccctccctgggtatctagggaaggggatgacatctctgatgttctccaaaccagtggcaaaaagaatcattctttcaaaacccaaaccaaaaccactgtgcttgacagatccaaagcggcggaggtccaagtaccattcatatggctccaaaggcaacccggcgtcttgtatcctgtgaagcaaaattgccatgtcattgactgagtatatacattttacggaaaacatgactgataagtttaacagaatcaggggaggaacataaacacgtaatattgtaagatttttagatttttagcatgttcagcatcatccactggatgcatagcttccaaagaaatgatgacatattgaatagaatatatgaggaacaatcagtgcaagattttttgcatgctcaacatcagccttgactaggtacatcagcaacaagccaggaaggatgatataatagggaataatgatgggatgatacatatgtaataatggttaagactgttaccatgtgcaatatctacccattttactatttgattaagcagagagaataccaaaagcatggaacaatagctatcgtactaaagattccaaaatatcttctgcttgaagttgagcatcgcataccttgttttgagaaggtccagacgttcctccctttggcttccaccaaccaactcaccaacctttggaagatattccagcaaataagttagggatcatactatgacaggtcgataatgacaaaatttctgttcatgtaacacattcacatgcttacacctaactcaaaatttatgttcatgcaacatatttacatgcttacacggttacacctaacctcaaattttctgttcatgcaacatatttacatgattacacctaacctcaaaatttatgttcatgcaacacatttacatgcttacacctaacctatattggaactaactagaagtctgaaatatttatatttaccttgggcacaagaacatccatagcagctacagtcttctgatcatcattgagtctcatataaaatgcctttatttctttgggatagttataaacaatcaccggcttcttaaatatcacctcggttaaataccttaaacaatgtaagaagagagataaaaatgtaaacaaagcacagtaagtcatcggaagataaaatattaaattccaatatagatacctttcatgctctgaagctaaatcaattccccattcaaccttgttttcgaatttcttatcagtgacatttttcaatagctcaacagcttttgtatatgaaatgcgctgaaaaggtgtcgaggaaacaagctccagacgctcaattgcagtcttatcgtaatttttcaccatgaattccatgtcttcccggcaatgctcaagaagccacttgcaaaggtactgtacatatctttctgcacagttcatatcatcctggaacacagttcgccaaaatatcatgaaataacaattcatacagaatcttagaaccaatagtagatagattaataagctaagatgaaatatttcaaatgctgcaaaggaaaatatgatctggattatttacctgcaagttagcaaatgcgatttctggttcaaccatccaaaactctgccaaatgtcgtgatgtatgggagttttctgcacggaatgttggtccaaaggtataaacactgctaagagcacatgcataggtctcaacttgaagctgtccagacacagtcagaaaagcctggcgtttgaagaagtcattctcataagctactgtcccatcatctctgtacggaattccgggcttcaacttagatctttcctccagccttgagacattttcttttgccttgttaagctcagcaacagcagctgtgatttcttgtttgctagcttttgcagctttaagctgtgcaaccgcatcacctttttccttgacaacaactctagctgcctcaatatcagactctgatggtgcagggttctctttcaattccttctccaccttttcagcatggctgaacaaagtcgtcacttgaaacatctcaccagcaccctcacaatcacttgtagttattattggtgtgtgcacataaagaaaaccattctcatcaaaaaacctgtgtgttgcacaggctagctggtgtctaatacgcgcaacagcaccaatctgcaaaataaaataagggattgcagagtttgttatgtaaaatattccatctcatgagttatgaacagagaaaaaactgaaacaaagtacatattccattaatttctatatattgcaaaacctagaattgcagttcaatacagagttgcggcaatccaaatggcaaagataccaaattcatcaaccaaaccttttaaggaaatcaaaatttaaaaaaaacaaatcagaaatgattgcattgtaatcaagctcagcttaagataaaatattatgggaatcaaatagcacatataaaggtttagacttaacatgccatattctaattgtggatgcctgaactcaattgggagttaatcatccatagccttacatgaccctctcagcatgtgtactttcaagaatagcaaagttagcagaagaggggactaggcactaaacaccggaaactgccagatccataaaactttaaattaaccaagtgtttgatttgtgtaaaattcgcagtccacacaactcataatccagttcaaaataaacccatccttcaaaatgtatccacatcaatttgatctaatgcaataggtaaaatcgcaataaaagtagataaaactgtgtgggattgttaaccaatccactagacaacctaaattttcacaccaggaaatagactagaaaaccaaaattttcacaccagggaactagacatcctaaatcatcacggcaggatttatcaaaactagtgcggaagttgcaaaatctagaaatttctgtagtctacttcagaaagggcttcagttttcgtggtgtgaggcgaaacagacggaccgtgttggtgcgggagcggagatggacgacgtccctgagattctcgagcgtgagcttggtcttgggcagcgggtaggcggcggggtcgacctcgccgacctcgatgacgcggtcgacgcggagctcgacgcgctgcttggcgccctccggcggcttcttgagctcgccctcgacgagcacggacgtgcccgtggcggtgagcggcgcgagcgggtggacggcggcgtcgacgaggacctgcaggttggaggcgcaggagccatcgttgagctcgaggaaggcgaaggtgcctttcccctgctcccgcccggtcttgacccacccgcccacgacgacgcgctcgccggcgcgcgcggcgccgtcggccaggatggatcggatgcgggtgcggtcggtggcgggctccaggtcgtcggagagggaggccgcggccatggcggccgccgcggcgtcttcggccatgggggaggggagggtttgggaggaggcggcggcggcggcggaggaggagaggagtggtgtcgggtcgggtgggaattgggatttttagggtttagtagtaggtttgttgccacttggcagtttggaatggtggagaggtggagaatgtagcgcgcgtcgtgtggtggactggggggtggtgtagctatagcgggcccgccggccggcccattgattcgtttcatctggaatcggtgtacgagaaggcatctggaatcgggccacaccgccccatttgaggttggagggagaaaaaaccagcaatgaagaaaaggaaaaagtacatcgaaggtccctcaacttgtcatcaagttacaaaatcgtccttaaacagcaaaaccggatacaacacatactccaacttataaaaagtgcaaactaagttccattaatagttttgactccggttttatccgacgtggcagctgactcaatgtgggacccacgtgggccccatacatcagggtgaccacgtcaccatctctttcccctcttctttcccttcctcctctctctctcccaattttctcatgcgggctggctggtgcggcgggggaagagctgcgcgcgggcggcgagcgacggaggaggagcggcgggggagcagcttggaggccggcgacgggccgcggggtggacgcatgcgctgcggcggttggctcagagtagaacaggaattggtaggcgcggtcgccgtagtacttctccagggactgcacggcgaccttccccgccatctggccttcttcgagacctcattcttctcgggcttcccgtccacctccatggtgacgggccgcgccgcctcttcaggcttctcgatctccatcgccgcgccgggattgctgctgcttgtctcaggcttggcattgctcctgctcttggttttggttttggagagcacggcagagacaaaatccatgcgcagattggcatcctcttccactgttttgtttggtaggcaagcaagcaaattacaatccattcctggttcctctccttaaaaaccaaaccaagcgggcctatgtttactgaagattagtctttaacaggggcctatgtcaattccttgccgtcatcaaacagacagacaaacaaacaacacgatgatgatgagttctgtcttgacggctgcttccttccaatctcctcgcaatttcatcaaactacaagtacagctaaggcctcagcagcgacgcctgcaacaccaacaacagcttctgattgttggcagcaacggggcaataacaataggaaacatgagtttgtgccgggattgctgctgcttgtctcaggcttggccttgctcctgctcttggtcttgattctggagagcacggcagagacaaaatccaagagcagcggcttggccggcgccatggcgtcgatgatgctgccgccactgcgagagatggcgtggcctcggctgcgtttccggctaatccgtcgcagctaagaagctcgccgacggctgccacggggcgcttccacctctgcgcccatcgccgtagcgccggcctgcgcccaacccactgccgctgcgtcgccacgccaccccgccgcccgtcgccggccacccagctgctcccccgcccgcgccgctcttccgccaccgcaccggccggcccgcatgagaaaactgagaaagagagagagaggaagggagagaaaagaggaagagatgatgacgtggtcaccctgacgtgtggggcccacgtgggtcccacgctgagtcagctgccacattagataaaaccggagtcgaaaccgctgagggacctagtttacactggtattgtaagttgagagacaccggatatctggttttgctgtttagggatgattttgtaacttgatgacaagttgagggaccttcagtgtaaaactaataatatagccgactgatgggtctaaaaatattcatattagcatttaattaactaataactgtggtatgtatataataagagagctatttgtgtgtcccttcttaatgtttttattctaatttttcttcttttgaagctttcccgtccactcatttatcttgagaagtgagcagccattgtgagtttaacagaaactagtcatgcgccgctagtgttgcattggagcttgtgtggagccggcgactaattagtcgaccgctcacactctctttctactcatttcttccctaactctgtactttattcagtttggactcagtatagccagcaaaaattacctattactagaaaggcttcgcgcgctatgtggcgcggccactaaattacgggaaacagaagaatgtaagattagagaagcaattcttttagggactgcctatacattatgcgatagattttctagcctcctatcatgcaaatttttcaagccataggataaatttaatctcatctatttaaatttagggagtaactattaaaaaaaaagtttgcatgtatttacattgtaagttccaaattacatatgtaattttagtgtatttatgatgtaagtcataaaattacatatgtaattttagtatatttatgatgtaagtcacaaaattacatatgtaattataatgtaagcacgatgtaattagtaagcgtggatcataagcaaagtagcagtagaaaacactgctcaaatgcaaggaagaaaaacaggcgtgtgtttcgaaattgaacggtaaatatgtgagaccaaaaaaacgcaacaacaaagtccacagaacgcaacaacaaaagctcggtccatctcaaagtccacagccgtgcatgactttgctcaatccaaatgcagcacgaattgtaaacagagatgaatggccaaaaaagtgaaagatttagcaccctattttctgtcaacagagcactagcgattccgatatcaaaatatggttattttgccgctggacaccatacacattaattaaaatattaatttccggttgaatatgagagataaatagcgtgaaaaggtcaaaaatgccccctgggcacacttatcatattctttctcttcctccttatttccccttctaccggcagccccctccttgcaccgcctctggtgtgccatctcgttgatgtcactagcttcctccccgcgccaggcgctccacaccggcaaactcctctgaaacctcctcacccatgtagatctcgagttgccgctagggaaccatctccataggctattttcctgtcgtcgcacgcggcccttcacttcttgcacaaccgtcgccgttgttcctcccatggatttggagggagagccatagctttgccccctgctctgctccacccaagggtggtccacctcaccgccggctactaggtcccctcgtccacccccaatgactccgtgtcaaccaccttcatgtagacgaccggccatatcttgccaagctccgtccgttgttcactctaccttcttctctaggatggaggtcatcgagcgcccgacgcctagcacttgttccctcgagcgtctacaccatcgggagccttcgtctccaccaaggccattgggaggcttcgtttgaagtggggtgtttgcagaaaggggaaataaggagcaagaggaaagaatatgacaagtgggcctagggatattgaaagtgcatctaggcccctaatgattttgatgattgattacaatgcgattagagaggactaacacttttattcaagcaaatgtgaaggttgttatgtcctcgacatgttgtaatgagatgcataccccatgaatgcgacatcacgatgcaatgcggcagtgatcaaatggcatattatatcttttaccttgcattgtgtcataggaatgccgtactattaagagggataccacatgcatataattggtagaacactagtgctcaaaatgcttcatctttgtgtgagttgaaaaacctaagccaaaatttcaatcccgagttgtttcacttgtcacaacacttacaccgggtttctttgcaagtttttcaacatctcttgaaggttttggaccatgttttatgttgggtttgatagcccacgaaactagctttccataaagtccaagatcttcgaaatcggagttcggagtaaaaagttattgcagttttacttgagcaacatcagactatctgatttgaaatcagactatccgatttttcacataacttcactctctgtctttgtttggaaaatcctttcgagtgagtttttctatgtgtcggtgtatccgatgttggatcagatgtccgatgatacagagactccgaaatttcatggaacttgagtctctgtttgaggacgaagtttttgcttcaaaaatatcagatactccgatttaacatcagatagtccgatgtctcggaaagtccgaaatttcatggaacttcgttgtctgtttctcgttgcgttggaggtttaaaatatcggactatccaatcttgtatcggactatccgacatgggctgaaagattcccctccaacggtcactttttgggggatccataaataccccccacctaaccctttttctagggttacccaactcatttcattctcattcattttgggttgagcttggtgctaaggtgctttggatctttgagctctttctccctctctcaaatccctcctcgttctttgtgtggtggatcttggtggttgtagatttggtgtttgagggcctagtgtgtgtttcactcgatcttgagcactagggtttgaccaagagttgtgtggtgtcttttactcttggaggttgaggactcctaaacggctaggtgtcactcccgagccaccgatctacgtgtggttggccgggagaagtttgtgaaggccggatctcgcctccgcaaggaaagagataccccttagtggaaggaggagtgcttagtgtaacctcttgaggaaagggttagcaaagacccggctcttagtgagcgtctcaacggagagtagaatcccctcaagaatttgaactccaggaacaacttcgtgaacttcatcattggtgatctcccttcatcctccttttagctttgcttaattgtgccgctatagatctagtcactgtttgtgctttactcttgtttgtatgatagatctacttgttgtgcttcattggtggatcagacagtctgatccaacatcagactatctgatattttcggatagtctgactgtggatcagactttccaatcttatttcagttttagcttccgcataaagttttaaattagcctattcactccccctctaggcctaattgaccctttcagacatttttatattttcatgttgtttttctctcctattcaatcggaatttaatattttaatacatgcggtgtccagcagcaattaaacatattttgagagtgtcttcccaaaatatcaacttttgccgtgtccgggagctaaaaccacgaagtcacggtgtcctacaacaaaatttgtcacattgggccggtacgttgaggtggatatttttgtctggtttgaatagttgagggatgtattttatctggtttcgtagtttagcgaggcaaatcacactttggtgatagtttgggtaaattcgacataataataataataataaataattcatattgagagtttttccctttgcgaatttccgtgaagtgaaaaaaaaattagcacataaaagaaagttgaaatttaaacaacaatatgcacaaaggcgctgcacctatgctgtgaacaaaataatatgtccaacaactttatcaaatactagaataatttatcatgaacacttaagacttaacatgattaattaatttgagatctatagtggcccagcatgagaccgaggttttatggcccacttttagataatcatttctaatgggacacctaaaacattattgatatttttgaacaagtttcaatatgatctccatggtgaagcatctaggcccccgttgttaattttggtaattaatgacaagcactaattgtggactaaccgttgctattgagatatattttaagttaggtccacgtcatgtgtgcgcatggatgactatcgatggattaaaatttgatggcgcgaagcgaagaaaagaaaacggtaaaactagtgttttaattttaaaattgatcgaggtgaagggcgatcaaatttgctagtttatttgttagtttcgccgtactatcaagggggtaatgatctagcaaagagatgattaaattgccacattaggtcattgcattttcacttgtgctcacattttcatcacacacacacacacaaacactttacctttcactgggctcggcatgaccaggggcagtcagaccggccacattgtggcggtctgaccggcgtgccttggccggtctgaccggcgccacaacggcggtctgaccggagcataaggccagtctgaccgacggcacatgcacggtcaaaccggccccctggaggccgggatggtgttgctcgaggtggctgatacagagccgacggagccgtattcggtcagatcgagccgaggccggtcggctcggtctgaccggccaggccgatggggccctctgacagcgctacaacggctagttttctagccgtttgtcgcaaccgagaaaatttgcattttcccgaacgctagtgtattaatccccgtcccaggaaaagccggggtacaccacacaaacatgatataaaagacacatctttattatatcgataatatttaccttattacaaatgcacttcaggcctgacaataacaaataaacagcagcggactagcgggcctatggctccatcttcacaggcgctcaactagggtataagccaggactctacctaagacatctcctccaaagcttctcttactgaagaggggaaagatagagcaagaatgaatacaaccacagtactcagcaagccacaccgggagatgcatgattaatgcaagggagtacaaggggtaataatataggggttaagttttgcagtaaacagcatttaaaagtcacttagttgcccaaagctattttataaagacgatcctagagctatatagtattattaatcaaggccgtgaacccgcacgaacctgccttaacccaaggcctacgatgattcagaccgaactggcaacccaacctgggtcccagctcgtcccaagccaacacaggccaaccattccacattttagttgttaagcaagttttaggaattaaaccactaacttgggtacattgctaggcttgcccataaccgagggcgcggctattcgaatagattatactctgataagaggtgtacatctttacccacaagacacatctttactcagcattccacggccgtggaacccgtcgtaaaggatgtgacataacccctttacccatcctagccgtgacaaaagcaccgacccaacctcgcctatggccggaatcccgagacaggtaggtaagattgagcccctagcagcaggacaccggccctgtgccatgacatctcgactaccgagccgcagcccgtgtagccttcatttggcctcgagatgtccatcgagccccgacttcatccatctccatccgtgtactcttgctaggactagactgagcaccgagttaagccttacccattagacatgtggttagtacggtagtgctttgcaacagaggctcgaagactggtccttatagtggccgaggtgctactagcagaaccatgcacctcgtgcccagcctaaaaccattttgggagttttgaatagagggggggggaggtgtgtgttcaattccatcacaagccaaccattccacagtgtccaaatgatatgagaactcccaaagtctaaagttataaaaccacctagtgttgcctaattaatcagcgaagcatctacctaaattcatactagtggaaccgttaatagagtacccactagttggggttttgtttatcctaaggtgaacaaggtaagaataacaatagcaataataataaggtcataacaaaggtaaataggcgtggctaaataaaacagtgataacgcgggaatttaagtaaagcagtaatgcaataatttaaatcaaaataattttataaactgagattcaatatgctcaagggtgatgcgacttgccttgctcagagagaacggccttccgaaccttcggcgacgaccacaaagtacgctttggaaacctccggaacgacagaagctacgcgaagcacataagcaaagctacaagcctaaaaagaagcaataacaatacataaaaagaaagcacatgattctttaggttataacaaacattaagagacttgaacgggtcgattcggggttcgtatgatcaagatatgatcatccgaagtttaatgttgttatatgaagatttacggattattatgattaggttttgcaactataaaacatgtgcaagcgctagcctggaaaagacaggaaggctgcgctgttgacatgcggaccccacatgtcaacctaagggaccacggtagaccgagtacacagagacagtctacgggtcgacggaagcggaccccgtgtgtcaaccgaggcgagtggccaacaaacggactccactagacaccacgcgggctgcacatgtaaaaaccacgtggctatcgagcgggcacactaacacggtcaccacacgcacacatgaacgactaccgacactggtacatgggtaccggggtcgacaaccacacgacgggcatggggcgacaccgaaaggacgaggacggggcagcgagaggacggatccttaccaccacgcgacgaggcgtgggaacgacaacgacgaacgggcgcggcggagacggctcggggacgatggaggcgaccggcgagggaacgacgtcggcggtgatccttggacgaaggcgagacacggccggcgcaacacttgacgacgcggagccgaggacgaagatgacgacggggctgcagcaaccttgacaaaacgctggtgaagcatctaggcccccggtgttaattttggtaattaatgacaagcactaattatggactaaccgttgtctttgagctatacattttaagttaggtccacgtcatatgtgcgcatggatgattatcgatggattaaaattgacggcgcaaagcaaagggaaagaagacggtaaaactagcactttaatttagaattgatcgaggtgtagggcgatcaaatttgctagtttaattttagtttcgccgtactattaagagatatgtgcgcatggatgattatcgatggattaaaattgacggtgcaaagcaaagggaaagaagacggtaaaactagcgctttaatttagaattgatcgaggtgtagggtgatcaaatttgctagtttaattttagtttcgccgtactattaagaggggtaatgacctagcaaagagatgattttaattgccacattaggtcattgcattttcatttgtgctctctttttcattacacacacattcacttgcaaattcactgggttcggcctgaccaggggcggtcagaccggccacatagtggcggtctgaccggcttgccctggccggtctgaccggccccgcgagcggtctgaccagcggcactttcccggtcagactggccccctagaggctgagatgatgctgctcgggatggccgatacagagccgacagagccgtagtcggtcagaccgagctgatggcggtctgaccgagctgaggccggtctgaccggccaccccatgtcggtctaaccggttaggccgatggggccctctgacagcacttcaatggctagttttctagccgttgcagagtagcacggtctgaccggccacataccttcggtcagaccggcagagcacaaagttgggggatttcgccaccaacggctagttttggtgggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtatggcacttgatcatctccacaccgggtcattgcttgttactcttggaggttgccgcctcctagacggcttgtggaggagttgcccagtgacctctccgagaagattgtggaggaggcccggcgccggtttgtgagtggtttggagttcaccaccttcgaagtgaagaaagaactaccccgagtgatcgaggcttgggtagtcctctccgtgggccggctcccgccttgcccaccccttgacgaagggggcgtgcggtggcttcgtggttgagtggtggagttgggctcgcctcaacggggagtaagaaaccggcgagtttccgaacctcggtgaaaagtctcttgtctcattgtctcatttgattgtcgcatttacatttgtgcaaatttactttcctagagatatagttgagccactatcaccctaggtttgcaaaacataacttagttgcttagttagagttcaccctcaccaagcctagcaacttaggttagatttgattaggtgttatttaatttttaaatcgcctattcaccccccctctagtcgacatctcgatcttacaagtggtatcagagcttggtctctcttgattgggcttcaccacctagagagaagatgtcgaacgaggtgaaccatgtagggaaggctcccatgtttaatggcacaaactactccacttggaaaattaaaatgtctactcacctaaaagctatgagcttccatatttggagtattgtggatgtaggctttgctatcaccgacacacccttgacggagattgatcaccgcaaccttcaactcaatgcccaagccatgaatgccttgttcaactctttgagccaagaggagttcaatagagtgagcaaccttgagaccgcatatgagatttggaacaagttggcggagatccatgagggtacaagtgagtacaaggataccaagcttcatttcctcaagatccaatatgagacattctccatgttgcctcatgagagtgtgaatgacatgtatgggaggcttaatgtcattgtgaatgatctcaaggggcttggggcaaactacaccgatcttgaggttgcccaaaagatgcttagagccctaccggagaagtatgagacccttgtcaccatgctcatcaactgcgacatgtcaagaatgacacccgcaagcctcttggggaagatcaacaccaatgacatgtacaagttgaagaagaaggagatggaggaagcctcaccctccaagaagtgcattgctctccaagccgaagttgaagacaagagcaagagcaaggtgaatgaagtcaatgaggacttggaggaagagatggtccttcttgctagaaagttcaatgatctcttgggaaggagaatggagagaggaagggactccaactcaaataggagaagaaatagaagacccaacaagactctctccaacttgaggtgttttgagtgtggtgagaagggacactttgcttccaagtgcccttccaaggatgatgatggagacaagtcatccaagaagaagagtggaggctacaagctcatgaagaagcttaagaaggaagggaagaagatcgaggctttcatcggggaatgggactcaaatgaggagagctccacctcatccgggtccgaggaagaaggtggtgatgatgcaagctccaagaagaagaagatggccgttgttgccatcaaggaggctccatcactcttcgctccactttgtctcatggcaaagagctcctctaaggtaacatctcttagtgatagtgagagtgatgatgattgtgatgatgtttcctatgatgaacttgtgagtatatttgaggagcttcatgcttatagtgaaaaggagattgtcaagttcaaggccctaaagaaggatcatgcttctttagaggtcttgtatgaggagctaaagacctctcatgagagactcaccatttctcatgagaagcttaaggaagctcatgacaacctcctttccactactcaacatggagctctcattgatgttagcatatcttgtgatttgcttgatgatagtgctacttgccatattgcttatgttgcatcatctagcatttctaccttttgtgatgatcttgtggatatgcctaactctagctctagctcttgtatttctatttgtgatgcctcacttgttgttgagaacaatgagcttaaggagcaagtggccaagctcaacaagagtttggagaggtgcttcaagggtaagaacactcttgacaaaattttgagtgagcaacggtgcatccttaacaaggagggacttggattcattccaaataagggtaagaaaccttctcaccgtgccactcgttttgtcaagagcaatggtaagtattgctccaagtgccgtgaggttgggcatttggtgaatggttgccccggtggtaagccttctaagacatgcatgtttgattctcattatatgcttaggaaggctcatgatggtagcattgttgctagatatgtgggttctcctatactcggtggtaaaaagaatgccatttgggtgcccaaagttttggtctctaacctccaaggacccaaacaagtttgggtacctaaaagagcttgatcttctcttgtaggtgaactaccgcaccgatggaagccattgggtgcttgatagtggatgcactcaacatatgactggtgatagggctatgttcaccacatttgaagtaggagggaaagaacaagagaaagtgacttttggagacaatagcaaaggaaaggtaattgggttaggtaaaattgctatctccaatgatttgtcaattgataatgtctctcttgttaaatctctaaatttcaatttgctttcggttgctcaaatttgtgatcttggcttgtcatgtgctttcttcccgcaagaggttattgtttctagccttcttgacaagtcttgtgtgttcaaaggttttagatatggaaatctttatttggttgatgtcaattcagtgaagcaaatttgaaaacttgtttagttgcaaaaacttcattgggttggctttggcataggaggctagcccatgttggcatgaatcaattgagcaaactttcaaaacgtgatctagttgtggtcttgaaagatgtgaagtttgagaaagataagctttgtagtgcttgtcaagccggcaagcaagttgcatgttctcatcctactaaaagtatcatatctacatctagaccattggagctcttgcatatgattttgtttggcccaccaacctataagagcattggtggtaatagtcattggcttgtgattgttgatgattattctcgctatacttgggagttctttttgcatgataagtctattgttgccgagcttttcaaaaagtttgcaaaaagggcccaaaatgaatttagttgcactcttgtgaaaattagaagtgacaatggttccgagtttaagaataccaatatcgaggactattgtgatgatcttggtattaaacacgaactttccgctacctactcacctcaacaaaatggtgtagtggagagaaaaaatcgtacattgattgagatggcaaggactatgcttaatgaatatggtgtttccgattccttttgggcggaagccataaacatcgcttgccatgcaaccaataggctttatttgcatcgtctcttgaaaaagacttcctgtgagctaattgttgggaggaagcctaatgttgcctattttcgagtttttggttgcaagtgttatatttatcgaaagagtgttagactaaccaaatttgaaagtcggtgtgataaagggtttcttctaggttatgcctcaaatagcaaggcataccgggtctacaacaagaacaaaggtattgtgtaagaaaccgccgatgttcaatttgatgagactaatggctcctaagaagggcacgagaatttggatgatgtaggtgatgaaggcttgatgagagctatgaagaacatgtcaataggagatgtcaagcctattgaagtggaagacaaaccatccacctccactcaagatgagccatctacttccgctacgccaagtcaagctcaagttgaagtggaggaggagaaggcacaagatccacctatgccaccaaggatacacaccgctctttccaaggatcacccaattgaccaagtgttgggtgacattagtaagggtgttcaaactcgatctcgtgtcgcttcgatttgtgaacattacttgtttgtttcttgtcttgagccaaaacatgtagatgaagctctttgtgatccggattggatgaatgccatgcatgaagagctcaacaactttgcaagaaacaaggtgtggactttggttgatagacctagagaccacaatgtcattgggacaaagtgggtctttaggatcaaacaagatgagaacgggttggtggtgagaaacaaagcaaggttggtggcacaaggtttcacacaattgaaggtttggactttggtgaaacttttgcccctgtggcaagacttgaggctattcgcatccttcttacatttgcatcatgctttgatataaaactatttcaaatggatgtgaaaagtgcttttctaaatggtgaaattgccgaacttgtctttgtttaacaacctcccggttttgaagatcctaaaaatcctaaccatgtttataaactctcaaaagttctttatggtttaaaacaagctcctagggcttggtatgaaagattgagagattttcttttgtcaaaggatttcaaaattggaaaagttgacaccacccttttcacaaaaatcattggtgatgatttctttttgtgtcaaatttatgttgatgacatcatattcggttctactaatgaggtattttgcaaggaatttggtgatatgatgtttagggaatttgagatgtccatgattggagagttgagcttcttccttggacttcaaatcaagcaactcaagaatgggacgttcgtgagccaaaccaagtacatcaaggatctactcaagaggtttggcttggaggatgcgaagcccatcaagacacctatggcaaccaacgggcatcttgaccttgatgagggaggtaaaccggtagatttaaagctttatcgttccatgattggtagcttgctttaccttaccgcatctaggccggatatcatgtttagtgtttgcatgtgtgcatggtttcaagccgctcctaaggagtgtcacttagtggccgtgaaaaggattctaagatatttaaagcattcctctactattggcttgtggtacccaaaaggtactaagtttaaccttgttggctattccgattcggattatgccggttgcaaagtggatagaaagagcacatccggtagttgccaaatgcttggtagatcccttgtgtcatggtcatccaagaaacaaaactctgtagccctctctaccgccaaggcggaatatgtttcggcgggtagttgttgtgcccaattgctttggatgaaacaaacattgtggactatagcatatccttcaccaaaaccccactcctatgtgacaatgatagtgccataaaaatagccaataacccggtccaacattctagaaccaagcatactgacatacgccatcacttcctaagagaccatgttgccaagtgtgacatagtcattagccacataagaaccgaggatcaactagccgacgtatttactaagtctcttgataaaacccgcttttgcaagttgaggaatgagttaaatgtcatatatttctctaatgtggcttgagatggtgcaccatggttgcttctttttgcattatgtatatttgctctcatttgctttatgtatatttgctctcatttgctcttatgctttggatttgttgccatttggttcttcattgcgaaaatggagcatgtcacattaagggggagttttgcactcttgcatgtgctctacttccctttatatgtgagcaaatcaactagtggtgctagtagtattttcaaaatgcctaagtcaacataagtcaaaacttttgcaaaatcaatgtaatttgaaaactatctcttggaaaatgtttcaaaaggtttcctatatgttttctaagcctcacattgcaagaaaaatgatttctgaatgaaaatgtcattttggccctcttttgaagaaactagattcttagttttggccaaaatgagaattatccccaaaatgagattgagaaggaatttgagaaaagtttcaaaacaaagttggtagataagaagttttgaaatgtttttggtattcaaacctatttcaaaaaccaaatcatttaaaagttatttgaaaatcaaattcgcccaaaaacccgtatagaccataaaaggtcacctcctagcacttaagtgagttttgttgcaaatcatcataatcttcaaatattatgggtggttagcaatatttaaactcacacatttcaaaaattgctccaaaaatcaatttttttattgaattttattgtgtgggggttgtcggcttgtgcaagggctgtgcacagccgccagggggcctggcagtctgaccgacgctatatgcgtggtttgactatccaggtgcagcggtctgaccggccacatagggccggttgtcacatcctgatttttgtttcgggatttataaattatttaataaattattattagaatttatattaaacgttcattaatttacaagtgaacttaaatatgggaaataaaatttccttaatttaaagcatggatggatttaatttgtattaaattctccatgattaattatactctctgcaatattctcggatttttcggagctcaattcctaattttaatcatacaaagagcatttcagtaattacccacatattaaattaatcattaaatggtctaattataatttttaagtactttgagtgtccaagtattttcaggatttttcttgaaattatttgagcattggaagtatttttaacaattcaaagatcatttaagtgattattttaattggaaaagtaataaaattctcctcccttgtcttaggctgaatcggcccattcctttccttcctcttctctccctcctcgcgcgcgtgttgtgcatcccacgccggcccaacccgagcctgcatcctctcttcttctctcagccaaagtccggttttgctccctcttcaaatcaggctgagaaaagaaaagcccggcaagaagtctactttccttccccgcgctactgttcatcttccagctctggactgagccagagccgagccgtgccgtgcctgttggctgttgccgccgatccccttccaaaatccaacctctccgttgctcttattttcgaattggttgcgggaatggaatcctctcaatctcctcttccttgtccccaagaaatccccaaaagtttatatggaaatcctttccaatttcgcggttcaacctttcctttttccggcgaagatctaaactttcccgagtttttcccgtcgttgtgggctcgatcctggccttccatggctatatataggacccccttgtcctcctctttcgtttgccccctctcccgtgatctcccgtgcctcgtagcaccgccgccacgtgctccaccccgccatcgtcgccggccgagctccatccgcgtcgcgccgccgcctccgtcgtcgccgccggtcgccgtcaccaccgttaggtgcgcgggagggtggagaagcccggccgcctgacccccgaagccgccgaccaccgcagctccggtgccaccgccgaccgaagccgccgctagacccgtcgccggccgtcgtcgttcgtcgtttggttcgagggtgagtaccgttgggttcgtctcgtcgtcctctacgtgttcatatcctccaaagtcgcagccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgttaaaaatatccacatgtactgtttatgcttgtttttgtactgtttatttagtttttattagtctttctcttcgttttgcgtgttagcttgtcgtttccgtcgttgcgaaggttcgtgagtgcgtcgggagtgttcagaagattaattgaagactgattattgcaaggcaagtcacacagatcccaaacaaccctttgagcatgttgatcccgtttaaagctattgtttctattcaactattgcatttattttcgaatgtcattgggtggaattaacctattgtttgttataacccttttgttcttgattactttattccttgataccttgggttattataacttgactagttgggctttatatattggttcagctagatattagttatgattgcttagccatgcttagaaacattaacacactattgggataacttatgactcactattatttaattatggcttaatgatagttcacgatggtcaatcgtgattggttaattaattacttgccaactaaaacttgataatggtgggttgtgagcacatggttttgagagttgtgctcatggcaattaaggaccggttcgcgagctactgttgtgaaacattaaccgtgccaaccacaagctagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcaacatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatatcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgtttttctttttttttaagtatgtaacgttattattatgatggatttgtatattaaattgtcagtttatgtacctcggctgattcctggacgaggattttatgcacaaattagttcgaaaattattagtgaatttccgggcgtgacaccggtctgaccggccggcaggtgggcccaggacttttgtcctttttcttctcccttcttcccctacccgacctaatctcctcccattcaaccatcttcttccccaactcgaaaaaaactcatctctcctctcccaaaccctagccacctccctccatcaaatccattcggtttgaccgcggatttctctccggttacaccgtaagtgattctcctccgcttcctctctctattccatggattagtttgtgtttttgttgagtttttgatccatggcatggaactctaggtgaagcacgaggtgttcttcgatttgcaccaatagagggtagtttcttggtttgattcaactcctccaaccggtaaatcactctccctcttgtgcattctctcaaatcaatctatttcaccctagggctatgggtagttattccaatcttgatgaaataggtccaaccctttgatgttctagttccactcttgtgcaatattgttctagcaatttttagactcaaatgagtagatgtgaaaatttttggatgcttgaacttgtgggaggaggtctgcccggagacacaggcggtctgactgtgggtcagccgccggtctgaccggcgtgtgcgcgcggtttgaccggccgtcagtcgtcggtctgaccggccaccggcaggcggtctgaccggcctgatatcgtcggtctgaccgccctactggctgtggtctgaccacccctccacaggatataggcaaattttcacctctccaaattgtttctagaattattgctaatatctatcatcctttgctctttgacagtgatgcctccccgcactcgccatgatcgtcgtgcacccactccgaatcccgtgagtgagcctgaggaatcgagcggagatgagtacgctcaaagtgatgaagaggttgaggccaatgttgagggggatagtgaggaggaaagtggagatgatgtcagtagaagtggagaggatgaggatgaaggaagtgatgatatatgcacattgatccctccatccagtttgttgtgaacatgaggaatccatcacaatataccatcttgaggcaccatgatcagtttttgaggcctcgggacaccccggatccccgttttcacaccgctttccagaagagtgtgtatgagcaagtttatgcagggaaagcttttgcagagcataaggggatttcttggagagacatcaatgtccagagtttgaggggttgcaggatctcttcaagactgttagcattgatcggattgttactctcaagcaagactacaatgaagatttgatccggcagttttatgctacagtgtgggtggctggagacaatagtgagatgaagtggatgtccgacaccctccagtgttctatctctaggaggcaattccggcggctcctcaatattcgcttgaactttgaagatgacttgcatgaggagcacactcacaatccgctctccatagactacctctctcagttttatgaagatggagtgcggtacacacatgggaaggttgccggcttgaggaccatccccagtgtggttaacaggattgtgagagctaccatcctccctcgccttggcaacaatgatgacattatgggggcggattggcacgtcatcgatgccatcattcagggccgtcagttcgacattgtgtctcttatgatgcaagagattgccatctccaaggggaccttcacttagggaatctattatgccccttacatcatgaggttgattcaagacaagcttggggctgctgggcaaaatttgaagaagcacaagcagtacaagccccgcctttagcttggagctccccgtgctcctagggcggcgccctcctctcatcctggagctagctcaagctcagcacctcctcctcctcctgggtattatccaaatgctttcatccttccacttcatctttttaccgggagtaaaaagataccaaccgggactaaagatcataaaatgctatgggcttttcaaccggggctaaatatgatttttagtcccggtttttttaatgaaccggaactattgtgaattttggccgaccagacaaagatggtttctccagtagtgaaagacagatagcgtatggagacagtcgatggacagagcaatatattgtgctagcggccgaagtggacggggacggtgagatgagtggaggctgcgccggctgttagagcggacgcaacaggtgtatgacggcggaccggaggcggcgttggctagcgacgcggaagccctttcctacgggagcagcgtctcgtcccacgtgcgaagacaagattggaattggaggcgcctcgcccagggtttcccaaaccaccagggccagagttaccatggtaaccgcgccgtggcaaaccgtacgaaaactgtataaaatttatcaaaattttaaattatttttaaaatttatttgaatttaaggagattgccgtggttttctttttacaggaccctccggtaaccctggtctcgcctaagccttcccttcttctggcttcatttctctatggtttcggaggcacagaagaattagggactggtttgggtagctgttggagcccataaatcccaggtaattaatatataattgctctaaggtccaagagaactacaaactaaacattgaattaagcataacagccacaacacatcaaagaggcttactaattaccattaacctgtatacaaaacagaaggttgtaaatttgctttattagttacgaaataatttcagaacattttacactggtacactccaacaatgaaatgcactcacccaacatctaaactactctcccccactgatggaaagtatatcggatatggtttgtgtggcatatattactgctgaaaactccctcccaagtaggcctacaacaataaaagaaagaagattagtctatgcttgccgatgacaatggtttgaaggttgacaaattaagcaatgaattttacaatcccataggaaagtatactacagttatcctgcattcagtcaaaattataacacctcttggggagctctgttatctctctgtcatatcaagttatcaacagcggtgaaaggaacaaccacgcagttgtgatgctaaaataacttttcttgctcaaattttaaggtgctagtgctagtaaaagtgttttccgcatttaagagaagaaaatggatgggcatatagttggattggaaaactttaactatggggtaatttactctacatatttgagaaaactaattaagtagcatatagaaagagctagtttacccaattaatgcatttaaactgactattcattgatgcaaataggtggcattaattgtctggacaaagattctttttatagttcaaggtgaatcaccgggatacataagagccacatctatcctaccatcactccttagtgggctataggaaatcatctctattttcaacggcaaatactttgcgactattctgagctcatagctagtaattcagttttaaaagacagatagctgaatataattatgaaaacttcaataattccatcaaaataggtattgcagaaggcctggatgactaaaattaagataataagttataactcacaatagagaaggatgatagggaaaaggaagggaaaaaatatcctgcagacaaatatacaccatattagcatgcaacccaaaattgagcatattaaccattcaatgatctatcagctaagagaattaaaagtgtaaagaaggatctaatccatttggtccaatgatatatagcaatgctaggataagtatagcagtcgtacaacaaaaatactgaaaatggcatgtagatagtagagtatcgaagcaaatcggatcttcctgcatataaatcatccatttaacttaaaatctagttctattagtgccaaatctaagtcatctagaaactacattaagaactaagtgggcagtgagagcaaacacacaaagaaaaatgctaatcagtaagtgactaaaagcctacctaatgcttgaaatacaaagagcttcaaaacacatattgtctgtacattatctataagagctcctctgacgttacatagcatgcaatttgaaatgtcccatttgaatgatatgactttatgtagaattgcaacacatttttttgctatgacttgtccacataatagaaaaatggtaacataagcatatgctatttttatttcgatgctgaatttgaaaaatagaacatatcagtcggctagttcgtacaattgcttccatgtaggaaaatataatatgtcaaacagtagtgaagtattatcaatgcaaaacagctttaagttcagttaaccaataaatttgaaagcagcaacagtaccaaaacacatatgtcctgacagtataagttggcgatctgccttagtatggatttgtgccctcacacgtgcttttttgcaaacacctagaacattgtccctctgtaaaaagcacattatgcatatcctccctgcagcaagtttagaaaataaattgttgattcaatattaagatgcaaaattaggatcaggggatattcatagatcgatccagatttttatttaatgatggataaagatggtaccagtcagtagctgcatgacgtaggagacggtgatggccccagcagctgagttgatgaactcggcagactgtttgtcgaagtaatgaatgacgacttgaactatgtaactgaacaaaatggtattcaactattcatgcaaatggggaatgatggagtgagggtgaagtagaagaaacggggttggaagggaagagtgggcataggtgttcaccttgaaaggagagacggtagatcagcttgtctgaacaacagcagcgcctaacgatggagacagatacgccctggacgcttcaggagttgggatccggaaggctcaaatgattcgcatgatatgggtaaataccacatctcgagctcgagctcgcagaccatcgagatgatgctatgtattgatgctgccaatatggcaatcgatgtgggacgaactgccattgatgggccgatgacgatggaggaaaaaacctgcgagggcgcaagaagagtgagaagaagagaaggggagggaaagagaggggcacgcacgccatgccctcactccgttgcgtgaggcggggaaccggcgcccggctgcgtgcgccgatgcgtcgccgtccgcccgtgagagggctacagcagcgtggcggcggatgaggccatatgcgagcgggccgcgagcgctgctagggttttggctgtgtggggatatgttgggaagatcttgaccgtctgttgtcctctcatcgatctgatggtggtggaagaaccggcaccgtaggccaggtggacgactggatcgatcccaatgcggcatcgaacggcgccatggtaggtgaaactcggacgtgattaaccggaagaacggggtgtttttggaaaaaaaaaccaatgacgtggcgcccaaattttccagcactcccacgacgtttagagagattaatattttggagatgctcaatgtaacctgcaaatttttttttagaaaacttaaccgtcctcccacagctataaaacatcaaatatgtgtcggcactataggtgccggaagtgctaaaaccagcacctataagccttttcccacttccatgggttgaaatcgcaaaaaacggctctaaataagaaccgacacctattctataggtgttggttttcttaaaaaaccgatacctttaatatattataggtgtcggtaaattaaaaaccgacacttatgaattgagccgagccggtgggcccctccagcatgaggcgatcgataaggttcaactccctcggtccctcctcatccatgcatccactcgcgtcctctctctctctccatccctttcctctctctccctcccttctctcccgcggttggcggctagccggcggaggtggcagcggcggccgcaccctcccctccgccagatccgacggaaggggaggcggaggccgcggccggcggaagggcgatgcggtggcggcgagcggcaggaggatggcggttggaggccgcgaatcgatctcttcccctccccttcttgtccctcctcctttgtgttttgtattatttcctctgtaatttgttgaatatgatctagatgtgttcatggatttgatgcattttagttcatgtgttcatggatttgatgcaattttgggatttaggtattatttgggatcggcttgacggcttgatgcatcggccgatctttttttggttcgtgtgcgtctcaaaggtgctggttttgaagccggcatctttaatctcctgtgatttgtgtcgccttcatggtgccgattaggaaaaccggcactgaagggggtttcccaaccagcaccgaatccctattttgtagtagtgccaagagatatgtactagaaatacctagggatattctagctagctctacaagatggtgagctaaacgacctgagttcaaagtctcatattttctaattatttaatattaggccattctctaatattcgcgtttatagatatctgtacgtgcaccttaattaattggagatgctgaacgtaaccggcaatttatttcgagaaaacttgatcgatcagtgaaaattatgtttctttttttggcctttggtctctggtgaccctattgacagcctgttaaaacctattttaactatcacgaaaaaaaaccgtattgtaatagtggtgacgaaaacaaaacatgcatcaaagattcttaaatcagctggttccgtggttcgtgcactcataaggcacgcaaactagctggtcgcgcggccactttctcataagggcatgtacaacccacagacggtgggtcgtctgcagaaactcgaaattctcatacagatagatataaagacagctcatacaacccacaaacagaggggccatctgtaagctgtttaatgctttgcatgtagcttagatcaactataaatgtatttgtatgtaccattgtgtggctaattgatagaataaatatgaagattaaataatagaaacgcgattacaataatttttagaaaccatatatataataattatattatatatagttacaatgctttttgtctaattttctttgtttccgtagcgttgccatatgtgctcgattagatccttcttaagttgcctatgtgttggtcgagctttgatagccgaatttctacgaagtgcctctgcaaagcttggattagggtcatcatttgtacgcacttctggtgggatcactatcgtcgcacttggattttcattcaaatccaagacatccctaactgagtccttctcatcttcaactatcatattgtgaaggataacacaagcttgcataatgttgataacgtctccttgcttccataagcgtgctggtcgacgaacaatatcaaagcgtgattgcagaacaccaaatgcacactcgacatctttcctcaccccttcttgcctcaacgaaaatgttttatcttccgctgattgaggggcattaactgtcttcacgaatactgcccattctggatatattttatcggcaagatagtaacccatgtcatattgatttccaattacagtatagtgtaccgtaggagattccccttttattgcttgaattaacagtggtgacttgtttaaaacgttaatgtcattctgagaccccgcggtaccaaagaaagcatgccatatacgaagattttttgatgccactgcttcaaggatcatagtaggaacaccttgtttaccacttgtaaactgacccgcccaacctttcggacaattcttccatggccaatgcatgtaatcgatgcttcccatgcacccaggaaaaccacgagcctcattttcttgtaagatttattcaagttcatcgcttcttggaggccgtagatattcgtcaccaaatgtttcaatcacaccttcagcgaattttcccaaaatctccaaacaagtgcttgcagctattttcaagacctcatcaagttgatcagccgaggttccataagctaacatcctgatggccgctgtacacttttgaagtggtgaatgactatttctaccaatagcatcgactctttgggtgaaataaggggaccaatcgctaagtgcatgcacgatacgcaggaacaatggcttattcatcctaaatctcctacggaacatgtcatcggtgtagataggatttgcggaaaaataattagcagatttgcggaaaaataattagcaacaagatcatcatgaccttgttctcgattccttggtatgtacctccttggtccactctgtcgacgtcggcgatgtacagtcgatgcttcgatgcttctctgtccatgtcggccttgaatccctctgctactatttcttcaaaaatatcatcctctacgattaagtcttccacggtgaacacctcttcaaactcttcggcatcttcgacttcatcttcttcgtgcggctccattcaaagagttacgatacaccttgtttgatgcaagtgtttggatggtggagtagtgtacagaggagcgcacagaacaacgatgttttatagaataaaaaaatatgaccattcatatttacaaaaactgatcggcaccactaaactgatcaactactagcattcaagctacattcaaattcagcatttacatttacattcaagtggcacattcaagctactaaaaagatcaacgtcgcactacagcggctaaactgatcaactgatcaactccagcaccacttaaaagatgaccattcacatttacattcaagttcagcattgaatttcagaaaactgatcaactccggcaccactaaaaagatgaccattccattcacattcaagttcacacacacaattcagaaaatcatgcgcagtttcagttcacattcaagttcacaaagcacagtttcagttcacacacacagtttcagtttcagttcacactaaaaatatcatcctctgcgatcagtttcagttcacacacacagtgtcaagttcacaaagcactgtcattaccatttagaaaatcatgcgcagtttcacatttaattggatttcagaatttaattaccaggatacctgaaactgaaactaccaggataccataatttcagaatttacattatggcctatagagcaaaactgagtaagggagaactgaacatatatgggtactgaataagcagaaaactgaatttggctgaggttcatatatggctgggtactgagtaagggaaaacacggcaaaactaccagtatactgaacattgatactgaacatatatggctgaggttcatatatggctactgaatatgcagaaaactgaatttcagaaaaaaaaagcatgaatgagcagaaaactgaacatatatggctgaggttcatatatggctactacaagtgctaaatttaacaagtttgtcacagaatttcagaatttaacaagtttgtcacagaatactaaataagcagaaacttcatatcttcataccagaactggctgaggttcatatatggctactacaagtgctaaatttcagaactacaagtgctaaatttcagaactacacagataagaaataccttctcaaacagtttcaggaaaaagggccttcataagacacttcatcatcatagctcgctgtgccttttcctcatcggacattgaacttgtatcctgtgaaacgaggttgttataagtctccatcatctttgtctctttatcaagcttctttccttctttgtactcttgtgctgtaaggtgggcaatttttgtggcctctagcttctcagaagctatcttctcttgcctgtccaatagcttcatacgcttctcattgtttgcctcctaaaatttactgtatctatcaaatttgtctagctcaataggagaatcctttgagtgaccatcatcactactgctggaaccctttaacttgccatttttagcagctagagctgcctttttagctgccttctgaccaattggtcgttgtggcatctgatcacaagtgtcctcattttcctcagattctccttccagatggaatgctttccttttacgtgcattcttcaggttttcattatatgttttccactttggcacatctcggcaaattttccaaacctctgtcagcatataaggtccaaccacgtctttgcattctttgttgtcatccacatagaacttgtgtgctgcatcaagccacatttcagccgaatatccacttgtaaatactctacgagccttagcgtaagcacattcaaagaggtctgtccatttattaatcttgttccatctatccttgcattgcttcgcatttcttcttcgaagtggaggggtagttttgttgtacgtttcgacaacctcaccccaatattggacaccacccttatccgcaccacaggtaaagtcggttgaatgttctaaccaagcgctcatcactctaacatcctcgtccggagtccacatgatcctcttctcggttctaacactgtcattgccatgtaatatttccacttcgggcggtgaactaccattgtgtgcctgattcagaggactcatgtgaataactgcaccaaccaaatgagagttctgtgcttcatttccaaaatagctcatgaaaccaccaggtggacgtacatcttggtccctgcaggaaattgcaattaacatgaaattttccatggtccatctacaaataaaattcagatgcagtagtagtactattgtggctgtatttatgaagggttagaaggtaaaattagcttaaaatgatttcggcacagaagcttaacatgaaattagcttaaaatatgaaattagcttaaaatgatcagttgacacagaagcttgatgggtatttttactctttaagaacaactaacaaagagtacaatatgttggacacagaagcttgatgggctcatttttatgataatcatttatcagttgaatatctaacaaagagttcaatgaatcacttctggacattgttaaaatatggtataaaagggatccaggtacaacagtatgggatttacagattcacaatgcttaatatcaactacaaaattatctagattcacaatgcctaatatcaactacaaaatcagcaatgaaacaaggatttaccatgatccaggagatgagggatcaccgccggccgcatcaaaccaaggttgagacgatgcatggggaccaattgagctggtgaagtcacctccgacagaaccatcaatggagaaagccgggacggtcgtcgctgccgctactgacccgcgaccgtgtccgcgagaacggggcggcggtggtagcccgacagcgtgaccaaaagaaccccgaccgaatgagggagccgccgccgccgccccgacacctagggttcggcctggggccgtcgccgccgcatccaatgtcctcgatccattccttctccaagctgcgccgggcgtggacatcccgccgcaccaactccggcgagaataccagatggggggcgagcagatggcggccgcgcagatgggcgggcgaagaaatttggggcaagtcgcgagcagagcgcgggagaacagcgcgcgtggttgcctgggaaatttgtgggcgagcgcggccgcacgcgggatccgttcgcccgtcgcctggggatgacggcgctctacagcgcgtgggctcgcgtcgactccacctgggagaacgggatgaactcgtcgcgtcgggaggcgccgggctgcccgtctctgcgcgtgcacgggttttttttgcaaaatcaccaacacacagacggggcgaggagacgggttgtacatgccctaagtcataaagcctgcatgcagcccagctgacctgctgctgtacacgtggtagagagaaacgaccacggtcctcctgttcacaaggttttacacgaaaaactgtaaacagcgcacgattcctctctacacaatcaattaatgttaattacccttttcatatatacagaccatcgtccataatttaccttttttacacatgctaaactaccaaaatgggcatgcaaatatgcggactaattaatcatgacatcagcctcatttcaggttcacagcttgccatgcaaaacatgcagagttatatttattaacattaaagaatattcagtgaaaaaaacattactcaatctattgtactgtttgaactcatgacaattaaagattttttaaaaaaaatcaagacgtgtcttgttcattctggaggtgtagtaatatactccctccgttttttaatagatgacaccgttgactttttctcacatgtttgaccattcgtcttattcaaaaaatttatgcaaatgtataaattataaatcacacttaaagtattatgagtgataaaacaactcataacaaaataaattataattacgtaaattttttgaataagatgaatggtcaaacatatgagaaaaagtcaacggcgtcatctattaaaaacggaagtagtattaccatgtcaactggacacaaaatgaagaacatatacaccaatttgatcgcagtgaccaattctaacgactatatatcgatataatcgtatacaaatacaattgtatatatggaaatagagatatgagttgtataaaatctatatttaataaaaaatctagcctaaaaaatccgctatatttttatttttaatccctttgacgaattatacaaaagatgctctcaattcttttgtcgatctcacgccaagccacatatatgagttcaaagctgaagttaacacgataggtagcctcgtgctttttctgaggcgacaaatatcgtctccattggtctgtcagtaacaaaaaccctctaattaacaccctttcatcttgtactttaatttcacctcttcacacaaactgtatatgctgtcttttacttgacttgtagtgcaaccttccactgtcacacatgacgcctccatctgcaatggcatcttaattaatcatcagtaactccaatttccaaatagcacgtacgcatgcatgcgtccatgccatctccttcatctgctcgatcgatcactctcagatagattgattgattttactatctcgatcgagttggtcgccaattcgccatggccagcagcctcatcaacctcctcctcacggaggtggcggccatcgtcagcatcgtcctcctcgccctcctcgtcgtgctcagctcctaccgccgccgctccggccacccggcgctccgcctcttcgtctgggcggcctccacgctcttcctcccgctcgtctcctacgccgtctccgccgccgccaagtgggacgccgcgcgcgtcccgctcctcctcgcctggaccgtcttcctccagatgctgcgcaacaccatcgacaccgcccgctcgtcctcgtccacgatcggcaacggcagcggcagcagcaagttcaggccctccgtcgagcagctggcgaggatgggctgggtggcgttcctcattgtcagcagcgacggcaccgccgggagcccacagctcaccggggtgctcctgtggctgtgggtgctcagcctcgccaagctcgtccaccgcctcgttgccgccgagctcgccaagaactcgttcgccgtcggccttaacgcctacctcatctccgactacatgaagcagctgtacgggcaagaccaaggagaccacgacgtgcaagctcctccgttgttggtgatgggcgaggagaagctgcaaatcgaggcgaggccacaggggtaccgcattggccggacatcgccgccgccattgtgcgtcgacgccgggcatgtggtcaccatggaccggatatgccggctgttctcctccggcgatccactcgtcgcttctaacccgcagatcaaggacacatgcctctcgttcgccctgttcaagctgcagctccggcggttcgtcgggtgccccatcgccgaggcgggctctcgccgttcggtggcgttcgtgctcgacggcctcctcggcgagagccacgagcgggtgttccgggtgatcgagaccgagctgtccttcctcgccgacttcctctactccaagctcaccgtcttctacgcgagcgggtggtggttcccggtgctcaactcgatgctcgtgttcgccacgtgggtcagctgcctcgccgccggcggcgccatcgtgcacgacatgacgtgccacggcacgacgctcgccagcaactacgacaacctgagggagtacctgcagaaccacgacaccgtgttccacatcatcgtcggcctcgacgtgctcgtcaccgtctccttcatcgtcgccatcgtgttcacggaggggtgggagatcgctacctacgtccgctccgactggatcaaggtgtccgccatctgcgagtacgcgcgccggccgtcatggcgcaagtcgccatggactcgccgcaacgtcggccgagttctcccgctcaagccaatgcagcgctgggacgatcggttcgggcagacgtccatcctgcagctccgtccgtgctactgtggctgcgtctcccggcaggttgaccggatcgccaagtcgtcggccactgtgccggcggcggtgaagacggccgtcgtggacacgctaaggacgaaccaaggaaacctgggaaacggcgtgctctcgttgcagcggaacggcgtcgccgacaagctcgcctgggcgtgccaccacgccggcgacgagagaagcgtctccgagcagatcctggtatggcatgtggcgaccaggcttctcgagatcatgcgatcagaaggcgctcacgggagacacgacgacggagacggcgacggcggcggagacagcgacacggtggtcgtcgcgacacggctgtcgcggtactgcgcctacctggtggcgctgaagccggagctcctgccggaccacccggcctggacggaggagctgtacgagggcgtggtggaggaggtgtcgagggtgctcgcgcggttcgcaggggcggtggtgcggtacgagcgcgcggcgacgtgcctcggcgggagcacgaacgcgacgctgaggaaggcggccaagctcgggcggcagctggcggaggagctcggcggcgacgaggagttgccctggagggtgcttgccgatttctgggcggagctcgtcgtctacctcgcgccgtcggagaacgtcacggcgcattccaaggcgctccgccgtggcggcgagttcatcaccgtgctgtgggcgttgctcggccacgccggcattgttagccggccggacactgacgtctgactgacagtgtgagtgtggtttatggcgaacacatggttttctttccgcttttgtcattgtgtataccaaactgtcgacatgagatgtgtttgccaaactgtcgacaatttatttctgatttgcaatagtaaaacagtttccaatcctttacgaacaagaagcagaggttctttttatgaacaccgaatgatgttgcatgatcttctttaaaaaaaaaaatctataggcataaacatgaaggaattttgctagacatctccagccaggtggcttgaaaggcaaggccggaatctgtcatcacataagcaaaagcttctctggtcagaaaaccaggttgttgcacgctgcattgcgcagctgcaatgcaatcttgagacagaatcatgtgccgagtcgaaaagcaacgcaatgcaagctacctgttcagccagactaggtggctagcttttatcaccaggcagggggcatctttatctttcaggttgtctgtattgcctatatttttttttatacccaagtccctaattcaagggcaatgtttatctcttggtgcagaattctaatatctcagaagagctgggcttaccctttgatgtggatttgaggatatcagaagatactatgaggtatcaaattttgtagcataaattttgatagcttcacatacctcccaaaaatttgacaaagttggccctttcatcattgataaggacgttgagaaaatcctggactaggagaacagcacaatgaagcaagttgaatcggagatggatttaaatcttccgggtggatgtccacccgtttattgcatgcatgccaactaaatggttttgaaaaaaatttaaaaaatttgacaagatagattaatgcataatatataggcaataaataaaatgtaacgagtttacatatatttgcagaaaatttgtaattttgttaaaacttgtagaaaatgtttttgaacttgcatctttgtggaatgatatattccatgcttgtggatgctatagcaaactaggcagtgacccaaacaaaaataatcctctggtacttgtggaccttgttaggtcattcacagggcacatacgtaacgtgtgacaatgttggttcacatagacaaattgcttgcgtgtaggagagaggggagtggggaccgctccttcaccggcttcgcgtgaccatagttggtcactagaacctcccactcttgcagcagttctcgatcagaaaaagtggtcatctgcgcgtggagagagagagagagagagaatgggggaaacaaaagtgtctgactgaagagaaaagccggataggggtgcggaggtggtgaagtggcgacgagtctgaccccaacgaaggtgccctcgccggggacctcgtttgcccacgcctcccacctgcttcgatccgcgccggagaggggagaggagtaagggcgctgagcgaggaaaccggaggggagatgaaggggcgatggtgcctgaagcagtgaggggaggggcgtcatcggcttgatctgccccatccggccacgctgccagcgagctcgtcgcccgcaccaccaggtcctcctcgaccgccaccgctgcgtggatttggggtagccaaggaaggaggccacaaggggagagaaagagtggtggtggccggagcgggcgagggaggggcggttgtggtgggcggcggggtggctcgatcttccttgcattgccacgcggtcgtgccagcggggagctcctcaaccgccgccaagggaggaggccgaagggaagagagggaagggcggttcagtggtggtggctagagtggtgaaagggggagaggagagcgtcggtttcgaggaaagggagagtgagagagagaagggggaaggtggaggaaaaaaagggaaaactatttttgtggaccccacttgaggttacaacattgtgaaccttgtgtctttcaccattccttagcctacgagggatgtgaggtccggcaaacacatatgccacattgctatttctattgcccttattgatcattcagtacaagttgatgtagcaagatcagaaaatgctgtccaagcagatatggaggtagagtttcatcgtagcaagcagcggttcggatttttgaaatggggttcaacacttcaactgcttttagtaatatgcttagcttgtcgttccacctttaataaaaaaaaagcttgttgttccacctggatctggaattttgcatcaggtgaaccttgaatatctgggcagacttgtgtttaacaatggtggtgggatcctttgccctgattagcagaattgccgtacttactttgatacaggatttaaaaacttcatatgatattacatgttaaaactttgtttggttaatctcactaacaaggggattggaggagaattaattccacacctatccccctcaatttcctttgatcccttcttcatgggattaaccgcacaagacttaacatgggtatatggctgcattactatatattaagacgatatataataattttgtactttgacttttaacaataaccgtaggtagacttttagctgatcttaataatcatgaaaagagattgaaaaattaaaattgcccaaaaagctcttagatttattctagaatcaaataatacatttatgtaactacccacttttatttgcttcaaacaaaagctattcttgttactctcttcttttaccttttaactctaaggagtacatatgagaaccgatagctggccaaacaggtggcctggcccaatgcggcatgagtccactggcaacacaacccgctttagtacaattcgttaggcacgacacctgtagcaggctatgctatgtcggcctatgtgccaaggccacggcccaagaatagctcaagaagacaccgtgttgtgctgggccatcacagcacgactactgttacggctcgtgggtcaatgacaggcccaactgtacatatgacctatggaaattgaaatttgaggtggaaaaataaaaagcgaaaaagaaatagtgaaggtggaaaaataggaaaagtagtaaaaaggatggaaaataatgagtaaacatatggaggaaatgggaaaaggtaagggaaaataggaaaaatatgactaataaaaataggaaaaaatggaaaattaggaaatatatacagaaaaaatagatgggccagacaggtcgtgctcgtgcttgcccgtagacaaccgtgccatgccagcacaacccacaggccagtgtgccgtgccatgtcgtgtcgtgggctggtacaatacagtcatactctagtcatactctggcctagcttggcatgacccatttggccagttatatgttattgataagtgtggtgatggaagtgaaccattatcttcttttaaagaggtataaatcgcgttgtagaaatggacttacgcacaaactatgacagatggccttggccggtgtttctgatgggtgagttgatggtataaaggcagaagctgcaatgcttggccatgggcagccaatgagcatagtattgtcagggcttgtcggtttcaagttagagtgacaaggaagctgaggaatacagatttggtcctagcagggacatttaactttttgccactcgcagtatataacctgtgggttctcatgtgtctataatacgtgggatcaatgacaaatctttaattgcgacttgtaagagtggcaaataattaattattcctaactcgggaatgtttacttcaggctgataggaaacatggtgttttgtcggttaatttgctgaattttacgggggaggcatgagtgaattatcactgcaggttgatagggctacaatcgcaaacatgggattcgaatccaattgtaatgctgggagctgctatagttgccaaaatggcttgcgaattaggccttgaggtcaagccatggattaagacaagtctcacaccaggttctggacttgtgaagaactatggttgtactacttgcttaggaaattctggagaacttgatatgtatctgctgcaattgataacaatgatattagagtaaattttataaaactacatgtactttacacgatcttatcataaaactacagatttagtatctttgtttattacaaaactacagatactttacacaatatatcacaaaactacagatttaagaacttgtttcacaaaactatatatttagtgtcttcatttattacaaaatacagagttagtgttttcatttatcacagaactacacatttagtatcttcatttatcacaaaactatagatttagtgtctccattatcacaaaactataggtttcaacaatgctaaaatatgtagtttgtgataataaagacattaaacctttagttttgtgataaatgaagatattaaatctatagttttataaaacaagtttttaaatatgtagttttgtgacaaattgtacaaaccaggaattgaagaggagtgtgcacatgtgtacgtttgtactatatttctaaaaagaagaaatatgccaggttttttacgtaatgtcgtgatatcttttgtatgggggtgtataatcgggcaatcactcgtctggaaaaatgttttatttatcagtgtgaaacacgcaatcctcgctccgatgatgctccccaagtgcatctgaaatcctataatatttaagtttttcatcggtgcctttctatttatcacaaatactgtagtaatttgaggacctatttgtccattaaacagcaaacaattaattacaggtgctccaagcaaacaacttttaaccccaaatctaatgcattgtcactatacatgtacacttgtgctacaataaagtcaaagcgaaaaccacatatataaatctattatgtacaaaaacatgatacttgagtactattgtactcaaccaaagtttatcttatgagcgctggagaaatgtttagccgccctgaccatctcgccagccgcatcataccctgcgcggccaccggcggagccagagctcgccaccacctttgagcccaatcgcgcgaaccaagacgccacggccaaccacaaactggagccggatttcctcttcttgcctcccatgactaaacagttactacaaaaacgactgtgtgatcgatgaactgaaccacaaactggagccggatttcctctgctagtttgtttcaactttgatgagctactgtgtcgttgtgtttcttgtgctgttctgttggaagagtttgcagctggaggcttttatatagcattggaggcttggagcagaggtatgcatatgctgggacctgggtcctataagctttcttggcagccaagctgcaaatgaggagagagagtcagagagtccacggttgtgccgtgttctgcattttgtgccgtgttgtgcattgatgtcactctcgcttgacctgaaacatggtcatggtcattgtattcctcatcagtttaaatttaacccaaagcaggaaacgtgtactttgaattttgtgtattaccccctgtacatcttgacataagtcgacgttttttttttccttgtctttattgatacaatcatatatacaagctgtttttattttaatcttctggcaacatgctaatcatggcatgcttaggaatgttcctggatagctgcttttgaagaagaagctatttatcagacagtgatagggaagttagttacatggtcgtttcatcaccgtggcaccttcttcagagaaactcaccgattcctatagagctcacatgctttgaccttttctttttcatattgtaaaccttacatcgatttcttagcatgcttgatttgtgacgaagctacactactagtgtggttttttttttgtttgtttgcattggtcggacaagacagaaacgtaagaggagactgcttagagcactaacaatagtagacactatatgtgtatcatgtctatactattaatttaatgacatagatactactgtacaaactatttgcccaatacaacatttcttacgtgtgggaccaaataatacaaactatttgcccaatacaacatttctacgagtgggaccaaataataagatcttcccagtacatcatttctacccagacaagaaatacgagtctctaattatggaccaagactattcactacgccggaccaggtcatctctgacgggcccaaaccctcacctttaacgggtttggtcttggtcagtgattagtggtcactgatgacaaaatcacctgtgacggatgaaacacccgtcacagataacccatctctgaccggtatataagtcatctctgatgggttaaaacttgtcacccgtcacagatgagtcatttgataatatgagtcacagataagtcatttgataataagatgagtagttgattaaaaagtcaacgacgtcatacattaaaatatggagggagtataacaatattaatagcttgtcttaattatgacatattgtatcttattaatttctatatgtaacgcatgaaatcccaattgtatcttgattgttgcctaatcaaatccccattgattctatttatagtaggtaatctgaataataaattcaaaatttgcagagaaaaaatgaatggtaattgaaattcaaaattggtgcaaaatcatcataggtggctaggctaagtaatctaccaacgaaaatgatttctcatagataattggttgcccgctagcaaaaagatccattttcaccggcctatgttatctagtcacaagcggcgcggctggcctcctatgagaaaatgttcttgttgcccgcgttatgccaatttataatagtgagcaccatccacttccccttccctttcctgtgaagggatgaccatgctcactagatctagcagccacggcctccctggtggagaatttgatcgctcggagccgagaatgaacgcaaggggctagcatatatataggaggctcctcgttaatgaagatgtcgaccacactggtggatttgaggacgtgccaacctccgcagccacaagcccgctcctcgatctaccccttcctccctccccccccccccaaccaccactctctctatatgaaacgtatagttctttttttagaagcttagggcggccatagtaatcggtggatccaggccatggcagctgacggacccgagggtgaggaggcaacagtttctaccgatggatctgttggctcgatgtgatctttgttgaattcaagttaatatacgatttgttgatttatggtgaattattttgttgtgagttgatgcatagttgtggataatttgttggcttgttatgaagatttgttgatacatagtagtggaggattatttgagttgatgtatatatagttgtaggttgcgttgtacgatgatgttgcttatctgttgaattgagtttaaatttaatgattctagttggtgtgtaatagctgttgcaagagaaaatttgctgaggcttgagcccatggctgtactcagtttagaatgcattttctcaggcagggtcagcggcagcgcaatagttcctgggtaaacaaaatcgtttgccataagtcaatatttcggatttaagagcccaattcacatcttcacctggctctttctattttattcgaagtagaaacttcaggacctatttgaccggcccttaatcgaacacttctttttacaaattaacaacgaccttatgaatcctaaatatatacacatatgtgtgctacagtaattgaacagataataattctattatgtacaaagtacaaacatgataacatgcaccattaacagttaaccaaagtttatcttgtgagaactggagaaatgtttagccgccccaaccatcccgccggccgcatcatacccggcgtggccgcccgagccggagcccgcggccgccgcctttgaggcgcccaagcacgcgaaccaagacgccgacgaccagaaaccagagccggatttcttcttgcctcccatggctaataatcaaattaacacgaggggaattaacaaagctagctcaactagtacgtaagtgacagtgtgtatgtcttattaatgctcgcttaaatagcttagctacttgatgagcaccgatcgaactgactacggaatgtttttcttttgctgaaggagttgcagttactggaggctttatataggatgcatgcgagcagctgaggtaattaagctggaagctgcacacttgcttcgtgcttaattacttgcttggcgaccaagctgcaagtgagagaatcagagagagacctgcagtgttctgacttctgactctgaggatcgagagatgatcttgaattataatgtcgctatcacttgacctgaaacttggtcatggtcagttaatactcggtatatatttagtttcacttaaatcaggaaacgtgtacaattcaaattatgcactcttgtgcacaccttggcatcgatggacacgttcgaggcaagagcttgctgaccaagacatgcagacatgcatgcactaggaatggaccaggatagctatctgctgcttgttcaagaagaggagctgtagtgctgtactaatataattaacgacgatatcaaagagtgatagtactgtgataggaacgttagttgtttccttgattttaaaagcatatataaataggcaggcatcagcatcaccgtggcagcttcttcagagaaactcacccgattgataaaatgtttcacatgcttaactgcggttttcttggtatgatgacactacgtatattatatatatatgtgatagctagctaggtagatagtcaaagagaatacagtttatttgcatcatatccactccagtctggctagccaaacgccactagaaagcacagataatttgaagtcgttatatggtcgctcattaaacggaggtagtataagaaatggaaacgaacccatgcatggaagaagtcaaaataaagcgtggtttactattgacttagtattagcaaggagagccagttaaccacgacagcttttccatgatgggcagctctccgaaactttcctacacctgagagaattaagtaactttagcccaatcattttatttgcttcgtacactgacaacacatattgtaaagtttttcagaaacaagcagtaaaataggatacttacgtacctctgacccaaaatagttgtcattttgagtttttctttgtaagatttgaccattcctcttattcaaaaacttatggaattattatttatattttgtgacttgctttattatcaaaagtactttaatatgacttatcctatttttatatttgcactaattttttaaataaaatgaatggtcaaacgttgcaagtaaaaagtcaaagcgaccactaatttgggacatagatagtagaaattaccaaacgatcgtgcttcctaaactgatcagttgattggtgttcatgcccagaataattacgagtactaagaatatgacattcgattaaatttgagaatatacatgacttggacgggtgataggacgatgatgggatagtgttttccccgatgcaagtagccatgtccggtcaccaaggacggaacatgttgatgtatattcaagcaccctacgtacttccacttgctaggcatgggatggcttatcttagtaccgagtgaagttgtggttatctatgcccattcgtcattcgtgtgggatgtttcccttggaggtacccatgcgtgcataggttggtagggggtatctcccacgatggtaatcctaacttagtcacacgcacatgcccacggctaagttatcgagggcctatgcgtggtttaggtggttggggctgagcttgagaaaggatatgttatgagcttgaatcacttgaaggtcacacctatgtgcgtgtgaagcatttgatcgagtaagactattcgaatagccgtgttcatggttacaggatgatcacttgatgtattagtcagtttatgttagcatcaaacctgggataaatggtgggtattagtcacggttaatcttggtggataagtggctaatggttgcttgagcaagggtggtccatggacgatgtttagagcctgttgtgctcatttgttgttcacattcagatttatatacttgttgtacataaatttcagattgtgttattttgcaaattcttatagttttaacttattacttgctcaacaaaacttgctttgtgcaaaatctgaacccttatggtcctttgatatacaagcttatatattcctttgtaatattatatattgtgtaagtcttgcggagtactatttgtacccatgttgctatttttaggtaaggataccggtgactttgatgtgtcctactactatccagccaagggtggcgagggtagtgagtagctgagttggttgccttgtgggctattggctgaccatgggttgagacttctgccactatatttgtgatgtatgaagggcttatgaaccctattgtgtaatatttaccttgttgtgtgtttaattttattaaatacttgttatgctatcaattgcttgcagacgaaagtgccaggctagtcgctttttcctgggaactagctaagcatgagtaagtgttttgagtaattgagatgatcgtggaatatagcgtttgaataagtcctttgagatatataacacatttggtcgccaccttcgaatggtttgatggggcatatctttggtcgaaatcaactaacaagctattccatcgaatatctctcttactcactactcgatatcgtggttaatatattgaaaggtgtcaactacgatcatggatacactgaggatgagtgactatttatgcgagtatggatcccactaatccaaatgcgtgtggtggtcacgttggacactagactgagagaagttgatttgctctctctctctctctctctgaaaagaaacattgacatatatgtttcttttttttagtttctggcctaacattggaaggagtctttcttggaagcaaataagtttatgataaaaaaatatttatcatcttttttccttaaatccttccatatgtaaacttgatttagcatctatatctctcatacatcattactcacttttcatcaaattgtggagcaaaactatctttggaagcatttatcctatatcactttcttttctccataaatgttgcaaaatggttgattccgtcgctctcacacacaaatagttgtttttcaatagttcttgtagtctaactttgggagttactccattggcagttggcacactgtttctgcaaattttgggcatgggaaatctttttaaaggtttgcttttaatggagaaactgatcatcccccctcccccctctctttctgccttttatgtcgccctatatataagggtaccaattaattccaacttttttattttatgtagttgcaattttgttttagtactgaagtgcaattaggtttataaatttttatctataagaaattttattggccctatatttcacacttttccccataaattatgaaaagggtcatttggcctatatcggtttcatatatgttcacttatcatacaagttggcaataagagaaatttcatgatctttacttaatgataccatattttttaacataaaatttggtatctctgttcttgaagtgttgatagacaccatttttacaccaaaaatgttacctacgcatggatcatatataaaatcactcttggaagaatgttttctttgaagcattgttttttttaaaaaaaaagatatgtgatttgtcctacatcacaataagggagatttgatagaaggaaataaaatagacgcccctaattaaatgagttatggttgggactgagaggtgtttggagggaaaaatagcgctactctatttttttagacaaatttaaatagtattagggactgagggagtagtttacttgctccctctgaaaaaaacacatatgtttctcattttttaagtttctggatcaactttggaaggaggctttctttgggtgcaaataagtttattgataaaaaaatatttatcctatactgcttacttttttctataaatccttccatacataaagtagatttagcatctatctgtttcatacgttactcacttcagttccatcaaattgtggagctaaattatctttggaagcatttatcctatatcactttcttttctccatatatcttgcaaaatggttggatttatttttctctctcacacacagacagttacttttccaataattataatagtctaactttggaagttagtatctttagcagcactttacttcattggcacacttactgtttccataaattttgggcatgggagatcttttcaaaggtttacttttaatggagaaactgatcacttacccactttttctcccttccatgtcgttttatgtagtagcccattttacagatttgaaatttatatagtcacaatttagttttagtactgatgtgcaataaggtttataactttttgtctataagaaattttgctcgtctatatttcactcttttcttcataaatcatgaaaaaggtcatttggcatatatctctttcatacatgttcacttttcatacaagtttgcaatacgagaaattttacgatctttacttagaggtggcatattttctaacgtaaagtttggtacctttgtacttgaggttctgacagacaccatttttacactaaaaatggtacttactcatggatcattatataaagagtgaagtatattagcggtctctaaacttctgccggtgtatcatctaggtccccgaacttctaaaatacatttttaggtccctgaacttgccatgtgcgttatataggtccaaacggattctaacccactcgatgcgctgacgtggcaatgccacagtgacacctacgtgttagtggaatccacatgtcaagcatatatacaaaataaaattaaaaaccatattttctcctattaggtagacagaaaaaatataaaaattctaaggtagagaggagaaaatatgtttttctacttatatttttttctatgtggctgacacgtgtgtccaactaacacgtatgaactatcatggcatgccacatcagcgcatggaaggggttggagctcgtttggactcatatgacactccaaaacaagttcgagaatccgaaaatgcattttgagagtttcgggatctagatgacacacccacataagtttaaggaccgctcgtgcacttcactcttatataaaatcactcttggaagaattttttttaagcattgtttttttacagaagatatatgatttctcctacatcacaataagggagatggagggtaagaaaacaaaatagatgccccttaaatgagttatggttgagagtgaaagttggttggagggaaaaatagtactgctctcttttttggacaaatttgaatagtagaagtgcacttatcagggacggagggagtagttgacttcgctctctctcaatccctctaaaaaaaccacacacaagttctctctttttttaagtaaactagaaaaatgcccgtgcgttgcaacgggtgaaggctattttaatcatattattgttatatggtttaggtaaggtgaaattcactatgtcaactcgcttggatgtattattttttaaaatcatgagctgcgattaggagtctgatagtctcaaattaacatgcgtgtttttttaaagagatttcttatacgactctttctgtatttccaaaaacgaatgaacttaagaatcaactcaaatacagacatgtatttcaaaaagcgaatgaacttaaaaaccaacttatacacggatgacgtaccaaagtactagcaaaaacatatttgattttttataatagcagagagtagagatataatctagttaaggtaaaattcattgtgagaattcgcttggatatatagttttctagaaaatcatgagttgcaattaggagtccgatcatctcaagttagcatgcgagttttttttaaaaaagagatttcttatatgactccttctgtatttccaaaaaggaacgaacttaaaacctgactcaaatacagatatgtattttcaaaagcaaacgaacttaaaaactgactcatacgcagatgacgtaccaaagtactggcaaaaacatcttcaatttttataatagtaaagatttcacaaaactacatatactttgaccaaattatcacaaaactacacatttagagtgatatatcacaaaactacaaatttaacactaaatttcacatagaactacagatttaaggtagagtatcgtaaaactatagatttagcaataaaattatcacaaaactacaggttcagtgataatttaatcataaaacttacacgtgtataactcaaacataacactagtgctaaggatttaaactctaaaatatgtagttttgtgataactttgttattaaatctgtagttttgcgatactccaccttaactctatagttttgtgataaatttagtgctaaatatgtagttttgtgatacatcactataaattgtgataatttgatcaaagtatatatagttttgtgaaatttactatatttttttttcagtttctggactaactttggaaggaggctttctttgggagcaaataagtttattgatagaaataaatttaccctatacttcttacttttttccttaaatccttccatacataaagtagatttagcatctatctctttcatgcgttacacacttttcatcaaattgtggagcgaaattatctttggaagtatttgtcctatatctcttttctctccataaatcttgcaaaacggttggatttatttttatctctctcgcacacagatagacttttcaataattctagtagtctaactttggaagttaagcatctttagcagcacttaacttcattagcacacttactgtttccataaattttgggcatgtgagatcttttcaaaagtttacttttaatgaagaaactgatcacttccccacttttcctgtctttcatgtcgtcctatataaaggcacaacttaagctgtcatctatcaccaattcatagcttccaacattttcatttcattcgtaatcaggttttccacagggagatggcaatgaaggtgtatgggctgccaatgtcgaccaatgtagcccgcgtactggtgtgtttggaggaagctggggaacaatatgaagttgttccgattgatttctcaattgctgagcacaagagcccagagcatacttcacgtaatgtaagttattcttacaacttgttctctccattttttttccatcaattttcatggacaaaataacttccatttgtctgaacttttggatcaatcgactatgttgatttttcatgattccattctctctttttccccctcatacagccatttggtcaagtcccagctcttcaggatggtgatttaattctttttggtgagatttttttttcttcccaccatgcaaagtcttttttttcggagatgtttttttttcgcgagggaatgttttatttcttgcatttaccaaaatagttatgaaaaaaattaataagatagatcaatttatgatatcgcatatgtatctatcatcttatcaaaatattttttaaaaaaatattcataactattagataacaatgcaaagaaagaagacattccctcgaggggaaaaaatgctttcactacttttttttcgttcttgattatttttaatccatacaattttacactgtttcaacagagtcacgtgcaatttcgaagtacgtgcttcgtaagaacaactctgaactcctgaaggagcacaacctttctgacgctgccaaggttgatgtgtggctggaagctgagtcacaccatttcgatgagcccatgtccgtggtcatctaccaatgcctcatcctccctgtgtatttcggtggacaaaccgatgcgaaggttgtggaagagaatctggagaagctcaagaagacatttcaggtgtatgaagagcgtctgtgcaagttcaggtacttagctggagacttcctgagccttgcggatctgagccatttcccaactgcgtactacctgctggccacccctcatgctgctatgctcgatgagttccctcttgtgaaggcttggatcgatggcatgttggccaggccgtctgtcaagaaggtcatagagatgatgaaggcaactgcctagaaaaaaaataaatcgtgttgcttgttgtgatgatccttgtgatctctctaaaatgatgttgtctgagaggaagtgattgaataaaaacatggagcaggaattatgtttgggcggtttgcttcataagtacatgaatgtgttgctttgtgaatcgaaactccatggatttaagctaaataattagtttaacaactcaattccccaattctaacattcccagtgaatatgatggctgttcgaaggagcatctattaattgcacttgtttggatgttaaaaaaaaactattttagcaatcatactatcttgccgtactaaagatttatctccgcaatgatttgttttcaatggcgctagacctagtattaccgttgttttacaagtggtggcatatgagagcaatctttggtgtgcagtcggtgtcaaagcgctccatgaacttctatttaggtcagttggctcagctgctgacttgctgtgttttcttgcacgggtactatataaacaggatagcttcgattctcgatgtacctatatggcacaataaaccatgtggcttcatctattctttaccaaatcttgttttatcatggatgctatcaaatttaatacaattgataacctttttacttgctgtccagtggatcttggtgtgtgctcgctgtgtccttcctctgacatgaacagagctggtcttatatgtaaattgcatcagacatacctttaccctgtatctcaaattgcatcatgatgttcatcacagcagcaggatcccaaattgcataagacttgtctttgactcggtgtaaattcaacttctctgcattgtctcaatttgtacccaaaagcttttgttctatcttcagtgagtcaaattgcctgttctttctggttaatggatgaatgaattaaccggcacgattcttgaactcctaaccagtactattttttgagaaaaactttctatatacgaatttcttataatactgttttaaatccaattttctactttatagattcatttgtaccatcaaataattatcccaaatcattcatctattcagccattcattacaaaataattcatataattatcacaaaagaacacacaagctcttcatatttttcagtctttgtgaaccgttctcatccaaaacgcctgcatattattcccacctttgcaatggggtgttttgagttgacaaaggatttgtgcgatcagattagcaagatgatagcgaagtactggtggagcaaccaggagaaggacaataagatgcattggttaagttggaataaattgacattgccaaaaaatatggggggcttaggtttcagggacatttacatcttcaacctagcgatgctagccaagcaaggatggagattgattcaggaccctgactctctgtgctcaagggttcttagagctaaatacttccctctgggggactgtttccggccaaagcagacatcaaatgtttcctatacttggagaagcatacagaagggtctcagagtgttgcaaaatgggatgatatggaggatgggagatggatcgaagattaacatctgggcggatccctggatcccgaggggatggtcaaggaaacctatgacacccagaggcgctaaccttgtgacaaaagtggaggaactgattgacccttatactggaacttgggatgaagatttgctgtcacaaactttttgggaagaggacgtcgcagctattaaatccattcctgtgcatgttgaaatggaggatgttttggcgtggcactttgatgcgagaggatgcttcacggtcaaatcagcttacaaggtgcaaagggagatggagagaagagctagcagaaacggatgccctggggtctcaaattgggagagtggggatgatgatttttggaagaagctctggaaactgggtgttccaggaaagatcaaacacttcttgtggagaatgtgccacaacacgctggcgttgcgtgctaacctgcagcatcgaggtatggatgtcgatactagatgtgtgatgtgtggccggtataatgaagatgctggacatcttttctttaagtgcaagccagtgaagaaagtttggcaagctttaaacctagaagagttgagatccatgctagagcagcaaacgtcaggaaagaatgtgttacaatcaatttactgtcgcccggaaattgaacgaacaagtgccatagtttgcctttggcagtggtggaaagagaggaatgaagtaagagaaggaggaataccaaggagcccagctgagctctcacacctgattatgtcacaggcaggagagtttgttaggatgaatgtaaaggaaaaaagccccagaacaggagagtgtgcagtttggagacggccacccctgaactttgtgaaaatcaacaccgacggagcatacagtagtaacatgaagcagggaggatggggttttgtgatcagggatcagactggcgcagtccttcaggcaggagctggtccggcagcttatctacaagacgccttccatgctgaagttgttgcctgtgctgctgcaatcaagactgcgagtgaaaggggtatgtccagaattgagctagaaacagactcaatgatgcttcggtatgcgattcaggataattcctttaacctttcatccttaggaggagtgattcttgagattaaacatataattttgagctgttttcattccttctctgttagctactcgccccggagttgtaataaggtggcacatgagcttgccgcgtatggttgtaatctccagaccgtgtcttcctgggcaggctgcccgcctggtctggaacggctggtatccagcgattctgctggtttggtaatataaatctctcggtttccctcaaaaaaaaacgcctgcatatttcattcctcacttttcagagaagccacaaccacaaaccagcagcgtgaataatgtttattacggagtaatcactatttccatcagctgacaactttcgatactgaattactgatactcgttcagtctcctgcatacacattacagataagtactgtagtatttttgcatctatgtcatttctcaattactcctagtgccctccattgctgagcggtggaaccttttttttttttttagagaactctgagcggccaatctatccatcgttgtcctctgcgccagatttgggtgccactcgacttttgggtggtggatctatcacgaacagtagtaaccttctgatttgccttccttgaacctctgccagcttcaacttaattatttgtttctttccaaaccagcctccctatagatcagtagctgcaataaaattgtaaacattagccatgtgaaaagtatatcagaaaatttatcttcatatgtagcttcataatattgtataaatttacaatatccaccaacataaaattgtagaaattaatcaaaattactggtaccaggatggcatgtatgtgtaaacagtgtaattttcatttctattatttatacaagctctagttgaataatacaggttacctcatagcaggtagcaccgtggtagagcagattcttgactggaattcattcaacatggcaagggaatacgcgatgcagtgagatccaaacaacgaacagtctgaggttcacttcaatctgattcttgtctgtgttttcccactgttgtagttcattgttaggaaaaccacatcggaggcctatcagctggtgcagaactcaagtacatgatactgatttgaacaaagttttgaagtttgaattggaccagttgaaacctttaactccaaatggctataagattgaaccattcaacgagttaccttactttggttgatcttttcgctatctgttaacattcacttcatagtttcatgtgctacttttgacctcattattctctagcaattcaccacgtcacacagagagacctggccgtggtcctctccaccaagatttctccatactgtgcggcatgctagcattagcaagtcatgcacccccaatggcccttccagtgagatttagtgtacgggttgaattttcagaaatcagttcaaaccatggaaccagtatgcctcagcaccctttttcttcccaaaaccggtaagcaggagctttattcatgaaatagcactacagtcatctcagagcgaactcatgcttcaaggcacgtcaatgctcatccggcactgggccacaaacaactgacagattagcttccctctgaaacaaaccgaaacaaaaacccagcacatcctctcaggtacaggcagcccgcatgcttgacagttagcctgcaaatattttagcaaaataactaaatgccctgctccgaatactcgaatagaataaaatatattatcatattgcctaacataaattaaccatatcttttctatatggaatattcaccttaatttgattttatgtgtggctatctatttagattttgttgtttcttaatattgagaagttcaaggataacttacaaaacttacaataagagtagatggggtgggaatagattgttcttgaggcacccatgaatagatatgcatggacgtagtctcttgaaaagaataatgcagtgtgcattggccaatcagactgcccccttctgtagaatatgacagatcagattgatggtacagtggcgatgaccaatgacaaaagcatcaaacagatatctctggtactacctgtagtatctatagagcaggctggcatagtgttatttgctaaaatgtttcagtggcaccatactaattatgtgtcatatattcctcacttgtgaaagctgacaaaagctgacaatatgctgactggacacgatataactaggaactggtaaaacagaaattttccttggtatgacacctactgcctagtgtctggcccaaggtaccaggtcaattttccacttgcagatttttgtctataactgccactgaattgctatttacattatggtcctgcttcaccaaaatatagcctacaaagccacctattttcactgaggaaaattgaactccgaagtaaagcatcacgatctgcagtaagaccttcccatttttcaggtgcaattttgtgggacatcatccaatgtctcgctgtaattttgtgatgcagctctgcagcgtgaccattggaagtcattatgctggtatcatcttggtttcaacacatgactcatatggatttcaagtttccaaccactatggaaatagtagtggtaaccacatagcgaagttgtgttcaagttgctcaacaagttccttaggtgttacaaggcatatggttagccttcccattcagctaatcaaaaagtcgccatcattcttcattcctggtgtacacaccagagctgatggattaagacagcatgaagttatgtaatataggaaaaagcagaaaatcatggttagcactcctaaatagagatgtaagaaaactaactgaaatcttctttatgctatgctaattcatactttggtagtttgggcacatatgaagaacttgtcaaacatgtagagatggctgccgaattaagctgtctttataagttttgctgattcttgggcctgcatatcaatagacaaccacagtaatgagaaaaacaactcaagactagcacaataacaacatttagaataggaaacaccgaaacagcaatgtaaattgcaaattgcatacaggctagtcatcttattatcataaaattctgaaattatgttttcatgtaaaatcacataggataaatcagaatttcttttattacaatggaaatctctcacttagacagccacaccacaatagtagtggcatatttacaattagacattttaatggagttttcaagtacaatgattaaaatgattaaactttctaatatgcatgagcaaagggaacaaagctaaaaaatgttatacaaagacagcttctgcatcaatttttttgcacacaaacacatgtggtacgtgtgaacaggttgcgttatcatgtcagttacacaaattgcagtaaaattcagaagcacatagtacgtgagtaagaagggctctacaacaaccaccttactccagtggtgttagtagcgtggtgtacagtacagggccacaggggtacatctgaatcctcagaactttcgctagtatgccaattacataaccatattgtataaatatactcaaacaggagtcaagagaagccaatggaagaaaaaacaaaggccatattgtcatcccactgtggcaatccaaccattgaggcatctggctatcacagccagctaaccgcatcaagccatcgaaaagatccctaatttcccatctatccgtcattctgaagcatggaaaggttcaaaggcaatgcacctaacaccatgacacatgtagccctgtatcaagtgctacccccccccccccccccccaaacccacccctttcctctccaaaaataaaatagagtaaaattcctggctctgccacttactcacaagcaagttgagatacgctgaagatgagacccaaatcaagccacacaaacccaaggaaagtataatactaataataagaagggctctactgctgcaacgaaaattgtgtggtgatcatttttgaacttcgtaattcaaaatttcaaatggtaacatttcatagggttgtaatttaaatcacatttttttctagtacggcagtctaaatgaaatatatgtgaaaaagttaaggttagatagtttacaatatagggaaaaaatgcacaacagaaccagcacttctgtgataccataacagaaggggaacatgaataattcctactggcattgacactgagttagataatctaatagatgccaaaagtactgcaacaaactttttatatctcagtttttcttttatcctctgactttccagtaaaaacaattagtacttacttttcatatcctttacaaagtcagctataagctgcagatatccattccagttgatcttcttcatgagattctgccaatggacccagctcttcatcaaacgataacttagatgatgagtggtaaccttcatccttcatgtgtttagctagccttctcagctgtgcatttatattttctgcttcaggatgctgctgttcgccaactacaaacacatgaactcggctgttaagctcaacccagctacatccaggatctttgttaactcctcgaagtctcatcaaatgcctcaccctttcaacatcattccattttctctgggaagcatagatgtttgacagcaatatatatgctgaggaatctccggtacctaactccatcaaccgttcaccagcatatgctccgacatcaaaatctcgcaaagagcgacatgctcctagtactatacgccacaaacatgttccgtggtcaatagtaatggactctatgaaatcctttgcttccttaagcatccctgctcggctaagaatatcaaccatgcaagcatagtgatccagcctaggagttaaaccataatcttttgtcattaaactaaaatattcccatcctctgtcaactagacccatatgactgcaagcacacaatatattaatgaatgttatattatcaggtatagtgccctccatcttcatttcttcaaaaagatccagtgcaccattgccacacccattttgtgaaaaaccagaaatgattgagttccatgcaataacatccctatcaggaatccttctgaagacagacatgccatcttcaaggttcccacactttgaatacatcgtagacaaggcacttccaacaggggcccccaaacctaacccatatttcacgatttgcgtgtgcaattgtttccctggttccagtgctgcaatgccagcacatgctctcagaccactagctatagtcgatttactggggatgataccttccttgtccatcctggcatacaatgtcagggcttcctcgtgctccccattctgcacatgcccagaaaccatcgctgtccaaaggacaatgtcaacctcgtacaactgatcaaacccttcttttgcgtcagcaatacaaccacattttgcatacatgtccaccagtgcactcttcacatatatctgaacctcaaacccaagcttcaccatcaaaccgtgggcttgcttccctactgccaatgctcccaaatcactacttgcattgagaaccccaacaaaagtgaactctgttggtgtgaacccagcagcatgcatctgtgagaacatactaactgcactgtctgcctcaccattttgtgcatacccagtaatcatcgccgaccaagtgatcgaattcctctccctcgatgactcaaacacatgaaacgcagcacccatacacccagccttcgcatacatcgtgacaagcgagttttccacagatacaaaatccagcaacccatccttcacaatcagtccatgcatctgctcccccatcagcaaacccaatggcacactaactgcgctgagaactgctgtggcaacaaactcgcttttctcagaagggcactcttcgagcattagtcggaagagatcgaatgcctcctcggagcatttctctgcagcataacctgccaccatggtggaccaggaaaatgagttgcgctgaggcattccgtcgaacactctgcgagcatcagaaacaatgcccagcttacagtacatgttgagcaggctggtgcacacgtacacattggatacggcagaggggatcttgcaagcgagagcgtgggccgcggtgccggcgggcgcggaggccgcacgggcggcggcggtgaaggcggcagcgaaggaatggggcgacggaaggacggtggaggaggagagcatggagcggaagcgggagagcgcgtcgagcgggcggtggccggagagcgggttgaggagggagttccaggaggtgacgtcgcgggcggcgggagggatatcgtcgaacaccgcgaaggcggcggcgaggaggggccgggggagcgaggagtagaagttgatgagggagttggcgacgggcgcgtgggaggcggcgccggacttgagcgcccaggcgtggagggcctcgccgtggcgagggcaggaggcgcgccggcggaggagctcgatgaactgcgtgtgcgacattcgccgcgccgacgagggcgccgcggctgccatgctggacgcggcggaagaaaattacgcagttttttgttttttatcgactcgcaacagacaatgctacatattgacagagcattaaaaaaattacaatattacaaccttgtaagctcgtaatcagaaaaaaaaaataatctccacctacacactgacagctccaatacatagacccaggagaaagctagtatcagaccgaccgccgctagaccaacaaaagactatagtcgggatcgtccaaaactaacacagaactgtactctatttacaactttaggattaagggaaagagtgtaaaaaagaagataaaaccgttctccctctagaccattcgacatggtcaacttataagttagggcgtcatatacttggccaaacgggcggcacggcccgttaaggcacggctcctgtaacaggccgtgccgtgctcgtgccggcccacatgctaaggcctcggcctaagcacggctcaggaagaccacgggcacggcacgagcccaaatataacacacgggccggtgtaggcccattagcacgtttggcccacaaaatttgaatatgagaccgaaaactaaataaaaaatgtgaaaaaaaaatatgaaaaaggaaaattaaagggaaaaaaggaaaatatgtgaaaatattagaaaaatgacgaaaagtagtgggaaatagaaaataatatatggaaaaattgggagaaaatgagaaaaaatcggagaaaatagacaaaatatatgaaaaaaatagggaaaattttggtgggccaacgggtcgtgctcgtacttgagctgtgccggcccatgggcttagacatcagccaagcacggcacggcccacgagcgggtgtgccgtgtcgtgcctgggctggctacagtggtgtcgtgcctagatcggctgcagtggtgccgtgctcgggtcggcacgccttggcccggcccatttggccagcactatagcaccgacacaagaggaccggaatttacagctagcttgctccagttgtctaggaagtttcggcgaggggttacctagacgacgtctccagagagtggatcaacagaagcatcgccgccgccgtccatcgcggtctcaaatgagaaccgagactgggtttcacctggcagacgtcatagggatgttgggacgacacgacaactccctcaagagggaatccgacgctcgaaaacgcctccgttgccagcccagccaagatcgggctaagttttcacccatagtagtaaagaaaatttatctatttgaactttcaaattttaatatgaaatattatgggaaatgtaaatcgaaagtgcagtttcgtcttacggcacgacgcccgctaaaatcgtccgatgaaagtatcacatacgcgggtacgtagtactaaatttatctccacgtttttgatcttagagtcaaatgtgagttttcgtaactatgtagtactagtatatttaaaatttttggtgacttatatatttcaaaccatatattattttttaaggtctgttctactcaaaatatatgataaaatgagtaaactattgaaatatttaaaaataatttagtcaaatggtagaaataactaagctctatagtggaagtaactttttataacattagaagtaattacatatatgtgttaaaagaaatatcttcataggtaaagtgtagattcacaagttgtcgacgtttgagatcgtgactacggtatttgcatagtatggggattgttgataccaaggtatatgtgagattgaggtaaaagagatggagacatggattttatacaggttcaggccccttatttgacaggtaatagccctactcttattggccgaaaccggtgttgctccttactcatatggatcacacaagtacataattcgggataacctatctagttgtcgtcgacttggcggcatggataaccaactcgtagtcaacgacagggtaattttcctcctcgaatatgaactcatcgagatcagagatggtgctagatcctttttggcggcctccgtaggcaccagatgaggtatgtctaggctaatctctgatgttgagatctggcgatgtgtgttggcttgtgtatatattgtgtcttgttgatcttgtggcttgtcccctatccttctagggggtcttgtatttatactcatagatgtccctttgtccaagtagaattagggagaccaatatggatacaatccacgtagtccttgtcatttctatatagaactctatttgtctttccttatccggaactccttctatatacgaggtatgattccgtataagacatggtatgtgatgggccatgccgagtttagtcaactattattaggtatgtagcatccataaccatgacacaagtaaatacatgacttttttatccaaggtaaaccatatgtgtatacatatatatagattattgttttcgataaaagtaatttattttatataggaagtaactctttagaaaatagaagtaactattcatagtattaaaagtaattcttcataatattaaaagttggtacactcctagaggaaattaactggaaaacagaactaaccttttatggtgttagaaataactaaactgctagatagaagcaactcttcgtggtattaaaagtaactatataacaatgttatagggaagtaagtcttcataacagcactgctacaaaagtaaataacctaaatatattcaatattgaacactttttcatatattttcagtagagtatgatggtttgattggatattgaaaacaataaacgatttaaaacaggggcgacggagccaactgaaccgccgcatcgacggcgacagcagtggcagggtcacgtgtgaggaaggagattgcggtggcagggtgaggcacgctgcggtgggatgatggcaaggatggcctgcgccacaacgtgtcaacgtgttgagaaaggagacggcaatgaggcagccgccaccagcagtgccacaaactcaccggagtcgctgactcggggctatggaggggtgtggatgaaaacggagggaggaagatgtttcacggaatatgggacccactattattattattactcccttcattccaaaatatggtgcacaaccacccttaatccaaaaactcagaaataattaatatcacatcattgttatgaatcattccaactaatacaatgcatgcaaccaatagaattaaagatattgtgagtgtaggatttaaaataataataatttaggggagagaatgtgataattaattacatgcatgcatgcacacctcatattatgaaacaactttataaagtaattgtgccttatattttgaaacggggggagtattatttctatctagaatgccacctaagcgccacgtagaataaaaccatctagaaaaactccttaggaatcaatttgcattggttttgtaagatggaggaggcattatacccggtttacggttgagggatgcaattcaatcgagagcaagagattaaggaggcaaaatagatttattctgaataggagagctgataaccatcctaccctcattgattttcttcgttttttgaatttttttttttgcattctcgaggagatttgcacgtgtttggctgtttcgcaaaaagctccgcacgtttgcacgtaatatctcatatgtcacgcttgacgccccgttgtaatttatctggaaactccttgtcttttagagaaatacaatgcgaagaagataaaattccgcttatagggatagcactgtaaacatgaaaaacaaaggggcttttccgaaaaaaaaccaccatctccaatctccccccgtgcactgccgcctcccccgcgcgtcatcaccgtctcctcgcacttgtgcacactcacacgggcgccgcgcgcgtggcacccgtcagagtcgtcatcggtgccctctcccttctttttctccctccccttgtggtagtggtggcgccacggcgggggtagtgcggatgtggcgcccgttagagctgaagccgtgtcctccttgtggcaacgacggcggcgaggggacctgcggtagtggggaagcgcggactcctactaacagtttgtagtaggtgggtcagcgcctctgttggtcttagagtgataatccaattaccggccatataacttcctaagcatcttgccaaacactggagaagtatttcttcaagtatttcccattaattgctctctaaaatcattctccttgcaatgtacatgtggacttggaaataagctttacagtctgcccatttttattataccaaaagcggtagctcccctattcataataggctgacattaatgtggtcagacggtcagacctatcaactatcatgccaaacttcaaaattcttgtacaccgttgtaggctaagcaactcaggctgtgtttaattccacgctaaaattggaagtttgactaaaactggaagtttgaagaaaaaacttctatgtgtgtaggaaagttttgatgtgatgaaaaagttaaaaatttaaagaaaaatttgagaactaaactcggcctcagcatcactagtaagctttacagtctacccatttttattataccaaaagctagcttcctggtagctcccccattcataactaggtgataccccacgctttgctgcgggattcacggatgagtatatgttaaatattgtcgaaatgatgaaagttgaaatattgagaaaataatgtgaggaagatgatttgacacatactggttgatctctataatataatattgtagatgatatgccatgtttgcatgggatttaaaataggttagaaaagcaattgctagtgagtgaagatgtggcatgcttgtataggattttaaatgggctagaatagcaattgctagtgggtgatgatgtggcatgcttgtatgttgagctttagctttagtgggtaccaactatgtagaaagtatagacagataggctgacatgtcgcactccatctcaatgacagagtattcttctgagtcaacatctaacccaactatagaacctctcttgtactcctttgtaacatcaagtaaggtcacatatcatgtgactttaatctctatcttacgtaaggtgttctgatccaacctgagaattttgagacaagacatgcaatgattggctggacagagacgactgccaccgatggtggcgacggggacgtccggcggaggagggagaggagatgggcacggcgaggccacactactacagaaagcgtttttgcatacgggcggaatcgatcttcacatgcggttggccggcccgcatgcgcgaaatggtctgcaaagatcaccatttgtgcatgcagccggcccagccgcatgcgaagatcgatcttcgcatgcggtcacttaagacggccgcatgcgaaaatagatctttatggtccatttaagaagccgcatgcgaagatatattttcccatgcggtcgacttaacaagaccgcatgcgaagatctattttcgcatgcggccgtcttaagtagaccgtatgcgaaattcaatttccgaatagctcaaataatatttattctagccttttagtgaggtgtgtctcgtaattaatattaaattattgagggatttattatcatatttcggaatagtaagacaagtgccgcagtaacaaacatgtaatacataaccataaattcaatcgtaatttacatacgaaatatataatacaggtgccacagttttttcatcatatgtataagtagtgtacatgtcattgcatatgttctttctcccactctctgagaggtttaaatttgttgtccattgcgagttcactctggttgtcatagaagagacctcttgtattgcagacatcgcgcggatgaatcggtagaggtcagcggccacgttcaagatcgtagtgtcgttgaatcgttgtgcaatatatgggatttcggggatctacgcacagaaaggaaaataaaatggtactcaatgagaagtgtgtgctagatgggtttctgtgtagagaagagttcgtttacttactcggttaccgattgttttgtacctcccatttactctgagcatctcacacacgtaataaccgcacaagttggttcctggtggttgtttgtagcactgcgatataattatgggggaccgatctcagtagatataatttagtatatatgtattgttcgataattagttgtattggtatagatttgatagtaccggctagctagtcctgacggataacttcttctgggatggaatatgtactggtccacctcttttgcagtagtacttgtgtgctctgtttgaagaaaacaattgttttatcagtagttagaagactggcgatcgacctaaacaatttatattaatgaaatgtttatcacttacaaattcaaaatagtgaggaattccataaatgtctccttgtcatagtgtgcggggtccaatgatatgatcaattggtctttctgatatacaaggaataatatgtagttgtctctgcatataagataggcttattggagacagaaaattccgaagaagataaattaattaaacaaaaagaagagaaagcttacgtgaacgcgtagggggccattaagaaatctttgtcggtgtgcgccaacattgctattgccaagtatgttgctacttctagcttcttcctcttgtgcaatgtcttcacatattcttccttttcttcaggggtcttgccaaccaattgctcgcagtcctctctcagctctacggtgtgttgtgttttgcatattcttgttggatcgacgtatccaacctttgctccagttctatcagcttcgtggaattgcatactgtacaatgaacaaagaagaaatgggatttggtttatttgtttggaatgatacgtgtaacatgtaataaagagttcagacttacagacagaacgccgcaacgagattaacgtccattttatctagcttgtagagggcgtaaaggtctcggaaagagataaaaaatatcccattaggaccactcatgaaagcgccttccgggatggcgacgcttatgaaactgagacctttcctagatgccttcatataccattcgtgcattaccctcatttcccatggtagcttgttcataagataagttggcaagaatggctttgccatactcataagtgtcaagcacatcagcagataaccaggattgcacttcatcttgggctgctaatactgacttctaggagtctgacaagatgtgagcaagttcttttctcttctcagaattcctgaaagctgaaaacatgaacttctccttatccttttcaatctcctttgggtcgtatgtggatatcaactttggaattatacgacgaggttccaaaggattagacttcggttcggatgtggtaccttctggtatgtgcacttgttctaccagagcagattggggtgtaggtggagaggcttgaactgagggcggagccgggggagcatgctgtttagctagggaggtgggagaggcttgaactggttgcggggccgggagagcaggctattgataaggggagggtagtggtttaggttggtgaggcggtgacctaagcagtggtggtgacgccggatgtcgaggtgacggtggttcaggaggcgacggtggtgcaggagcggcagctgtccttgcctgcgatgaggatggagttgaagatcctgctgctggaacggccgcggttaggattatgtctctgcggtgccacaagataaactgattcactgcatcaccgagaagttcaatcccctcaggtgcaggtatgtctagttccaaggaaacgtggtcgctatggaccttggcgacctatacccttgcgtaatcctcagggaatgccgtgttgtggaattgacgtccgggtatcgctaaacccattgcaacctccttagtctttccagcgcggccgattggtacgacgagactgcagggagttggtccagttatactatccacagggaagggagttgtctgcactgagcctacactgctgggtacattagttgtttgctgtgcagattgtgtgggttgttggccattagggaataaccttggaaaggctgtcgggttttcagctgccaacgagtagaagtgttccttcacttgcgcatagattttgtctgatagttgttctttgtatttgtctctcttcttataacttggtgcgtcttatggaaaccctatcttccaactcatctttgaggacaaaccacttacacgtccagagtgttcggcggtccccaacgccgcagtaaagctggtctcgctccctccgtgggacgaactgtcctgatctttctttctcgactatctgctgcaaattagtagtcacttcttctatgtctggagtctcgaatagtatgtctccctcatccgagactttacctgtgctgcgcacccaaacccagttcttgctacgttccaccatggggtctaccagcaggggtttgccggccgcggaaaatctttgctcgatctcccaccattgatcgacgtgaccagcgtatccgctcgaccccaatctatggggatatctgttcttcttcgcgagctcagacatttttttcctcaaagccaatgcttcagctattatatgatccgcaacaaacgtatcccagtcagcctgtgatatatgtccataatccgtgaacggtgggagattcttctgaacataatcccgatttagatcggacttccactgtcgccatcgatctcccatctttttaagtgtgtaatctctccccctgacctgtgatccaggagggaacacaaaatacttctgcaactcattccagagaagtgtcttgatgttgtcgtccaccgtttcccacaacttgacattaatgggacaacgcgtcctgactagagtaccacaggcgttgctaaacttggaccgcactatcggtggctcaacgggcttcccatcctgatcgagagcaatcacgttgtatgtttccttgggtaatttattcttgcttctctcaccacgtctttttttcccactcccgcctgcacttgtagatgtctccgtatgttcaggtgcagacgtagcggtgtccatctcaacttcttcctctctcctgttccgagcggctttacgtttcgagcggcgtcggactaccatctgcagaaaataggtaactctctacaccattagattcatgtcacatcatagttaggaaataatacatggctaacgattttcagcacttacggcctgttccataggtatgtagtccggatcatcatcgcgaggggcgacttgtgttatttccattggaaacgggtcacttggtgtgcaccacgtttcttcactagaagcgtcaggctgcttgttgctaccggatttttgaggagcgttaccttcttgaggcgctattggtgcgttcgatggaaccttatcgttcgacatcttccaacttgacgtaaaaaaatttgacataagtcccaatttaacataattttacataagtcccaattacgtaagtcccaatttaacataagtcccaatttaacataagtcccaattaaacataaatctcaatttaacataagtcccaatttgacataaattccaatttaacataagtctcaatttaacataagtcccaatttaacatcagtcccaattgaacataaatctctatttaacataagtctcaatttaacataagtcacaatttaacataggtcccaatttaacatcagtcccaattaaacataaatctcaatttaacataagtcccaatttaataatccacaattaaacattctcaaaattaaacaatccacaatccacaattgcacatttcacaatccacgatcaacaattaaacaatccacaatccacaattgcacatttcacatttctttttttaagggaaatgttaccgggggactttggaccggaggagccggcgcggcggcggcggggaggtattgccggcggtggcggggaggacttggcggcgacgacacgcgaggggggagagatcctggcggcggcgacgacggcgacggcgagaggggcgacttcggggaggagccggcggtggcggggacgacttggcggcggcgacgcggcgaggggggagaggtcctggcggcggcgacggtgacggcgagggggaccacttcggggaggagccggcggtgacggggaggacttggcggcggcgacgacgagggggctggggacttagaaaattttggcagcctagcggctagggttcgcgggcgccgggacttagaaaattttggctccccgcgctccctatatataggggcagatcatcgcatgcggtcggcttaagcggccgcatggaaaaatgatctttccatgcgggcgacttaagccggccgcatgcgaaactgatctttccatgcgggccattaagccagccgtatggaaagatcatttttccgtgcgggccgttaagccggctacatgcgaaaaagatatttccatgcggctggcttaactcgcccgcatggaaagatctttttaccaaataaactcatattttttctttcgtctaaataaactgtacatatatatttttttccaatatttcggtacaacaaaaattccaaatatttttggcagtaagaaaactcatgaaaatcactcaaaactcgtaaccaaatgttacatgctaatgagtacaacataagggggacttaaattcatgcacgtacatttggaacacaatgacaactaaaggttacaaaataactatgactaaataaccttggcaacaccatctgctcgaacgtacgacatattcgctttatcgattgtactctcaaccttcttaattcgcataggaagatcagtaaacaatgttacatcgtcgaactggttgtaatcattggggtcttcgatgttgtcgatgccgacgatctgttgctttccagatatgacaatagtttttctttcatccgaagggtccttcacataaaacacttgagccacacgctctgctaaaacccatggatcatccttgtggcctgttttactgtgatcgactatggttaccccgtagtcatcaacggaaacccctgttgtgtctttaacccattcacaacggagcactgggatttggatattcaggccatagtccagttcccatatttcctgtatggtcccataatacgacttattttcaccactcgtgtcaatcgtttcgacacagattccactgttttgtgcggtgcttttcatgtccttcgtagtcgtactcaaggtaaatccattgatgtcgtaaccttaccatgaattgacaatacttgaaggcccacatgccagtctttgtaaagtaagttcctccacagaatcaccaactggcaggtttagatctttgaaccacagaggaaagtgatgcttgtgctctcttgatacccaatcattggaccgccctaggaagcaggctttgatttcttctaggtgtcgctcaatgaatggctcaacgatagcgagctgttaaagaacattgttgtgtgccgcggacacctttttgtaatcattatcgaagaactgcttcctaccaacaataccccttccagacaatctcccttcatgtcgatgaacaggaatcccaatggcattagcatcctttatgtagtccatacaacactcgactgcctcttcagttgtgtatccctctatcattgatccttcggggtgagcacgattgcgtacatagcctttgaggatcgacatgtaacgctcataggcccacatctgatgtaagtataaggaaccaagttcaataatatgagggacgatgtgaacgatcaaatgctccatcatatctaaatatgatggtcggaaatacatctcaagctggcatacggtctcgacggcaaatgtctgaaggggacctaattctagaggatcaaataccttctgcgaaattcgattgaaaaagtagcacaactttgttataaccaccttggtatggactggtttgactgcccttatagcaattggtaggaataccgttaacaacctatggcagtcatgtgcattgtatcccagaaatggtcaaatccttcactgatactagcttcctgatgttcgatgcgaaaccagtaggcactctaaccccttgtaaacatttacagaaggtttttttctcttcaagtgtcaacgagtaacaagcaggaggaatctcggtcttcccatttggcagcactactgggtgaaggtcatgccgtatggccaaatctacaaggtcgttacgtgacttcaatccatccttcgtcttactcgggatgtccagcaatgtgccaatggtgctatcaaacacgttcttctcgaggtgcatagcatgaattgcatgtcgaatctctaggtccttccagtaatctaagtatttgaagaaaattgagtgcttcttgaaaggcgacgcagtatctttgtcaccatcagctttcttcctctttactgtcttcttctttccctttccatatacaaccttaatcttctttgttatctcatacacgtatgtaccacctcgtgctgctggggcagtgtcattctccactgtattatcgaacaatctagccatcttacgatacatgtgtctttgtggtaggaattgtcgatgccgcatgtacactatcttcaaagacgacatcaggtatttgtacgaagttttctccaaacatatcagacatctagtcttccctttaatctgcccagataatgaaaagtttgcatgtaggtcattaatggtaacgaatatgatcgcacgtagattgaagtgctcccgcttaaactcatcccatagtcgtaacccctctttccaaagctcctccatgtcctccatcaaaggctcaaggaaaacatctatgttgattccaggttggtttgaaccttgtatgaggatagtgagaagaatgtactttcgtttctgacatatccatgttgaaagattatacattgtgagaaggactggccatgtgttttgcgagctgcttaagtcaccaaacgggttcattccgtcagtgctcaacgcaaaccttacattcctgggatccttagcaaattctgggtgttttgcatcaaatgtcttccactggcgagcgtcggcgggatatcgaatcataccatctatcttccggctctcttgatgccatctcatcaactcagcatcagtcgggtttgagtacagacgcttcaggcggtccttaattggtaggtaccacatcaccattgagggaatctttccgcgcttactcttatcagaatctggatcggtacactctgaatctatgggcccattccctgttttataccgacttgtgccacacgttgggcaactttccaagtccgcatattctttacggtataatatgcagtgatttttacaagcatgaatcttttctacaccaagagataaaggacatatgagtttcttcgcttgatacgtgtttgatggtacaaagttaggcttaggaagcaacacacgcaacaaactcatcagatcattaaaacttgtgtccgaccatccatgtttagccttcaatcttagaagttcaagcactgaacgcaagattgtgaaatccttatcacatcctttcgtttcgtcgtaaagaagatccttcgatgccttctctaatgcctgccaattctccaatcctcgtgacctacccgctagcacctctggttcaacatggcttagcatatcctctaaatcaaaaccaccctcaaaatcatcactatcggtggaaacatcgacatccattctttcactggacatgtcttcgattataaaattctctgcctcattcatctcgaaacataactcttcatcgtcatcttcgggatcggcgaattccccgtgaaaggtctaaaccttgtagttggcggtgaatccgtactccattatgtgacccaatatttcactaggatctaccaacaatttctaattcttgcaatgacggcacggacaaaagatctttgtcatattctccctcaaagcatgtgccttagcctgatcaataaatttagatgcttcctcaataaatatcggctatgttctccgcatctcatacatccatgacgaccgatccatctatttatataaagacaaaaaagttacagataaaaaaatagaccacaggtatttcatataaaagtttaaatgcatttgtccctccaaaaaaattacaacaatacatgtaactagtatgtacaagtgattacatgcaaaatttgcccatcaaaacatatattttgaagctagattttgcaaaaactagctagaacaaaccttgtcaaaatattaaaaaaactccactttccaccaacgaaatataacagaaatggagccaaatgaaggagagagagttattcacctttcgtatagagttcaagcaaaaatttcgagttgaaaacctcccccctaattggtgcttgctttaggagagagagagagcttcgttttcaaatggtcgagcttgggcctggaggagcatatatggccgatcatcgcatgcggtcccttaagccagccgcatgcgaagatccattaccgcatgcgataatgggcctattttcacatgcggccgtcttaagcagccgcatgccctaatacatgcggccccttaagacggccgcatgcgaaaatagacctattatcgcatgcggctgtcttaagcagccgcatgcgataatggatcttcgcatgcggctcatcgacctgcccctaggggggccgtttttgcaggcgccgccacaagcggcccacatggaacctaccaacccatggtacagaaaaacgattttttagtagtgccagccgccaccgccacgcgcgacagggatggcaagaacaatcagggcgagggaggtcatcgccaccaaggacggacgacaagatgatttttggttcgatcattttgtcaggagatcaaaacaaatcccgtaatcagagatgggcaagatggtccattcgctcagccattgcacactccatcacagtgaaagaaaacggaaaacgggagagagcgacggaaacctctaaacaggaacagaggaaagatttgggtgccatctatctattattatatactaaaattccactaaactttttacaaacgctcttaagatgtcacgtggcgctctaataaattagagaaaatcctagaaattctaagaaaaaagcaaaacatctacccctttattttcacttaaattggtgggtccaatattatacaccgttagataaaaatgatcttaaaataaaccaaatactataggcccaacctctcctcttttttttctttgaccagggtcccacctctcctctttatgcgtgcataggtaggtcacgtacatacatgggtatgtagtacgtacgcctccctcccttttgtttccttttttttcttattttttctatttatacaattgatatatattttttaataatcataattttacaaacaaagaatataccatcatataactctttataaacacacgtaaataaattagctctataatctttgaaaataaaatttacaacatattatatgtttacctagtaaatcaataagatagtttccacttaaatcggtgtactcattactttgtactattattttcaaataatgcactattttaaaataaaatttacataattatattgtgtacctattaaataaactatttaagatctatattaactaatatatagatgcacttaaacagataaatccattatttaaatcattggatctatttttttaattactttggactattattctcaaataataaattgttttaaaataaaatctacaccattatattgtgtacccattaaattaacaatttaaaatatatattaactaatttacatttacactagaaccagtggacccattatttaaatcatcggatctattgttaataactaaagtgtctaaagttctctttttggcccgctgcataatgcacgtctacacctttgcctttcggacgtgtgacagaatgtcatgtctgaggcatctcaggtgatcacgaccattgtagtgctaccgattttgttaataacatgaaaagaaaattaaaggtgtgatgccgtgagagaagaattaagcaccgtgggaacacttagctctgtttaagccaaaatcgagagttgattgcataataattataatgtattgtgttttgatgtattcagattttgtattatttgttcgtacaattgaatgaaatcattatattataaatgtgagcacaatattaacgaatatcaatagaactcttactaggataaaagtgttataagggagtttaaggccctatattttccttgattccatcttttgggttttcgtttgcatgctccacgctttccaagttcctaaatggtgcttttcttaaataactttttaactttttagaagttaatttatttgtttataatctcaaatagctatcacataaatcagataattcatcaatttcagttgtcctaaactctaaaccctaagtagtacatatttttttcatgcgagtcatggtgatcagtaaattggttatcaacgcataatcaaagtcgtaagatgaacatataagagctaatgtaaacaattgtaaataggtgtcaaaattaattgctattaattagacatctaatggcttgctagcaacatatttaatttctctctacatgtatataaacatggacaaagctaaatgaatattaacatatatcccatacatatatattatatggttaatattctaattacatgtggtaagtccattaaaatttcttaaaataccataagctgtcacgtggtgctcaaataaattagagaaaatattagaaattctaagaaaaaaaacaaagtatgattttcacttaaatcgatcggtccaatattataaaccattggattaaattgatcttagaacaaactaaatactacgaggtcccacatctccaccttcggtacacacctacatacgtaggtacctactcttccccctccctttttccatttttccctttcttctttttctccatgaatacgcttccctctctttcttactgtatcatgcaccttttttagatgatttaatcacaaaaattttaagtatcttgctctcacatttttcatttgttatttactcaagaactacaagcaatagtttattatttactcgagaaaaaaatatgattcaaaagtcgtaagtacttaatccatctcctactcaaaagtttgtgaatggatttttaagataccttaagaaaaatagaacccttaaattattacaaaataacaatatccgaactttagtttgcccttaatctataagataaaacttttgaacaaacagtaaaaatcttacttttcaataatacaagtgcccgtgcatacgcgcgggccaccttcctagttaaagtaaacggtgaactttcggtgctataaatctaaaaacgtaaacttttgatgctatataatcaattttgccttaaataagatgtctccatataataaacgttcataataaaaaaaataaaacaacattaaataacatactcacgcatatacgcgggctaccttctttgttaactaaacagcggctacaaagtctgagatcgctaggcatcagcaagagcacagagagagtgagaagaacataattgttcatactggcagttgagcttgagagacaataagaaacagtacattcgagagtcacccctgctttgctactttgccttatagccccatttattcgtcgtattccagcaaaatagttgtcctttgttcctacaaatccaagaagtaaatagatggtcaaggaacacgtagcaatcatgcaggaactaggcatggaagaacagcatagccaggagacttaccaaaagtcataagacagcaagcaaaaagatggtggatgaggctgtacggagccagtctgtagccttcctcgattctaccctcagcagctgtcgacagggtgccacttctaacatggtattgtgcaaggaatttcccgtggtgcctgtagatgagagagccatctgcaatgccaggaacagccttcgaggagacacacaggctcctttcatccatgaaaatggtgtagtccccaaatcttgttaacgggatgaaccttcccaagataatgtcagcaagtctgtaaaccacggcctgcgagtacgagcgatcagtgtgaccgatcagcaagacctctgattcacagttcaccagataagcgaacccaaacagcttttctactggacatgtagcaaacaattttggttctggtagggaaaaagacgaagcagagccattcgcctccacccggggtgggtctatcacgaaaattctgtttggagagaagtttacccatattgatgctgcataaatcttgccctggaatgccatgtatttccatgagaggttggtctgccaatttgacaaggtccattgctgatccgcagaggtggcaaaggcaacgcgctgtactctggtaacaacgaacatgatagtgatgactccgtcagggccgaagctaagagcagcgcaaatacgattgaaatatgagaatatgcccatctcttttcgctccatggctctcatataagccaactcagtgctggtgaagaagggctcaacctgcggccgtagggtctccagggatgataactcaacaatgtcaccggtgaaagggtggaggatacggatagcactgtcccgatcccgctgcaagaggaggaggccatcgaccgagtcgatgacgaagtgatccgggaagaacgggaggaggagacgcgcgaaggcgcccgtggagacgttgaagaagcgaaccctcccgtggagcttgcggtggccagggaagaggccatggctctcggggaacaagatccaccggcgcggatggaagcgcgggtccacgacgctgcggccgcgcgggctgacggtgctggaccgccaatggcggcaaacagcgcggagccggaggtaatccgccacgtcgccagccagcgcgtgctcggcgacaaggcggatgatatctccatccagtgacgcccagggagactccatccagggcgcggcaccatttggggcaacggcgccgaccgtgcggccgcgcttgcacttgcgagggattttgcgccgcggcggcgacagagcgcgcttctcgcatcgcgccggcgacatccgtgattcccaaaatacagatatggacagtcaaccacacacgatgatactagcaaatactccaaatctcgcgtaaattaaagaagagaattttctgctgcagaatcggaaaacgaggccgaagcgtaagctgatttgacttaggctgtgatcgagcaacacggaggacgctgccgattagagcacgccaacgtactgtcattccggaagattagtattgtcatttgccagcatttagtgacggtcacagtcacgcaatagcaattgcagcgttttgagctttgagagttttatgaccacacatgaagattaacagttagtaaattggagcaaaattcacctacaagcagtagctatctagcttgcatataccttggcttcacagtgtattacactccagcctttgatggttgcacgcttttgctgttcttcaattctttctcagcgatggttgattcataaaccttgtccaagttggagtctttaaccaagaaaggccttataaatttggccacgaagtcttcctctactatggtggcgacgttgatgaaatccctgccgcgccacagccgccaagcctgcaccctgcagcacgctgaccacccggaaccgcgcgcggcacgagcctcccgtccaggtattaactgagcatcaccgggaagttggcgacgcgctcggcgtccatcccgacctccttggtcaggaactcccagttcttcctcagccgctccacggacagcatcagcaccgtcggtatcttggctgccgccgtcttcacctgcgcctccgtccacccgagctctgctcgtccctgaagaaggccgccttccaggcgagatgctccggtttcaagaggaacgctgcgacaatgacgtccttgaatggtcgcatcctgcgcggcaccccgaactcgtcggcgatcactaggacagccttggctacatctggtgctgccacgagcagcttggaggcgtaggagacgcagaaccagccgatgtcgtcgttggtgaggcctcccagtcgacgcagccgcggaggtacccgagccagaactggacattaacgaggagcgtcggtgagcggaagaaggcggcgctacagcgcgccacgatgaggtccatctgtaatgtggtgaagccgagcacggctgcgcagggcttgagtatcttggggacgctcggggtttgcattttttatttcagccaaaatttcggtgatttcggtaggatgaaatttacaaaaatttcatgattttcggcactttttagatcagaaattattaaaattataacatattttgactggatttgaataaactttgaccgaattcaacaaacatttgataaagtccgaaaattttaattgatatattgattttgctggaggggtccgaaattagagaaatttcgaactgaaactgcaatcactggcgacactgcaggtgagaatcttggggtcgcgagccacggtgatggcgatgaggggcggagagagcccgagctcttcggcgaggaatgcaagcacggcgtcgggcctggaaggtgacctgatggtggagagctccggtgtgacacgacacattgaggtagaggttgcacctgttcacgaggtagtcttccacggagaatgaggacgaggctgtggtgttgtccgaggatgtggatgcggcgacggtggcgtaagaagatgccgatgaggtgtgggggaggacgagggttgagagggacggcgggaccacagggccagggaggaggagcatagcggcggcggcggacgccagtgaatgggatagatggctggcaagcgatctgaggctgacactacttaaaaaatgattttcctggatatggacccatttagatttcagacggaccataacggtgttcccgtctgggaaaataagctcatttacacgtgcagtccatttaagagaaccgcacggaaaaatcgattttttccatgtggtcctcttaatggactgcacgcgtgatgagcttataaacccggg

SEQ ID NO: 60437 - DNA, 8903 bp, Oryza sativa
gtactacccccatcccatatatttgaaatttttcagaaatatccacccaaagtgctccagcaaacacagccagggaaaaaaaaaagagagaactttgttccgcaaatcaataggcacattatgaactcctaacagggtaaccaagttctcttaagtagactttgaacggatgaaatcaagaatcgtatcatgaactcagcaggatttcacctcaccaaacttgacgttatacctttggttcgatcgaaaatgtattgatcacccataaaggagcaggaaagatgatgtgagcgaattgaagagggagattgatcacccatagaggagcaggaaagatgatgtgagtgaattgcaacgcacgggtgtggagattatgggtaccccatacccacacggcatggttatccgactagttataggaaataacttttatctatgtaatatgtaacagatcatgacttgggtattacgtttccttgtatattacggaacggcctaaagttctggtttgataatattgtaaagtagatttaggaaaccgataccgtattggttaaggtttctatcttgtaatcctgccccccatcctatataaggtgggcaggaggccctctagggggcatataagacaactagatcgtcagatctatatacactcggcggattcaaatccccaaacaggtgtagggtattacctctcattgagagggcctgaatctgtctaaatcctttgtctcggcatccatccacttttaggtctcgtgcgctaccccttttattattgccgaatttatgtttcaacagttggcgcgccaggtagttgtacgccgagtttcctattgaggagtgcgatggaatcaattttatgagtcgccagcttcgcctttgcctcaggagctttgacttcctcgccatcgacaacttcaacaagcctcgctctttgactttgattcaaatcagtcggggaagatctaatctagctaaggaggataacaaccactctaccacggcgagtttaagattcgatctactatggccgccgccagcgtcaccttcgtcagcacgctttttcgcttcagagagaaactttatcgtcaggagaataaccggatactactgttaacaggatcgtcgatagcatgggccgcgtgccttggacgatacacggcatgctacaaagtttgcagtcctgatcttgcaacatatgtggtgtacggttggctacgcacgcgcatcatggtctggctgactacttcgatcgccaaacagtccggccagcatctttcctcgatctcacagcgacataatcaggggcttcgtagcagctctcttattacatgcatctactcatcatcaccatgtattgcatggctgcctgctacaagccaaccaatcaagattccttaatctacaggctgctaccaacaatcgtaggcttgatctactggagcaaatacagatgcatgcttgcacgttcttttatctcctaatcagatatgatttgtatttacatgtccgactatgcgacagccatataacaggcacgttgtttccgatatcactgacacgatcttcatggacatggacttcatcgctgactggtttgttcgtcctcatggccagcctactacgctgctactgatagcaacatcatcttcaccgactggctcgcctccgtcgccgctgccgactggtttctccgcctacacggctggcctattatgccgccgttgttgggcgtttacgacttcaccaccggcctgccttcgtcgccgccgactggtgtcctcgtctatacggttggttggtcacaccaccgttcatgcgtgtccacgtcttcaccgaccggcctgcctccgtcgccgccgactggtgttctcgcctatacggttggttggtcacaccaccgttcatagctgtccacgtcttcaccgaccggcttgcctttgccgtcgccgactggtgtctctgcctacacggctagcctattatgccgccgttagtgggcatcttcgctttcaccgtcgaccgccttcgtcgccgccgactagtgtcttcattgttattgatggacgactttgttcccacattggccacctctgccatcaccaggggaatattacaaagctaagtcatcattaattttttttatatgatatttttttcctctgcctcactacatcaactggttcgccgttgactaatgagtcgggggctacagatgttatatcgtattttttaaacaattttcataatatttatcttgattgcttgcgacataatctgagtacaaaagtacctatcgagttatggagttctatcttcctatgctttccgtttggtttgtcgatggatagttgcctttgggccgattcctagcacccgggggctcgttggatggactgagtaacgcaaggttctaagtattattcagaataaatcaaaagcatagagataagataaatttattttctgctctttacaattgcaaaagtacccgagtagtaaattatgattcgtgaaactttattccattaatgacaaactcatgtcactcatatgcatgtttgggaagtgcctaggctgactcccgatgcttgggggctatgactagtcggacagagtgtttaaacgtacggagtcatctgctcggggaaatcaaaattgacaagaggagaaatacatatttataaatattttaaaatacttaaatttttctcgagtattatatttacatcagatactactcatcctatatgtttgttctgcaggatccagatccagatatgcataatagggattcatggctttcaaagcttatctcctacgcttcagaaatggatcagtcagaacatcaccgaccggcttgccttcgtcgccgccgactggtgtctccgcctacacggctggcctattatgccaccgttgttgggcgtctacgtcttcaccgaccggcttgccttcgccgctgccgactggtgtttctgcctgcacggctggcctattatgccgccgttgttgggcgtctacgtcttcaccgaccggctgccttcatctgctgccgactggtgtctccgcctgcacggctggcctattatgccgccgttgttgggcatctacgtcttcaccgaccggctgccttcgtctgccaccgactggtgtctccgcctgcacggctggcctattatgctgccgttgttgagcgtctacgtcttcaacgaccggcttgccttcgtcgctgccgactggtgtctccgcctgcacggccggcctattatgccgccgttgttgggcatctacgtcttcaccgaccggccgcctcgtctgctgtcgactggtgtctccgcctgcacggctagcctattatgccgccgttgttgggcgtctacgtcttcaccgaccggccgcctcgtccaccgtcgactgatgtttccgcctgcacagctggcttgttatgacgccaactgatgctatcttctttacggctggctacgtcgccgtcaccgctaataggcgtcatcatcttcaacgcaagctgtctacgtctactgccgactagtttcttcacttccatggctgcatgattctgccagtgttgattggccttatcgtcttcatcgccggtcgtctcgtctgctgctgactagtgccctcgcctctacgtctggtttataccgctaccattattgttggtcgccttcatcttcattgctggctgacctgactactgccgattggtttcttcgcctctacggctgtgcaactttgtcaccggcaccgacaaactctattgccgctacttcgctagttttgctacttcaccagccacgacgtctacaagagcttcgttatatcggcatgcgtcaccaaatatgatgccatgttattttactacaacaagtggtattccaatcttcaatatttctactcggatatcttcaacatgcatcttcactcaagcaatgactactcgacgacaagaagctaaagttttcgactctatgttcagttgtttcccaactaactaaagagtcgggggcaacacaaatacacggctcaaaattcgacaggttttatgtcaagatgaagcaatcaactaatcagccaacgagttctatggaatctacttcagcaactcttattatttcaccagtaattttggtttctccacgccgctacaatctactccaaatttctcaattatcaagtttgagatttaatctacatgttcgggagttgtatcagtcttcattatgcacacgctcgcatcaaggaaactacttgagcttcaatatcttctcaatagtttgatggattattgtcactggcatcatcaccagcacctctacttcatcggccctgacgtcttcgccgttgctaaggggtgactacgtctcaccctcggtggcttctgtcatcactagcttcatcgccgacttgttatttcgttttcagggttggcctactacgcaccgccgaggggagacctcatcattatcattaactgctacattgctatcaatgggcaccttcatcatcacatttgatcatctctattgctgccaatcgtcattaccatcggttgcatttgtcgtcgtcgactatttcctgcattttcatgattggaggatttcgccattgtatttgatgcacgtctacgtcttcatcgttggcttgttttcatcgccaccgactgatattctcgccttcacggctggcttattatgtcgccactaatgggcattttcatcttcttcaccagctgtctcgtctgtttctgactgattattttgtcaccatggctacaaaattctgtcgctattgctgggtgccttcatcttcactgctagttgatatgactgcttccgactggtttcttcgcttccatgccgattgcatcagctattaccgatggacaattttgactatgacagaaggacaagctatatgctcaggggcttatcagctcaaacacaagcgcgaggattatatcttcaatttggacttcttccggatacatgcaacatgaattcgtgatcatgggtctattttctatgctcaaagactggactatttattattccccgtaagggttatcaatcgaatacttgcgctagtcgggattcaattattatatctatttaggagtatcccataagggataatcactcagatcagaagctattcatatgagctacacttggtctatatcactcggaagatttattactcgggagcatgttacatgcgtcatccttcaaagggtgtcgaaggcatattttttggcctaggcctaatatgtctgcagcccatattttcaggtgtggcctgtcacgttcttttagggacttaggcatctttttgcttacgcaaaagtgcacgtgattatgtgcccaataccttaaaatccttttataccgcagttactcaactttttaggagttggtacaatgcatcttaaaaggtgtcaaacagtaaagctttatatagctgctccgctgactttttatatagtcatgacactgtttgggttcatcaatccattgattagatacaatatcattgcttttcgccacgtaagtgtgcatttttattgtccaatattatggcttaagctgattatatatcttggccattttccaggcgggtggtaaacacgttatgagttaatttactcggatttcacaccacatatgccatatatttccaggtgtggtgaaaccatgtgtcttttagggacttaagcacatctgttaaagcagtgtgcgcatggcgtatgcccaatacattagaaatttctttattcgcaacatacaagcttctttatagctgttttgctatgtgaattttcaatgatgtagccaactttaggttacattcatcatattttacaaagcagtcggtatatcactcggatcatgttattcagggattcacaccgcatatgctacatattaatatcaagtcgcttggttgactataattatcgaaaccacttggttagttagattatttattccttgactatatgcttagtttgttcagctaaccacatagtcgggggctacacctattaggtgcatctagtcgatgcacctaactttatttttcagccctccacagtcttcatatttggaaaaagtactcgggagatcatggcgaagatgattgaagcactcggctttagagtaatctggttcgagagaagattatcttttcgactgtgaaggtctcaggggctactgtggagattatgggtaccccatacccacacggcatggttatccgactagttataggggataacttatatctatgtaatatgtaacagatcatgatttgggtgttacgtttccttgtatattacggaacggcctaaagtcctggtttgataatattgtaaagtagatttaggaaaccgataccgtattggttaaggtttctatcttgtaatcctgccccccatcctatataaggttggcagaaggccctctaagaggcatatgagacaactagatcgtcagatctatacacactcggcggattcaaatccccaaacaggagtagggtattacctctcattgagagggcctgaacctgtctaaatcctttgtctccgcatccatccacttttaggtctcgtgcgctaccccttttattattgccgaattcatgtttcaacaacgggttagccactagttttttactaatcacaattgcttagagaggtttaatgacatacttgaaaaaacaaatatatgatgtaggttgagtgtgaattcacttttcattggcaagttttaaatgtttttcctccacgatatttgcggtcagattatattgttatatactccctccattaacctttgttatgatgtttgaatattcatcctatttgctagtatgctaccaagtcctatatagaatcaaatgttatatgtatgacaaaattcctaagtagataagtaaggtgtcccatataagaaagagaagtagagtgtaaaatcaaaggtgtttttgattattattctgtgatgaacgattggcattgcagattattggttttgttatttggaatttattcacaaagtggttttggagatgattggattcacaggtgatcgcagatttatcattttatgtgaccggtcagaccgggctatgtatgccggtcagaccggcggtgatcgagcggtcggaccggccagtccgcggtcagaccggccgacgctgtgtcagtttcggttttgggttatttgtttggatatccgtgattatttcatgattatagcttctagatggatactatacgtatgtaatactgttgtttgctactaatgagtcaagttggagatagcttggtcttggaatatggtttctttgtttaattcatatgtaggtgactcgatgtctcggaagagtatttgcggtgatggaccgggagtcggcttggggataagacgacgtccgtggtaatcagagatcatgcgggatactaaggctagagttgatgcatgtggttgatggagattccatatgtcatacgatggaggtattgtgtgcgtatgggatgcggagtcgaatttggaaggagtccaaatttggtacgattggttatgtaaagtttctttcttgtattagagggtttcctaaggtgtttaggactcttagtatgagtttggtttgtggctttaggatgcctacctcgggtataaatagagggggagcgtgaggcttctcggtatcgcttttcacagcaattgagttgagttttgagttagggtttcgagtttagtcgaaatttttgtaaggattgctgttggtgcactttgtaaacacagagagaatcaataaagtcgtcatccactttaagagttcttcgatttgtgtttcaccgggtttcggcggtgtaatcggcggcacaccagcggtcagaccggcggcatcgcggcggtcagaccggtgggtgacctacggtctgaccggcggcgacatcaggcgcgacagggattccagggctgtccaaccggtcagaccggctaatctactttggtcagaccgatctcatcgaaattgagggtaacttttatttgcgctaaaagtttttggtttttgggtataccaaccattcacccccctctgattggcttagttcttgtgattcgatcctacaagtggtatcagagccttggtttcttctttggatttttatcgatctagagtttttgccatggctactcctgctagggtttcaactaagcctcatgttttcgatggaacggatttttctcattggtgtagtaggatgcaatcttacattttggctgaagattatgatatttggagaaaagtttctcatccttatgtaattcctgaagctattaatactgctgctgaaaaaactgcatttgaacaaaattgcaaagctcgcaacattcttttgagtggtatttctcgttcggattatgatcgtgttgcgcactttcgaactgcttatgaaatttggaatgctttgagtaactttcttcaaggaacaaataacattaaagaacttcgtcgtgatattttcaaaaaggagtatattaaatttgagatgaaacctggagaagctttggatgactatctctctaagtttaataaaattttgagtgatcttagatctattgattcttcttatggtgctaattatccacaatatgagatttctcgtcactttttgaacggtcttgatatgtctatttgggagatgaaagttacatctattcaggagtcagttgacatgtctactttgactttggattcgctttatacaaaattgaaaacacatgagatgaatgttctttctcgaaaagttgattctaagtcgagtgttttggtttcttcttcttcttctttggatgttg

SEQ ID NO: 60438 - DNA, 3130 bp, Oryza sativa
ttaaaatatcttattcccaatgatgatgattgttcaaattgtgaggttttaatgaatgagatttcaaaatttagagatgttaatgctgcacatggtttgaaaaatagatcttctcttgcttgtagttttactttgcacacacgcactttggatgagttgtttttaactaaaaagttgttgcaaaaatatcaaattggttttcatgctagtttgatgtttaacatgatttctgctaaaaaagttaaaacaacctcatgatgttttggattgctcaacatgtaatttgaataagttgaaattgaaagattctttaggttgtgttgagtacatggaagatgttgtgaaaaacaatgaagtgctttattgcaccaaatgtcgtaaaagcaaaggtgtcatggtgattgtgaaaattgtgctaatttggaaaaagaggtttcttatttgaaaaattctttgctaagattttctgatggtaaaaagaacctcaacatgattttggatcaatcaaaggttagcacacataaccgtggtttagtttttaatccttatgctcataattctagacatcctcctattgtgttaggtgttggtgctagaagtggtgagattttggttaaacctgattctaacaaaactgtgtttagatctgctggtatcatatctaccttgaatgcatctttttcaaaatccaatgttgtgcattcaaaatctcctgttgttgcttgtgttgctaaatcttctaatgctaccaatctgtctaatcatcgtgaaaaatatacttgttctttttgtggaaaagatgaacatattgttggtttttgtttcagattagctcataaacagaaaaaggagagagagattgcttttgcaaaatcaaagtggcaaaaatcgggttttccctcgaggaaaccggtcagaccgcagtgggtcccgcggtcggaccggtgaccggtcagactggctactgagcgtcggtcagactggcggtacagaggcggtcagaccggccactgtacctcggtcagaccggcctcggaggaaattttccgaaaattctataattgattttgcacgtggatatatgcctattggatcttctagtcatgtgtctcagtactggattcctaaatttttattatcatctaaccccagtactgaggcttcgacttctacttgtgtgtaggctttggtggcaaggaaggagaacgtgtggatcgtggatttcggttgttcgcggcacatgaccggtgataaaaattggttctcctcactcaaaaaggcatccaagactgaatcgattatcattggtgatgcttctacaagtgccgttctcgctataggtttggttaaggtaaatgaaaaatttgaattgaagaatgtaactttggttgaggacttaaagtacaatttgctttcagtttcacaaattgttgatgaaaattttaaggttcactttaagaaaactagaagtaaagtttttgattcttgtggtgattttgtgttgaatatttctcgctatggaagagtgtttaaagctgattttgaaaatcctgtttcacctgtgataacatgtttggttgctaagtttaataaagatgtgatgttttgtcatcgtagacttggacatgttggttttgatcatctcactaggttaagtggtttggatctagttcgtggtttgcctaaacttaagaaagatcttaatttggtttgtacaccgtgtcgtcatgctaaaatggtttctacttcacatgctcctattgtttctgtgatgacggatgcaccgggacagctattacatatggacattgttggtctagctagagtgcaatctgttggaggaaagtagtatgtgttggttattgttgacgattttcctcgatattcttgagttttctttatggcaactaaggacgaaacttttcaaccctttcgtggtttgtttcttcgattggatcttgaatttcctggttctttgaaaagaattcgaagtgataatggtggtgaatttaaaaatacttcatttgaaaaattttgcaatgaaagaggtcttgaacatgaattttcttctcctcgtgtccctcaacaaaacggtgttgttgaaaggaaaaatcgtgttttggttgagatggctagaacgatgttggatgactataaaactcctagaaaattttgggctgaagcttttaacacagcttgttatatttcaactcgggttttcttgagatctaaacttggaaaaacttcttatgaacttcgatttggtcatcaacccaaagtttcacatttgcgtgtttttggttgcaagtgctttgtcttgaaatctggaaatttggataagtttgaggcacgttctaccgatggattgtttcttggttaccccgcacatactcgtggctatcgtgtacttattttggagactaacaaaatcgttgagacttgcgaagtttcttttgatgaggctagtccaggtactagacccgatattgcaggtacactatcacaggttcagggggaggatggttgtatttttgaagacgagagcaacgacaacgacgatgacgaggtcggctcggccggtcagaccgggtgccaggccggtcagaccaccggcacaccttcggtcagaccgacggaagacgtgcggtaagaccggccagggccgtcggctgagggttctgttgacgctgttcgagatggtcctccggagattacaacttcgactagtactgatacggaacgtggatcaacttcagaagtcgctgctcctttgcacattcaacaacgacatccgccggaacaaattattggtaatacaggtgagcggactacaaggtctaaggtaacgactcatgatgtttgtgtaaattctgcatttgttgcttcttttgaacccaaagatgtttcacatgcattaactgatgaatcgtggattaacgccatgcatgaagaacatgaaaattttgagagaaacaaagtttggactttagttgaaccaccttctggacataatattattggaaccaagtgggttttcaaaaataaacaaaatgaggatggtttgattgtgagaaataaagctagacttgttgctcaagattttacccaggttgagggtttggattttgtt

SEQ ID NO: 60439 - DNA, 16592 bp, Oryza sativa
aaccatagagacatggagccttcgataatgtcgaatagaattttcctaaaatcaatactcagaaaagaatattagatagaaatagcccccgagcgaacgctcaaagggtaacatgttataatatgtatggaaaaccgaaaatgcattaaacttacagaccaatgttttgtatatgagcgtctactcttttaccgacttcgatcagtcagtttgttgagttatacactctccctagcccctagccttattgtcggcgaattgttcttggaggataaggctcttggacctttcacctgcctcggttgaacaagcactgatcctagcccccagccgtgaagttggaaaatccattttcgattacacggcttggttaatacgcacggcgagaactcttacacgaccagatcttacatggtctttcgtctctaaaggatccgacaaagccttatccgctctgggcgtccccagccgaagtttccttaggttcctcagaggctttgtcaagacggcgtaaagggacattaggataggtttcaacgctaggtgtcttttgtggtaagggatctctgggtaaaacacttggcgatattgtgcacctgatatcaactttgttgaagtagaggtaatgggagaatcactacacctctggtcagaaccaggtagtagtcgtaactcaaccactagaattaaatgtacgagagatcgctacaattgactggttgaggaccagtgagtaggtgtctctcgatcatttgaagtcgtagtacgaggaccgctgcgttattgctgtagtcgtacctcgactctcgaacacctatggaggcgctggaattggtttattacatgcgcatctcatgtggctagcatgactcacacacccaacttgtagcatatccggatgtccgttcacaatcatgtcaggtaataaagccgacaacgttcacgaggaattatccgttaacaaccttttctcaaatagtccagccacagccggtgctatgagataggttgtcagttttcgttggtaggttgggcgcgacgactctgcatttgtcgagatcgttctcgataatgcggtgtacttgaccacaacctactcgagtgctcaattgttcctgaaaaatattttctagaagacaagatatatagcagataatatcgagtatgtactcaaaaaactgcatgaatcttctagcattatcaggatataacgagcagattaaatatcagggcattatgtaaactgtaaacaagcatgatttatacagaagaagacagagcgagtccccagcgttagatcgtagtcgatttaacatcagggacacccgcgcaacagatattgtataaaaaacatgctctaggtaaacataataaattataaatccgacaatgttgtatgatctgaatattggtatggaaaattttatataaaataatgcgtacctgtgtagatatatgccggatatatctacgaaattagtagatcaattaaattaattaacctactaattacatttctgacatgtgtattcggagtagattagatcgatgcaatcttacttctccaggtgtacagccgcatgaatgcagtaaacacatgcacttgctgttaattgatctgatgcatgcacatatggacgttatccaaattggttggacttgacgccggccgtgatgagttgacgcccgtgtcaactgactaaaaatcgggtcctagtcagaacatggtagcactactctggcagttgatttttggctcctcgacacacttgcttggttggtaggaatcggtgtcgggttcggcttggactcggccggccgatgccttgcaccagttgatgtcgcacgcgtcgagggttaggctgcttccgacatcatggttctccgcggcggcggtagtcccaatctcgtcggaagatatgctccgatcaggttagattttcccacagccgaagtcgccgagtagcttgttgttggagaatccatctcgtaaacccatctcatcgaaaccttgaagcaccaaaaatcgccctacctggcgcgccactgtcgacgttttatgtcgcgattccggtatttgcatagtatgatgatcgttggtactaggatatacgcgagactaaggtaaaagagatggagacagggatttttatatagtttcgggcccctgaattgtcaagtaatagccctacatcctgttggccgaagccggtattgctcttattcaccataatcacaccagttcacctttagtcctcgcccattcttccttctattcggccggccttatcccttcccaaagtctggtttgcattcctccttctatcgggctgtgcaatagaagcccagccaaaagtctggtttgccttcctgcgccactgttcatcttccagctcaggaagagccgactgtccgccgtgcgcatgcactgccgccgcctcctccttccaaatccgacctccccgttgctcctatttccaaattagttctgggaatggaatcctcttaatctcctcttccttttccccaagaaatccccaaaagtttctacggaaatcctttccaatttcgcggatcaatctttcctttttccggcgaagatccctagaatttcccgtagtttttccgtcgatttgggcctggacccgagctcccgtgcctatataaaggaccccctcgttgtcctctacctctccctcaagtcctgtcttccgccgtcgccggaattgctctccccgggagccccttctctctctaccttcggccgccgctccagccgccgtgcgccgtcgcttcggccgtcgccagtcagcgccgccacctctctcggctccgcaaggtcaatagcaagctcagcagccatctccccaaagccgaagaccccgggaagcacttcgtcgccatgaagaccgagctcgccgccgcgttttgatctccagcgaggccctgctgctccttcctgttagtgatatgccctagaggcaatcatagagatgattgtatcacatactttgtttacatatttatccgacattgttccttgaaatagataactccttattggttaatgaatatgtgattctttcatgagactctttatgttgtttgttactatttctaaaggatccctaatcaaatatcatatgtggaacaaatatgtttatatgatcagcacatgttttaattgatgatcatgtctcatggatcatggtatagagataccaaattaataatgtggacacatgttggtgaacatgttattggatagacccaacatgagacactgcaagagccatatgtgttgtgtcatcagtgatctcatttagtgttggtgttgaatccttagacctgagattatcatggttctcaacatgtgtagtagcttacttaagaactgctaaatgctactccgtaaatgggtagctataaaagtagttttcgggtatgctatgaaatatgtagtgggatatgtataatcaagatgggatttgcccctcctatggagagatatctctaggcccctcgatgttgtagattatggaagtgcatagccatgccaaaggtgattgaggggtcaatcacaagttatataatctatcaacaggttcgagtgaatgattagctattagaggatgccacatatctagccttgagcttaatcgatatcgtgaggcaaaggggtttatacaagtatacactagaggttcaaccgatatgatctttatgtatgcccggtgggtcaatacgttctgctaggggccgctgttgacgcgtggaccgaaaaggagttttcagattacagccgagtatatatgaacatacagggtcgcatgcttaatgggccggaataaggggatttgatagggatccaatataagcttaattcggatagggatccgaataggagtcctatgggccttggaggcccgagtgatggatcctatatattcgtgaggggtgtgaccggcggaggtattgcaatacgtgagaaaccctagccatcacttccctccccgagcaaaaccctagccacgcgcgggtgcaagcacatctgcgcgtggcgttccgtccctgtacgtgtggataccggtagagacgccgctggtttgcggtgctgatcggcgtgggaatacggcgaggagaaagcacgaggaggagaaggtcgagccggtgcgatcgactacttcctctacatcgacgcgcgctacttcgcgagagttccttcgacttctcagcgtcttcttccgctgtgcagcgcgtcgagtggtaacgatctatgatctaatacttgcatggttcctggtttacgcgatagaaaattttgatttatgctatcgtagcctacgcgtatcccaacacttccatcatcaccaagcttcaccgccgcctcctttgggttcggtgttcgcctccgctttgctgacctctaggcgaagagcctaaatcttcggctcgatgagattgtagtaatcggttagagcggtagaatgtgcttgctcctttttgagctcagccttgaggcgctctatctcagccttcgcctcgctccccttctccaattcagcttggagccgcttattctcagccttcgcctccttgagggtattggcgaggccctccatctccaagctcttgcggcccagttcgtcgtccttggctcgaagacggttcttgaacccgtcaaggcaagcccgcatagtccgttcggttgaacaatgggccgcgagaatctagatcaaaagacaaagagagggcgaagaggacaagcgttaacataagccgtcgaagacggacaactgaaagtaaacaaaaaggagaacaacatacccgaaccgccaaacgcttgatggcagaatagccttcgtcgaactcgttcagctcggtgaataggctcgggctgccagccagagacacgagattacttaccccctcgacgaaggggataaggtccgcgccagtctcgaagtcagcaggggcgcagtggggggccaccaaagaatactctgaagcagacgtctcgacgaccgtcttcttccccttctcaatgacaagcggcgaaaaccacagtcctccgcacaggactgccaaagaccctagcaacgaccctgacaatccggtcagcaaaggccaaagcccagcggccacactccccccgagctccacctgcatcaaccatggcgctgagagcggtcgaaagacccaagctccgaccagtgggcgaagtaggggtctcgtccgaagactcgtcgtcgctaaaaatgcgagcgacatcaacgagccctttctttttgggggccttcttgatcgaaccccccttcgtcaccttggttgcggcgatcgcaaccagcgccttcaccccctccatatccatttggcggaggagggagaagttcgactccaccccggtcccaacgtgctcggggctcggagtcggagtgtagctgggcgtcttggcgcggttgccggcggcctcgtccgtggccttttcggccacaacctccgtttcccccacatcctccccttcctctttgtcgtcgtgatctatgacagtgtctttgtcatcagcatcagagtcggtggaggcaggggccctgcacttccggggggccaacttcacctgccccgcagccacttcctagatggcccctcatcgccatcggccttgaaggacttcgtccggggaggcagttcaccgacatatacccggttcgcccgaccggccgccagccgcgtaagcagctggctgaactcagtaatcgacacgtcgccgatcatcttccgggcttcagtgtcaacctgagcaagggtcaacactgcagaaagtcgaaaaatcgccacatcaagcgttgaacaaaaagagcgagtcacaagtacgtaagggaaatgcagaggctcactgttcgccccctcgggcatgacgagctttgacaagccgtgaacttcctcgtcttcattcaccacaacatgccacgattgggagagggggaaaatccgaagcatgcaaaattcctccaccagatcgcggcagctaagccgagagcagaccttgcgaagcagggtgaaccgagcctccatggtgccatcgatggcgaccttgggcttcctgttcggcgaaattgccctgcgccgccaacggagggccttcgccgcgtcggaaccggcctcgaaggggatggagtggtagaaccacttcgccatctaatggcgatcccacttcgacatggcggcgttcaccggccatagatcggagcgctcggggcgaacattaaagttcacgctcccgaacgccgttttctttgtcccggctggggtgaccactgtcttcgagttcacggtgccatagaacacggcgccgaaaagctcggcgctcggttcgaacctggcggtccggcacgcccagtcgaagatggtgactcggacaagtgccgatgggctcagctggggaagctccacctggaaaagacgaaggatctccggcaacaaaacgttgcatggaaactgaagccccacctcaaaaaacacggcaaataccatcgtccggttgtcgccgtgtttcggcaccacggcctttcccggagcgaaggccttcccctccaccagcaggctggcgctgacaagctttgccagctcgtcgtcgtccacaagcgaagcccctagaaaggcggtggtgtcgtcgtcgattcggcctggattagggcttgtcgcggaagctgggttcggcttgcgaggagccatggtgaaaggtgtgcgcggtggcgaaaagggagaacaagcgaaagatctaggaaatcaaagggcgtcgtgaaaggaaagaatggagaaagagagagcgctcgcggtgaaaatgacgagagtgcggcggtgaaaaaggggaagggggaatatatagcccacccaggcgacggttcgtctccccacccaatcgtaagagggaaagcccatcactgttcattttggcctagagaaaattaaaaacggtttcgccgttcgcaagacgcgaaacctagaaaacgttactaaccataaaagtacacgtacacataatgcacactttctctgcaggactccagaataggtttcggcaggagcgtcggtccaaagggggcgccccataccataccacatggtttgcacggtctcagccgaagctcctatctcactcttgcccgtgaggggcttgttggcggtatgtcatgagacccttcgaccggacctgccgaaaccatgcaaccaggggtgggttcaagcccaagacgtcgagtctgttgaggtgaagcccccatggcgaagactatgaagcaaagatggcgaagggtgaagaatcgcaccggtatcccacaaggttgaaggcatgttgggcgaagactatatggcgaagagtgtatggcgaaggcggatgactttgccgtagcaagtccaacttcaaggaggcccaagaggccatctcagccgatcaagcccggaggccactgggccagcgttcgccagtcggcccattaggggcccatataccttaattacactatatacccatgtaaatgtccctttcataagggcaaccatgtaaattcccctgttaaacctaaaccccaataggggaactagtaatagggttataaataggctcctagggccatgtaacggggatccagaaaaaataaaagaaagataatacacttcaccgtttccagtgactattgagtatccacgtccttcgacgtacgcagttgtcacttcgacaaccatacttaatattctctaaaacatcatttacaattatatcggaaattgcttcttgctgctactacacgaacaacagagattaggaattgtgaatttatgattagtgaagatggagtgctggtctctcgagttgagaagtattgacgctttttttttcaacaaaagattacctaacggcttacggtataattaatagagtcgttaaaattaagatcaaaaccggttaatgaaagcaatcaattcactttcatggaatcaaaaactaatttacatttgtaaagaatatttttagataaaagaagataactatcgtacttacatgacgacgaaagattactttctgagcaaaaaagcaaagaaatagaaggtataaatagaacaaagtaaacagcagataattcaattgttggatgttgggtgccttcccaatcgaccatatcttaactaatataaagattcataaatttccgttcgtcacacttattttcgtccatcaatcgtgcgattccctcttccccctctcgcgcgtgtgtgcgttgcccgtctccaatagttagcgcggaaaaataacatgggttgcatcgtaatacagtaggaaaaatagggtttggatagggctttattctcagctagatatgaagcagatttgatttgatttttgggaaaacggaaagaggagaatataaggattgaaacccctcaactaatttcatattatcttaaaggatgcggccgagttttatgaaggcggtgacatcgggaggcgtcgggaagatgaggaacttgacggaggtaggggatgacactgtagtgatgggcccacacgacagtgagatagggagggtaattagtttttcgttgcttgctgggtcggacgcgtgtccgcgggccgaggaggaggggagaataaggaatgaaagcgggccggctcggctgtggactgagggtggccatgggctgaaaatggcccaggtgtaatgaggattttatttagattactatttaaataaatgctgaaatgatatttgtattattaaaaatagcaattaagctctgaaaattccaagaaaattccagaaagtgtaattaactatagagaatttaattaaaattaaatctagccatatcaattttatttcctacactaactttacttttcaattaatttaaacacctacctacttaaaaaatacttaaaaaatacaagtattccagaaatttgtattttagttaattaagtaaatctttcttaactcctcctcaattttctcatcttttcttcccgttgcaacgcgcgggcactttttcttgaaaaaaatcaaagatgatacaaaatcctaatcgtgaacggagtacaaatcacaacataaaaaccgaacgataatcccaaaaaaaagaaaaaaaaagcggcgtcacctatcatttgagacttttcctatcaagcaaaagtaccaaacagtgtgaaaataactttggctaaaaataaatatttttagttttaatacactgtagcgaagcacgggtattttgctagtatacctatagatacatatacgctatgccctggtcttttgacgtacatattctacatgatacgtttgcaatatctcagtctattaaaagacgatctgataaaaaaaacctcctcaagtttctcattttgaaaacgaagctttaacgcaacaatttaatgagaaagagattaaggaggctattttccaaatggaacataataaagcaccgggtcctgatggatttcctgctgagttctatcaagttttttggaatgttattaaacatgatttaatggatctctttaatgattttcataacggtactttacctctattctcttttaactttggtacaattattctactacccaagtgtgttgaggccatgaaaattcagctatataggcctatatgtctacttaatgttagtttcaagatttttaccaaagttgctacgaatagaattatgagtgttgcctagaaggtcattagtcctactcaaactgcttttataccggggaggaacattatgtaaggtgtggttattttgcatgagactatacatgaattacatcgcaagaataaaagcggtgtaatctttaagattgattttgaaaaagcttatgacaaattcaaatggtcatttgttcaaaagacgctaagaatgaaaggtttctcccctaaatggtgtcagtggatagcttcctttattcaagggggtcatgttggtattaaagttaatgatcaaattagtaataattttcaaacccataaaggtcttaggcaaggggatcctttatctccaattctttttaatatagtggctgatacgcttgctttacttattaagagggctaaagatgttggttctataaatggtgtaatttcttatttggtagatgatggtttatctatattgcagtatgcagatgatactatcatttttctagagcatgatttacagcaagcaaagaatctaaaattgattttatccgtatttgaaaagctctctggtcttaaaattaattttcacaaaagtgaattattttgcttcggtcaaacgaaggatcattacgatcaatattctaatatctttggttgtaagttaggctctcttcctgtcgaatatcttggtattccaatgcattttagaaagctgggtaacaaagactggaaggttattgaacaaagaattgaaaaaaaacttagtagttggaaaggtaagtatatgtctgtgggtggtagattggtgttgattaattctgtactttcaagtttagctatgtttatgatttccttttttgagataccgaaaggggtacttcaaaaaattgattattatagatctcgttttttttcaaggagatgatcataagaaaaagtacaaacttactagatgggatatcatttgccagcccaaagatcagggtggtttaggggttcataatttggaaatacaaaataaatgccttttgagcaaatggttgtttaagttaattaatgaacaaggggtttggcaagacttattgaggaggaaatatcttcataataagtctattactgaagttgataagaagcaaggtgactctcatttttggtcagttttagtcaggtctcatgaaagtttaggatactttcttaaacatgggttcctggattgtgaatagtggggaacaactagattttgggaagataaatggttagataacttagcctttaaagataagtatccctctttatatgccattgtccgaaggaaaggttcttcaattgctagtgttatgagatctgttccacttaatgtttcttttaggagagctttagttggtcagaatcttatttttttgtatgagttgtgtgcctctattgtacatatccagttgaatcattcttctgattgttttagatggaactttaatcagaatggaaggttctcggttaggtcaatgtatcttgctttaattaataatggctatattgagagaaataaaatgatttggaaacttaaaatgccgcttaagattaagatcttcatgtggtacttacttaaaggggttgtgttaaccaaagacaatttagcaagacgaaattggaaaggtagtttaagatgttgttttttaatgaaaaatgagaatattcaatatcttttcatgaattgccattatacaaactttatatggagagcaatacaatattcttttggtctatgccctcctagtagtatatcacatattttttatggttggcttttgggggtggacaagaaaaggagtaagcttatacttgtgggagcctctgcaatatgttgggctctgtggttaagcaggaatgatttggtttttgacaaatcaccatctattacatatatgcaggtaattttcagggcaacatattggctccggtgttgggctcagctacaaaggtgtgatgaagatggcgagtttatgaaggttgcatgccgtaggctgaaacgacagtttatgcacctttttgcccattatggttggagattcacaagtagacttcaataacgtgttctccttatcttagatgggttattttttattttaagtgcgtgttctcaatgttttgttggactacactcttttttaagtgtaacttgtaataattgtttgtagctcgttttgagcaaaggccgggatattctattccattgtcaaaaaaaaaaaatctgcttcgacgacgttcgcatatcacacagcctaaatttgtcctcttgcgccagcccgcaattaacactactacaaaaatcgtttttctgtacgagggggtcggtaggttccatgcgggccgcttgtggcggcgcctgcaaaaaccgcccccccgggggcgggttgattagccgcatgcgaaaatagacccattatcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcgtaaagcaagcaccaattagggggggaggttttcaactcgaaatttttacttgaactctatacgaaaggtgaagaactctctatcctgcttcatttggctccatttttgttatatttcgttggtggaaagtggagtttttttaatattttgacaaggtttgttctaactattttttgcaaaatctagcttcaaaatatatgttttgatgggcaaattttgcatgtaaacaattgtacatactagttacatgtattgttgtatttttttgggagacaaatgcatttaaacttttgtatgaaatacctgcggtctatttttttatctgtaaattttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatttcgcgtgaaagaatggttgtcgatgtttccaccgatagtgatgatttcgatggtggttttgatttagaggatatgctacgccatgttgaaccagaggtgctagcgggtaggtcacgaggattggagaattggcaggcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttccgtgtgttgcttcctaagcctaactttgtatcatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacggggaatgggcccgtagattcagagtgtaccgatccagattctgataagggtaagcgcgggaagattccttcaatggtgatgtggtacctaccaattaaggaccgcctgaagcatctgtactcaaacccgactgatgctgagttgatgagatggcatcaagagagccgaaaaatagatggtatgattcgacatcccgccgacgctcgccagtggaagacatttgatgcaaaacacctagaatttgctaaggatcctaggaatgtaaggtttgcattgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagacttcaatctacgtgcgatcatatttgttaccatcaatgacctacctgcaaacttttcattatctgggcagattaaagggaagactggatgtctaatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcattcaattttctttaaatacttagattactggaaggacctagagattcgacatgcaattgatgttatgcacctcgagaagaacgtgtttgatagcaccgttggcacattgctggacatcccgagtaaaacgaagaatggattgaagtcacgtaacgaccttgtagatttgtccatacggcatgaccttcacccagtagtgctgccaaatgggaagaccgagattcctcctgcttgttacttgttgacacttgaagagaaaaaagccttctgtaaatgtttacaaggggttagagtgcctactggtttcgcatcgaacatcaggaagctagtatcaatgaaggatttgtccatttcgggatacaatacgcatgactgtcataggttgctaacggtgttcctaccaattgctataagggcagtcaaaccagtccatacaaaggtggttataacaaagttgtgctactttttcaatcgaatttcgcagaaggtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctataagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcaccgcacaaaatagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtatggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttattttgtaacctttagttctcattgtattccaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttagagaaaaaaaaatatgagtttttttggtaaaaagatctttctatgcggctggctcgcatgccggcttaatagcccgcatggaaagatctttttcgcatgcggccggcttaacagcccgcatggaaagatctttttcgcatgcggccggcttaacagcccgcatggaaagatctttttcgcatgcggccggcttatgtcgaccgcatggaaagatatttttccatgcggtcccttaagccgcccgcatacgatgatctgcgcctatatatagggagcgcggggagccaaaattttctaagtcccggctcccgcgaaaccctagccgccaggctgccaaaatttcccaagtcgtcgtcgccgtcgtccccgccaccgccggctcctccccaaagtcgccccgccccacgccgt

SEQ ID NO: 60440 - DNA, 23468 bp, Oryza sativa
  unsure (1)..(23468): unsure at all n locations
taatattggtcaataaaaatgcacacttacgtggcgaaaagcaatgatattgtatctaatcaattgcttgataaacccaaacagtgtcatgactatataaaaaagtcagcggagcagctatataaagctttactgtttgacaccttttaagatgcattgtaccaactcctaaaaagttgagtaactgcggtataaaaggattttaaggtattgggcacataatcacgtgcacttttgcctaagcaaaaagatgcctaagtccctaaaagaacgtgacaggccacacctgaaaatatgggctgcagacatattaggcctaggccaaaaaatatgccttcgacaccctttgaaggatgacgcatgtaacatgctcccgagtaataaatcttccgagtgatatagaccaagtgtagctcatatgaatagcttctgatctgagtgattatcccttatgggatactcctaaatagatataataattgaatcccgactagcgcaagtattcgattgataacccttacggggaataataaatagtccagtctttgagcatagaaaatagacccatgatcacgaattcatgttgcatgtatccggaagaagtccaaattgaagatataatcctcgcgcttgtgtttgagctgataagcccctgagcatatagcttgtccttctgtcatagtcaaaattgtccatcggtaatagctgatgcaatcggcatggaagcgaagaaaccagtcggaagcagtcatatcaactagcagtgaagatgaaggcacccagcaatagcgacagaattttgtagccatggtgacaaaataatcagtcagaaacagacgagacagctggtgaagaagatgaaaatgcccattagtggcgacataataagccagccgtgaaggcgagaatatcagtcggtggcgatgaaaacaagccaacgatgaagacgtagacgtgcatcaaatacaatggcgaaatcctccaatcatgaaaatgcaggaaatagtcgacgacgacaaatgcaaccgatggtaatgacgattggcagcaatagagatgatcaaatgtgatgatgaagttgcccattgatagcaatgtagcagttaatgataatgatgaggtctcccctcggcggttgcgtagtaggccaaccgtgaaaacgaaataacaagtcggcgatgaaagctagtgatgacagaagcaaccgaaggtgaacacggagtcaccccttagcacggccgaagacgtcaggctcaatgaagtagaggtgctggtgatgatgccagtgacaataatccatcaaactattgagaagatattgaagctcaagtagtttccttgatgcgagcgtgtgcataatgaagactgatacaactcccgaacatgtagattaaatctcaaacttgataattgagaaatttggagtagattgtagcggcgtggagaaaccaaaattactggtgaaataataagagttgctgaagtagattccatagaactcgttggctgattagttgattgcttcatcttgacataaaacctgtcgaattttgagccgtgtatttgtgttgcccccgactctttagttagttgggaaacaactgaacatagagtcgaaaactttagcttcttgtcgtcgagtagtcattgcttgagtgaagatgcatgttgaagatatccgagtagaaatattgaagattggaataccacttgttgtagtaaaataacatggcatcatatttggtgacgcatgccgatataacgaagctcttgtagacgtcgtggctggtgaagtagcaaaactagcgaagtagcggcaatagagtttgtcggtgccggtgacaaagttgcacagccgtagaggcgaagaaaccaatcggcagtagtcaggtcagccagcaatgaagatgaaggcgaccaacaataatggtagcggtataaaccagacgtagaggcgagggcactagagtcagcagcagacgagacgaccggcgatgaagacgataaggccaatcaacactggcagaatcatgcagccatggaagtgaagaaactagtcggcagtagacgtagacagcttgcgttgaagatgatgacgcctattagcggtgacggcgacgtagccagccgtaaagaagatagcatcagttggcgtcataacaagccagctgtgcaggcggaaacaccagtcgacggtggacgaggcagccggtcggtgaagacgtagatgcccaacaacggcggcataataggccaaccgtgcaggcggagacaccagtcggcagcagatgaaggcagccggtcggtgaagacgtagacgcccaacaacggcggcataataggccagccgtgcaggcagaaacaccagtcggcagcggcgaaagcaagccggtcggtgaagacgtagacgcccaacaacggtggcataataggccagccgtgtaggcggagacaccagtcggcggcgacgaaggcaagccggtcggtgatgttctgactgatccatttctgaagcgtaggagataagctttgaaagccatgaatccctattatgcatatctggatctggatcctgcagaacaaacatataggatgagtagtatctgatgtaaatataatactcgagaaaaatttaagtattttaaaatatttataaatatgtatttctcctcttgtcaattttgatttccccgagcagatgactccgtacgtttaaacactctgtccgactagtcatagcccccaagcatcgggagtcagcctaggcacttcccaaacatgcatatgagtgacatgagtttgtcattaatggaataaagtttcacgaatcataatttactactcgggtacttttgcaattgtaaagagcagaaaataaatttatcttatctctatgcttttgatttattctgaataatacttagaaccttgcgttactcagtccatccaacgagcccccgggtgctaggaatcggcccaaaggcaactatccatcgacaaaccaaacggaaagcataggaagatagaactccataactcgataggtacttttgtactcagattatgtcgcaagcaatcaagataaatattatgaaaattgtttaaaaaatacgatataacatctgtagcccccgactcattagtcaacggcgaaccagttgatgtagtgaggcagaggaaaaaaatatcatataaaaaaaattaatgatgacttagctttgtaatattcccctggtgatggcagaggtggccaatgtgggaacaaagtcgtccatcaataacaatgaagacactagtcggcggcgacgaaggcggtcgacggtgaaagcgaagatgcccactaacggcggcataataggctagccgtgtaggcagagacaccagtcggcgacggcaaaggcaagccggtcggtgaagacgtggacagctatgaacggtggtgtgaccaaccaaccgtataggcgagaacaccagtcggcggcgacggaggcaggccggtcggtgaagacgtggacacgcatgaacggtggtgtgaccaaccaaccgtatagacgaggacaccagtcggcggcgacgaaggcaggccggtggtgaagtcgtaaacgcccaacaacggcggcataataggccagccgtgtaggcggagaaaccagtcggcagcggcgacggaggcgagccagtcggtgaagatgatgttgctatcagtagcagcgtagtaggctggccatgaggacgaacaaaccagtcagcgatgaagtccatgtccatgaagatcgtgtcagtgatatcggaaacaacgtgcctgttatatggctgtcgcatagtcggacatgtaaatacaaatcatatctgattaggagataaaagaacgtgcaagcatgcatctgtatttgctccagtagatcaagcctacgattgttggtagcagcctgtagattaaggaatcttgattggttggcttgtagcaggcagccatgcaatacatggtgatgatgagtagatgcatgtaataagagagctgctacgaagcccctgattatgtcgctgtgagatcgaggaaagatgctggccggactgtttggcgatcgaagtagtcagccagaccatgatgcgcgtgcgtagccaaccgtacaccacatatgttgcaagatcaggactgcaaactttgtagcatgccgtgtatcgtccaaggcacgcggcccatgctatcgacgatcctgttaacagtagtatccggttattctcctgacgataaagtttctctctgaagcgaaaaagcgtgctgacgaaggtgacgctggcggcggccatagtagatcgaatcttaaactcgccgtggtagagtggttgttatcctccttagctagattagatcttccccgactgatttgaatcaaagtcaaagagcgaggcttgttgaagttgtcgatggcgaggaagtcaaagctcctgaggcaaaggcgaagctggcgactcataaaattgattccatcgcactcctcaataggaaactcggcgtacaactacctggcgcgccaactgttgaaacataaattcggcaataataaaaggggtagcgcacgagacctaaaagtggatggatgccgagacaaaggatttagacagattcaggccctctcaatgagaggtaataccctacacctgtttggggatttgaatccgccgagtgtatatagatctgacgatctagttgtcttatatgccccctagagggcctcctgcccaccttatataggatggggggcaggattacaagatagaaaccttaaccaatacggtatcggtttcctaaatctactttacaatattatcaaaccagaactttaggccgttccgtaatatacaaggaaacgtaatacccaagtcatgatctgttacatattacatagataaaagttatctcctataactagtcggataaccatgccgtgtgggtatggggtacccataatctccacacccgtgcgttgcaattcactcacatcatctttcctgctcctctatgggtgatcaatctccctcttcaattcgctcacatcatctttcctgctcctttatgggtgatcaatacattttcgatcgaaccaaaggtataacgtcaagtttggtgaggtgaaatcctgctgagttcatgatacgattcttgatttcatccgttcaaagtctacttaagagaacttggttaccctgttaggagttcataatgtgcctattgatttgcggaacaaagttctctctttgttttttccctggttgtgtttgctgaagcactttgggtggatatttctgaaaaatttcaaatatatgggatgggggtagtacttagtcaagactttctcttagtttcaatgagaagtttggtgctctggacaatgttggtaattgcagtgtgtttgaaatatgctagtacgatttatcattgaagtttttacggcctttcctaagtgaggcagtaacagaattcaatggcgcttgttgaggcaagcaacaaaattgcagcaaatggatctccacactggagctttgaagcagccactttgaccttctcttttgggttattacacgaatcagggcaaaaacgatggacgtccatcatcagtgctgtcagatgcagcgctttttttatgatacataaaaccaggcaagaactgctgtcgaagcctttcattgctgtattattccgtgttcgatgaagttcatggcaaaatcagtgtgattctgtctgcgacatgcattcgatgcattccttgccgttcatgcattacatttttgtgtttgttatcacactaaaatgtcatcttcctgctctctagcgttcttcgaacaccatgccattatcgccaggtcatgcttttgcatccgcctgtgcttggaactcctgaagcaaaagcactgaaaaaacccggctgattcgtgaagaatgcatatagatcgatgctgtcatcgtttcctcgggcggccatggctgcaatggccatattctttttactaccaccaagcaagatccacttacaaacttacaatggtagctgaggggagcgaagggagctagccatgcatcatctctcgctagcagcgatatggacttcccctggactggaatggtgagcaatgcgacatcattgcccgttgggttagtgcaggctgccgctttggcccgcatcagtcaaggcaggcatggttagtgatgcgggccagcccgttgggttaggggcataacccgccccacttttagcccactcatcacagagccaacttttcatattaaaagtcgaccaagtcaccttcactgcgattaatgcaaaatcagtctctatctcctcgacggaacagcaaatgttcagcagggatgcatgagtctgtggctaccttgaacttcaaatccatttgagcacccatcactacagcaaccacaggccacttcaagccacgtacggaactcacctatagtgccatcaaagagccggatttcttcatgtaacccactggtaaaacaaccgatcaggcgcatagcaaaactgctttgcacttgtgatattgcaacctctatggtcgactcacttgtgatattgcagctatgtcaatcgcgccacaataaccatggatgcggcatgtaaacgagctataattccatgttgtctatgtcatctatgattgatacaccatcgatcagctgtagatcttcattttcatatatatattcaccagtcttgatcttcatgtcatattcgattagattagtgccgatcaattggatccctcgcttagggccagccatgtggatgagagaaccctacagaatcaaataagagtaagaaatatctaaagctgaatgcttcccttatgatgtttcacttgtagcaatatttttataccctacagaatcaaatgaaagtaaggaatatctaagacatgttttattattgatggccaagaactttgtcctgtatcaaacagaatgtacaaaatacataacggtgttagagagggaaattgattttgttctgaatcacaggtactaaatcaaataagcatgtaatatattcatgtgcctataagacttagtattcatgctatgcatgttcatatgcctataaacaaatgattcagttttgtgaggtttacttgctagcaaccaagagtccagaattattctatttgattttgtttggaatacatgatacttagtttcatagtatagatctgtttttgttgtaaatcatcatttcacaatatatataagactttgtaaggtagtggcttattgtcatgggccagattttgtaatggcatgataagcatggggccaaatattcggcccagtactaactatccaactactgtcagaagactaggttaaaccagagcctgctccgatgataacatgttaacagacttattaactataaaataattgcatacatgtataaatgtgcacgcctgctccacgacaatgggatcatccctgctaaaattgacaaaataattaagaaatgtatccagcctatcccgcactgctatgtatccatacaactccaccaaaccatggtccgcaggtactttagccaaccttaatgagaaaaattgcaacatacaacaagttccgtgtgacatgcaaattccattgctgtcgatgttgcaatccgtgggctttgaaaacatcattgcctcccaccgagcttcacagaaaaatacaagttctgttaaaattaaaataacacaataaacaaatgctggcgatacaaaatgtaaacatgcttcttgaggattccatagtcccattggaaagttcccctctcatctaaatgaaaaactatccgctcccttgaaaaatttttcttctaggaaatcccaaggataaagagagccatatcaggagtccgggattgatcatgtttttttttttctgtacaggcaaggaacctatccaacatctgttcttccagtgtgttgtctccactagaaaagtagaaagaacgcagatatagctaacctgacaagatcggagtccatgtaggcattagttttaaatcagtgaagaacctttcagtgagttcctgctcactggagagcaacgaaagcctgaagaatcagagcagtgcgaggatgatgagctggaaggggggttttgctgtgctgagctgcactgcacggttgtatctagcttttcttctgcaaatgatgcagagggaatgtgctctggaaaacctggcatatatgatgttattttcatcttgatgccatgcaaatgtactggaactctaaaacgagagtaatctctaaccaccccagaagggaaaaggttcatttattttataaccccctaaactattcctcagttcactatactcccagaactagcaagacaggtcatttcaccccgtaatgaaatatattttcttttttcgttttctagaaatcctcttttatgttgatcttttcccgatggtagacaacacattctatattataattattttcgtgatttccatgactatctgcatagtagggtgtagctagacctgttcaacacttagtatgcacatgtgtgcaccaaaaagaatgaaaagccatagcacagggcatgattacatctatcacttcacaaattttcaaaataaaacatgcttttataagaaacaagaagatcaataacattctggagttaactgaacaaatttccaggcaaaaaaatggcttagggagttatctggacaatcagaaaactttggatagataggagatacaatgtctagtgagatcacaaccttgagtatgatgtcctacacccagggcgatgtcagcacaggctgcaatctgctaaaggtatgatcgttagatgcctcgtgcttttgcacacaccaagcaatgaaaccatgagttgttaatttcagaagatttccatttatatatgccaatgcaccgcaatcaaaaattataagtaaacagaggaaagaaaaattaagtcgagatttacggagagaatatatcagttgaccctatagcttggaaaacgccctaataatgaataaaaataagaaaaagagatcgaccacttactttcattacggtcagcaatatgatactcttttttccagcaatctgtgcccctgtatatagaaccgtcacaatggctgctatatgggagtatctccatagggggtacaccatcctcaattgggtaaacaattagctgaggtacccctgcagccaagctctcttttgtctccactggtcagttcacaaccagtaacatccacaatttctcctgttgcatcagcttgtgtgtctatgactccaaaggttgtcccacaaacaccttcgtaaccagaaatgacattcccgcttgatgtcctcctatcttctgctccattcccgtacaatgagtaatgaacttgttcattgtgtcagtattgcttttctctatatccttcgtgccttgggaaatggcagagtgcttgcccaaggaaataatgaaacccttggcagaagggttgagaggtcttctttctggttcacccaactcctcgccatttactatattgctgctagccatatttcgatatccatgaagaaatctatcacaaagagcatcaaagtcataaataagatggtaagtattatcagtcaggaatgaagtcatatagaatactagtatatccaagcctgaaattggtttctggtttctatctgtgagcctcttttctctgtgtttggaaatcatcatggattaattgcgtggttttcccccatttgcctttttttataaaagaaatcaacaacacaagaagtgtaaataaaaacccagacttggtcccaatccagatcctttataaaggcttgtttggtttactatcataccaaaaaaaataatcaaaatctaggtaattttttacaatagcaatgttttggtaaggtaacattgaaaatgaatgtgtttggattgatgtcaattaggagccaaaatttatattatggtgaagaaagttctagaattgtgtcaaattgagcatgggcattaccaacctttggcttgaaaccaagccaccacattactaactatttaaactaaaaaatactatatattttggcattgatccaaacatgccctaaaatctatatagtagcaacaaaaggcacaaacattaccgtgagaagagaagggctcaccgggaaacactacaggtaggtcgattggctgcggaatcaaagcaatgaactcgtcgcgcaagcgctgatggccaccaccatggagatgccacgaaagacaggagataaggagaggacgaggcggcaaagaggcggcgcattgaggcaggaaaagttgtccagccgctctccaccgtcgctggtcccgcttcgctctccgccgtcagccggccggtcacgaggcggcggcgccggtgcttcgattgttggctgggatcgatggggttagggattttagtggggagacgaacagtttagttggtgaaaagaaatttatttttgtcattgaccggatattaaaagatattttcaaatacgaataaaagaactaatttcataactcgcctagaaaccgcgatacgaatttattaagcctaattaatccatcattagcacatgtgggtttatgtagcacttatggctaatcatggactaattaggcttaaaagattcgtcttgtgatttccatgcaaactgtacaactagttttttattttatttatatttaatgctccatgtatgtgttaaagattcgatgtgtctgcattgtactgtgtaattttaaaaaaaaattctcctccactctgtgtgtgtttggtttctggaatagttagaaaagaatggaagtttgaggggtggggttgttaaatacgttgtttggatggtatctacggattgaaggagttctactcggacaagactgggtctttaccatatcgtgaggggtccgatatctccgagtcctacttggagatcaagtgacccgcggtatataagataccccctgggtaggacctaaggcatcgaatatcaccaccaacacatccaccacagcctacggagccggagcacgcaggagccaagccaccgggagatctagtgggaccaactcgactacggtctcgtcggtatcatcgagttctgctattccctttataatctgtggttttcatcatataatcccataccaactggattatggctattacttaccaaggagcctgaaccagtataatccttgtcttttgtttgcttgttgtcgtactatgtagatcctcgtaccaatggaccccaataccctctatatctggtctacgggtacccaccgtcgacagcgctgccttcctgtggcgaccctgctgccgcctcccctcccgctggatctggcagaggagagggcgccaccgcttgccgccacctccccgtgggaagcacgccgcccctgcaacactccccgacctccatcaccagagagatagagtggatagagagagaggggtaagaggaggagaagaagaagaagagatagggggagagagaggggatcgcggagaggatgaggagaaaaagaatctcgatgacctattgcatcgtgcactttgtagtccaccacttgactcggctcggttttggaaggtatcggttttaaattaaccatctgttaacaacggaattttgcatcagaattggaaaagaaggaacaagattgaagtggattttgtgcggaattgagttggatttggagtcggactgcgcatcgtctaggcatcgtatcagctagaaacagagtcggagtttgactaagccgatatggcaagtggccgatacggcctgacttgggttcgatatgggcccagattggaatatccgtcattgccaattagagataaaactcgattaaggcaatttggaattatctatttatgttatcctaagttgcaatgatgcatatcttggttgaccacgagtaccaataattgtgtactgaaactggtattggcaatgcggttccatggaattcagttcacgccaatttcctatggcgcaccctctttggtgtcactattaggtggtgccagggcgggttgtgatagccagccattccgaagttcttgccttgccatcccgccatccgccctattgacttgtggaacaaagcttgatggtctattttctgcagtcttccaatggacaatggtagaccgaggtatttcattgggaacaaaggtctggtcactaggatgttttctaggatctcatcgaggccgatgtcactgcatctaatagggcaacctgtgacttttgtatgttggcgcacaacccagttgcctgcccaaagttttgcaatgcctggacatcttcttgtttttaggtcgatgaagaccgccagtcatatgcatatattaagattcggaaacgcaccgaccttcctcaaggattactaatcagcccaaggtccgttgctttggatatatagcagtcgttgctataggtctattgctgtgatgatagaaagtgggtctccttgaaataggtccatggcatgatgtatcacatttgcggggatgctattttgcgggatcttaaaaccgaaagttgtcaacaaccccacaacccagtcatcatatctttgtggaaaactatgttgatgtagttccactttatagagtcaaaagctttttgaaatgtccacttaaagaggagcatgaagttgttatgtatgctcgcccacaaataaagacattttgattgccgaaatcaacaagtgtattagagcaggtgcaataaggctgattttggcacttagctttcctaactcatactctttgtttttagctttcctagatagactgtagttttgtatttatgtttaacgtttgaccgtccgttttattttgaaaaaaaaattacgattagtatttttgttgttattagatgatactttatgtgtgactaattgtttttataattttttcacataagataaacgatcaaacgttggacataaaaactataactatacttaaaatgagacagaaatagtatttgaaaaacgtgctaacagaaaatcgtaaactcaattagcccttatagggctctactcacagtatattcatttcatctcaaacccatggtctgcactgctagaaaataaaaataaaaaataaaaaacgatgagtaaaatttggaaatggagagagcaaagcaaccaactcgctggctcgctgtgggcccggcctatcgacttctccacctgctccgtctgctgcgagtcaaacatgttctcgtcctcttcgtctatgaccagttgaccaccactccactgaccactgatcagtctctgctgctgctgcgtggaactcttccagctcgccgccgagcttccccaggatcacggcggtgagctccggccatcaatcaacattcgcccccgccgtcttttgcggttcgtgttgattccccacctgctgatctagatctgcttctgcttctgtttcgcaggatctttctttgcgtacggtcgaggagcatatggaggggtttctggtgaccgcggccaccggggcactcaagtccgtcctggtgaagctcgccgccatggccggcgaattcgaaggggtgcgcggccagatcagtttcctcgccgacgagttcgccgccatgcacgcgttcctcctcaggatgtcggattcggaggaggggaacgctgaccctcaggacaaggcctggacgagggaggtgcgggagctctcctacgacatcgaggacagcctcgacgagttcatgctccatgtcgtcgacggatccgctaatccggatgggttcatcgtcaaatgcaggaatttgctgaccaagaccatggcccggcgtcggattgccaagatgattgctgagttcaaggcacaaatcaaagaagtgggggagaggaatgcgcgatatatgaatggtgggatcagtttgatgaggacagctaatgcgaccgtagaccaaagagctcttaccatctttcaggatgtgtcatctctagttggggttgatcagccgaagaaggagctcatcgatctgttgatgaaagatgatgggcatgtggcatccgagcatctaaggaccatctccattgttggaattgggggattagggaagacaacgatcgcaaacctcatctttgaggagctgagggagcaattcgattgttctgcttttgtgtctgtgtcaagaaaccctgtgtggatattatgggtaccccatacccatacggcatggttatccgactagtcataggggataacttatatctatgggatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtcttcgcatccatccacttttaggtctcgtgcgctacccccttttattattgccgaattcatgtttcgacagttggcgcgccaggtaggggtgcgtcgagattcccgtcggtaaagtgcgttggaatcaatcaccaacatgaccggatcgtacacgcgcgtcattcaccgccgcaagaagcacggagggcgcgtctcatcagagcgttgagcgcctgccagatcgagagatcgcgccgatcggtcgtgtgctgtttggacttccggatcggcgagcagctacgcgtgaccggcagcaaccagccgccggcgcatgatctccgtcgacgtcgcttggtctaattcaatccggccgaccacctcgatcaatctacatccatgcggctgtatagtccacgcgtcagatcgatccgcatgtgcatcacatgacgagggtcaagcagggagcaagactatggcatatgcatctaatcttcttccctgctaatagattgaatattaaatcagattgattgatggtctttttcctctttgctctttcttctggtgtatgcatgttgccggcgaccaaggtgttcaattaggcacggtatgattaagccgtcgctacgcaaggcgaagccgtccactctctgagcgaatccaactcgtgggctggacaggcatgcacgaaagttcacataacgagatcgctggagatgtacaggatgtgtcgattcaaccgccatgcatggattaattaatccagccatacatgcattcaatcgctgagatttatacatttaatttgctgatattaatcagatttattttatttgtttccatgagaatctcggagcatcaccgatggacgtcctgcgggctatggccaccacgggccacacatgggaacagccagcctatggctaatcaggagagaacacgtgcagaaagttgatcttaccgatcaacaagcaccattaatttacttaatcatgcctatatatttttatcattaaccaagttggtttgttgtcttgttctgtaagcacgccgagccatggatcgcttgattagtcctagcgacagagtgcaacaccagcaaccaattttctccgtctcggagtcagtccggtcgagaaaatcaatctcggcgagttcaacaatttaaatctccgactccgccgggttttttccttttcaacttattgttgtttattagattgatctctaaatatcagattaatctcttggtatttcctgttgtttacatgtaatgctgtggcactgctgttgccgattggtgtttccgcctgcacggctggcctattatgccgtcgttgttgggcatctacgacttcactgtcggcctacctccgtcgccgccaactggtgtcctcgcctaaacggttggttggtcacaccaccgttcatgggcgtccacgtcttcaccgatcggctagccttcgttgccgccgactggtgttctcgcctatacggttggatggtcgcaccaccgttcataggcatccacgacttcaccgccggcctgcctccgtcgccgccgagtggtgcctccgcctacacggctggcctattatgccgccgctgttgggcgtctgcgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagcggtgcctccgcctacacggctggcctattatgccgccgctgttgggcgtctacgacttcaccgccggcgtgcctccgtcgccgccgagtggtgcctccgcctacacggctggcctattatgccgccgctgttgggcgtctacgacttcaccgccggcctgcctccgtcgccgccgagtggtgcctccgcctacacggctgacctattatgccgccgctgttgggcgtcttcgctttcacaatcgaccgccatcgtcgccgccgactggtgtcttcattgttattgatggacgactttgttcccacattggccacttctaccatcaccaaggggaatattacaaagctaagtcatcatttattttattctttatatgatatttttcctttttctctgcctcactacaccaattggtcttccattgagtagtgagtcgggggctacagatgttatatcatattttttataatatttatcttcattgcttgcgacataatctgagtacaaaagtacctatcgagttatggagttctatcttcctctgctttccgtttggtttgccaatggatggttgcctttgggccgattcctagcacccgggggctcgttggatggaccgagtaacgcaaggtgctaaatattattcggaataaatcaaaagcatagagatgagataaatttattttctgctcttaataattgcaaaagtacccgagtagtaaattctgatccgtgaaactttattccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggttttaagcttatctcttacgctccaggaatggatcagtcagaacatcaccaaccggccgcctcgtctgccgccgactggtgcttccgcctgcacggctgacttattatgccgccgttgttgggcgtctacgacttcaccgaccggcttgccttcgccgccgccgactggtgcttccgcctgcacggctgacttattatgccgccgttgttgggcgtctacgacttcaccgaccggcttgccttcgccgccgccgactggtgtttccgcctgcacggctggcctttaatgccgccgttgttgggcgtctacgtcttcaccgaccggcttgccttcgccgccgccgactggtgcttccgcctgcacggctggcctattatgccgccgttgttgggcgtctacgtcttcaccgaccggcttgccttcgccgccgccgactggtgtttccgcctgcacggctgacttattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgaccgccgccgactggtgtttccgcctgcacggctggcctattatgctgccgttgttaggcgtctacgtcttcaccgaccggccgccgcatccgccgctgactggtgtcaccgcttgcacggctggcctgttataacgccaactgatgctatcttcttcacggctggctacatagctgtcactactaataggcatcagtatcttcaacacaagctgcctacatttgccatggctgccgactgttttcttcacttccatggctgcatgattctgccagtgttgattggccttaccatcttcatcgccggtcgtctcgtctgctgctgactagtgccctcgcttctacatctggtttatacaactatcactactgatgaacatcacgtcttccgtcgccgactggatatgttgtcgccgactagtgcttttattttcacaactgcgcgtcttcactaccagtttgctactgttgccgacgactcgtgttcacttcatcacggcaatgcaactttgtcatcatggtagagcgacttcatctttattatcttcggcactggcaaactctattgatgctacttcgcaagttttgctacttcaccaaccacgacgtctttgtgagcctcgacatctcggcatgcgatgccatgttattttactacaacaagaggctctccaatattcaggatttctacttgaacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttggacaacaacatcaactctcctccaagtgaagcatctacaacagctataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtctttgtcattttcattggttgctacactgctattggctggatcaccgacatcgtcatcttcatcatgtcggttgcgtttgttgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaatagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttctaggtgtggtgaaaccatgtgtcttctagggacttaagcacatctgttaaagcagtgtgcgcatggcgtatgcccaatactttggaaattcctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcacttaaccacatngtcgggggctacacctattaggtgcatctagtcggtgcacctgacttattttcaagccctccacaatcttcagatttggtaaaagtactcgggagaccatgacaaagatgattgaagcactccgctttggagtaatatggttcgagagaagattatcttttcgactgcgaaggtctcaggggctactgtggatattatgggtaccccatacccatacggcatggttatccgactagtcataggggataacttatatctatgggatatgtaatagatcatgactcgggtattacgtttcccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtcttcgcatccatccacttttaggtctcgtgcgctacccccttttattattgccgaattcatgtttcgacaccctgacatctctggaatcttgagaattattctcagtgaagttagcgccgaaccttatggcaacactgaatcaggggacatacaacaactcattagaaaaatcactacttcccttaagaacaaaaggtatgcaaaattctaaccttcaatcatatattcttatctccaaaatatatggtgtgtgtattataaggccagaccttcaagattttaagcctttagttcattctttgccggtccaacttgctaagtagtccgtgttttcttttacttgcattcagctctcttatgtgcataccattctgcttttcagattttatttacaaatataggtttgaaccatagcaaaaggttgagcaaaaatcattcgaggacatagtcttgccaaacatgaaaactgctcactttcattatgattttttaataaagtatccataagggacacatttcacctaacaaaaatattgtttttgacaagagggaccagattcttggctgttgaatgaattatggtttagctgattcattagtggatggagtctgagaactacccgccttgttacatttctttaatcaaatatccatgtgctataagtgttacaaccatagctacaatcatgcaaaatcagtaacaatggggacacatttcacctaactgagacatgatttagagaagcgagaccagatttgtgttaatttaacaagtcagctttagttgaattattctaggacgacatgagaccgaaatgggaaaaatatcccctttctaacatttatttgatcaaatatttctactgatgcttataataaaaaaattggcaggtatcttattgtgattgatgacttatggaatatagaaagttggaaaattattagatgtgctttttcaagaagtattactggcagccgaatcatcacaaccacacgtataaatgaagtagctgaatcttgctgcttcccacatgtgcatcgggtatataaattaaggcctcttcattttgttgattcaaaaaggttgtttctgaagagaatttttggtctggaggaatgtccatcacacctgactgaagtttgttgtaacatattggcaaaatgtgatggtttacccttggcaactattgcaatatccagtttattggctacaaaagcaccgacagaagatcaatggaatcaagtggaaaagtcaattggttatgcattggaaagaaacgaggatgtcaatggaatgataaggatactgtcgcttagttactttgatcttcctcataacttgcgtacatgtctattatatctatgtacatttccagaagattatattattcataaaaaacggttggttagaagatggattgcagagggatttattcacgaggaacatggacatacattatatgaattggggcagaggtgtttcaatgagctgatcaatagaagtttgattgagccaaggtatattggcaagttcggtgaggtgaaatcctgtcgagttcatgatacgattcttgatttcatccggtcaaagtctattgaagagaacttcgtaaccttgttaggaattcctaacgttcctattgatcggcagaagaaggtccggcggctatccctccttgttaatactgaagagtattatagcagtttggagngagaatcagtcataaaatatgtcctggataaaaaagaagatgatagcaatgagcaggaagataacagtaacggttttcatatcctaaaaaagttgaatttgggggccccccaaaaaaattgggggtccctttaacccggggaaaattttcgggcccctttaaaaaaaccatattttcttccaacattctgtgaaagtcccatctttgttgcagtttaggcggttgcgtgtgctcgactttgaaggctgtgagcagttagaaaatcatcaccttgcaaatatagagaatttattgcacctgaagtacctcagcatcaaagatacaattgttaatgtgcttccgactcagataacaagactacgatgtttacagacattgaatgtagatgtaagaggggcaattaacattccaacacatatttatcgacttcgacaactgacttatctacttgttgatatgagatgtcaactgccggataaaattgggaacatgcaagcattgcaagagctcaaagttgtgaatgtgcttgcgcagtcactgaacacgctgcaaggacttggtaaattaacaaacctgaggaagcttagtatatttatg

SEQ ID NO: 60441 - DNA, 7702 bp, Oryza sativa
cgcaagttatgaggaagatcaaagtaactaagcgacagtatccttatcattccattgacatcctcgtttctttccaatgcataaccaattgacttttccacttgattccattgatcttctgtcggtgcttttgtagccaataaactggatattgcaatagttgccaagggtaaaccatcacattttgccaatatgttacaacaaacttcagtcaggtgtgatggacattcctccagaccaaaaattctcttcagaaacaacctttttgaatcaacaaaatgaagaggccttaatttatatacccgatgcacatgtgggaagcagcaagattcagctacttcatttatacgtgtggttgtgatgattcggctgccagtaatacttcttgaaaaagcacatctaataattttccaactttctatattccataagtcatcaatcacaataagatacctgccaatttttttattataagcatcagtagaaatatttgatcaaataaatgttagaaaggggatatttttcccatttcggtctcatgtcgtcctagaataattcaactaaagctgacttgttaaattaacacaaatctggtctcgcttctctaaatcatgtctcagttaggtgaaatgtgtccccattgttactgattttgcatgattgtagctatggttgtaacacttatagcacatggatatttgattaaagaaatgtaacaaggcgggtagttctcagactccatccactaatgaatcagctaaaccataattcattcaacagccaagaatctggtccctcttgtcaaaaacaatatttttgttaggtgaaatgtgtcccttatggatactttattaaaaaatcataatgaaagtgagcagttttcatgtttggcaagactatgtcctcgaatgatttttgctcaaccttttgctatggttcaaacctatatttgtaaataaaatctgaaaagcagaatggtatgcacataagagagctgaatgcaagtaaaagaaaacacggactacttagcaagttggaccggcaaagaatgaactaaaggcttaaaatcttgaaggtctggccttataatacacacaccatatattttggagataagaatatatgattgaaggttagaattttgcataccttttgttcttaagggaagtagtgatttttctaatgagttgttgtatgtcccctgattcagtgttgccataaggttcggcgctaacttcactgagaataattctcaagattccagagatgtcagggtgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacagtagcccctgagaccttcgcagtcgaaaagataatcttctctcgaaccatattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaaggaatttccaaagtattgggcatacgccatgcgcacactgctttaacagatgtgcttaagtccctagaagacacatggtttcaccacacctagaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactatttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacaacaaacgcaaccgacatgatgaagatgacgatgtcggtgatccagccaatagcagtgtagcaaccaatgaaaatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgttcaagtagaaatcctgaatattggagagcctcttgttgtagtaaaataacatggcatcgcatgccgagatgtcgaggctcacaaagacgtcgtggttggtgaagtagcaaaacttgcgaagtagcatcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcatcagtagtgatagttgtataaaccagatgtagaagcgagggcactagtcagcagcagacgagacgaccggcgatgaagatggtaaggccaatcaacactggcagaatcatgcagccatggaagtgaagaaaacagtcggcagccatggcaaatgtaggcagcttgtgttgaagatactgatgcctattagtagtgacagcgatgtagccagccgtgaagaagatagcatcagttggcgttataacaggccagccgtgcaagcggtgacaccagtcagcggcggatgcggcggccggtcggtgaagacgtagacgcctaacaacggcagcataataggccagccgtgcaggcggaaacaccagtcggcggcggtcgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataagtcagccgtgcaggcggaagcaccagtcggcggcggcgaaggcaagccggtcggtgaagtcgtagacgcccaacaacggcggcataataagtcagccgtgcaggcggaagcaccagtcggcggcagacgaggcggccggttggtgatgttctgactgatccattcctggagcgtaagagataagcttaaaaccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaataaagtttcacggatcagaatttactactcgggtacttttgcaattattaagagcagaaaataaatttatctcatctctatgcttttgatttattccgaataatatttagcaccttgcgttactcggtccatccaacgagcccccgggtgctaggaatcggcccaaaggcaaccatccattggcaaaccaaacggaaagcagaggaagatagaactccataactcgataggtacttttgtactcagattatgtcgcaagcaatgaagataaatattataaaaaatatgatataacatctgtagcccccgactcactactcaatggaagaccaattggtgtagtgaggcagagaaaaaggaaaaatatcatataaagaataaaataaatgatgacttagctttgtaatattccccttggtgatggtagaagtggccaatgtgggaacaaagtcgtccatcaataacaatgaagacaccagtcggcggcgacgatggcggtcgattgtgaaagcgaagacgcccaacagcggcggcataataggtcagccgtgtaggcggaggcaccactcggcggcgacggaggcaggccggcggtgaagtcgtagacgcccaacagcggcggcataataggccagccgtgtaggcggaggcaccactcggcggcgacggaggcacgccggcggtgaagtcgtagacgcccaacagcggcggcataataggccagccgtgtaggcggaggcaccactcggcggcgacggaggcaggccgacggtgaagtcgtagacgcctaacagcggcggcataataggccagccgtgtaggcggaggcaccactcggcggcgacggaggcaggccggcggtgaagtcgcagacgcccaacagcggcggcataataggccagccgtgtaggcggaggcaccactcggcggcgacggaggcaggccggcggtgaagtcgtggatgcctatgaacggtggtgcgaccatccaaccgtataggcgagaacaccagtcggcggcaacgaaggctagccgatcggtgaagacgtggacgcccatgaacggtggtgtgaccaaccaaccgtttaggcgaggacaccagttggcggcgacggaggtaggccgacagtgaagtcgtagatgcccaacaacgacggcataataggccagccgtgcaggcggaaacaccaatcggcaacagcagtgccacagcattacatgtaaacaacaggaaataccaagagattaatctgatatttagagatcaatctaataaacaacaataagttgaaaaggaaaaaacccggcggagtcggagatttaaattgttgaactcgccgagattgattttctcgaccggactgactccgagacggagaaaattggttgctggtgttgcactctgtcgctaggactaatcaagcgatccatggctcggcgtgcttacagaacaagacaacaaaccaacttggttaatgataaaaatatataggcatgattaagtaaattaatggtgcttgttgatcggtaagatcaactttctgcacgtgttctctcctgattagccataggctggctgttcccatgtgtggcccgtggtggccatagcccgcaggacgtccatcggtgatgctccgagattctcatggaaacaaataaaataaatctgattaatatcagcaaattaaatgtataaatctcagcgattgaatgcatgtatggctggattaattaatccatgcatggcggttgaatcgacacatcctgtacatctccagcgatctcgttatgtgaactttcgtgcatgcctgtccagcccacgagttggattcgctcagagagtggacggcttcgccttgcgtagcgacggcttaatcataccgtgcctaattgaacaccttggtcgccggcaacatgcatacaccagaagaaagagcaaagaggaaaaagaccatcaatcaatctgatttaataatcaatctaattagcaggaagaagattagatgcatatgccatagtcttgctccctgcttgaccctcgtcatgtgatgcacatgcggatcgatctgacgcgtggactatacagccgcatggatgtagattgatcgaggtggtcggccggattgaattagaccaagcgacgtcgacggagatcatgcgccggcggctggttgctgccggtcacgcgtagctgctcgccgatccggaagtccaaacagcacacgaccgatcggcgcgatctctcgatctggcaggcgctcaacgctctgatgagacgcgccctccgtgcttcttgcggcggtgaatgacgcgcgtgtacgatccggtcatgttggtgattgattccaacgcactttaccgacgggaatctcgacgcacccctacctggcgcgccaactgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatataggggggggggcaggatta

SEQ ID NO: 60442 - DNA, 28696 bp, Oryza sativa
atgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacaacaaacgcaaccgacatgatgaagatgacgatgtcggtgatccagccaatagcagtgtagcaaccaatgaaaatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgttcaagtagaaatcctgaatattggagagcctcttgttgtagtaaaataacatggcatcgcatgccgagatgtcgaggctcacaaagacgtcgtggttggtgaagtagcaaaacttgcgaagtagcatcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcatcagtagtgatagttgtataaaccagatgtagaagcgagggcactagtcagcagcagacgagacgaccggcgatgaagatggtaaggccaatcaacactggcagaatcatgcagccatggaagtgaagaaaacagtcggcagccatggcaaatgtaggcagcttgtgttgaagatactgatgcctattagtagtgacagcgatgtagccagccgtgaagaagatagcatcagttggcgttataacaggccagccgtgcaagcggtgacaccagtcagcggcggatgcggcggccggtcggtgaagacgtagacgcctaacaacggcagcataataggccagccgtgcaggcggaaacaccagtcggcggcggtcgaggcggccggtcggtgaagacgtagacgcccaacaacggcggcattaaaggccagccgtgcaggcggaaacaccagtcggcggcggcgaaggcaagccggtcggtgaagtcgtagacgcccaacaacggcggcataataagtcagccgtgcaggcggaagcaccagtcggcggcggcgaaggcaagccggtcggtgaagtcgtagacgcccaacaacggcggcataataagtcagccgtgcaggcggaagcaccagtcggcggcagacgaggcggccggttggtgatgttctgactgatccattcctggagcgtaagagataagcttaaaaccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaataaagtttcacggatcagaatttactactcgggtacttttgcaattattaagagcagaaaataaatttatctcatctctatgcttttgatttattccgaataatatttagcaccttgcgttactcggtccatccaacgagcccccgggtgctaggaatcggcccaaaggcaaccatccattggcaaaccaaacggaaagcagaggaagatagaactccataactcgataggtacttttgtactcagattatgtcgcaagcaatgaagataaatattataaaaaatatgatataacatctgtagcccccgactcactactcaatggaagaccaattggtgtagtgaggcagagaaaaaggaaaaatatcatataaagaataaaataaatgatgacttagctttgtaatattccccttggtgatggtagaagtggccaatgtgggaacaaagtcgtccatcaataacaatgaagacaccagtcggcggcgacgatggcggtcgattgtgaaagcgaagacgcccaacagcggcggcataataggtcagccgtgtaggcggaggcaccactcggcggcgacggaggcaggccggcggtgaagtcgtagacgcccaacagcggcggcataataggccagccgtgtaggcggaggcaccactcggcggcgacggaggcacgccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccgacggtgaagtcgtagacgcctaacagcggcggcataataggccagccgtgtaggcggaggcaccactcggcggcgacggaggcaggccggcggtgaagtcgcagacgcccaacagcggcggcataataggccagccgtgtaggcggaggcaccactcggcggcgacggaggcaggccggcggtgaagtcgtggatgcctatgaacggtggtgcgaccatccaaccgtataggcgagaacaccagtcggcggcaacgaaggctagccgatcggtgaagacgtggacgcccatgaacggtggtgtgaccaaccaaccgtttaggcgaggacaccagttggcggcgacggaggtaggccgacagtgaagtcgtagatgcccaacaacgacggcataataggccagccgtgcaggcggaaacaccaatcggcaacagcagtgccacagcattacatgtaaacaacaggaaataccaagagattaatctgatatttagagatcaatctaataaacaacaataagttgaaaaggaaaaaacccggcggagtcggagatttaaattgttgaactcgccgagattgattttctcgaccggactgactccgagacggagaaaattggttgctggtgttgcactctgtcgctaggactaatcaagcgatccatggctcggcgtgcttacagaacaagacaacaaaccaacttggttaatgataaaaatatataggcatgattaagtaaattaatggtgcttgttgatcggtaagatcaactttctgcacgtgttctctcctgattagccataggctggctgttcccatgtgtggcccgtggtggccatagcccgcaggacgtccatcggtgatgctccgagattctcatggaaacaaataaaataaatctgattaatatcagcaaattaaatgtataaatctcagcgattgaatgcatgtatggctggattaattaatccatgcatggcggttgaatcgacacatcctgtacatctccagcgatctcgttatgtgaactttcgtgcatgcctgtccagcccacgagttggattcgctcagagagtggacggcttcgccttgcgtagcgacggcttaatcataccgtgcctaattgaacaccttggtcgccggcaacatgcatacaccagaagaaagagcaaagaggaaaaagaccatcaatcaatctgatttaataatcaatctaattagcaggaagaagattagatgcatatgccatagtcttgctccctgcttgaccctcgtcatgtgatgcacatgcggatcgatctgacgcgtggactatacagccgcatggatgtagattgatcgaggtggtcggccggattgaattagaccaagcgacgtcgacggagatcatgcgccggcggctggttgctgccggtcacgcgtagctgctcgccgatccggaagtccaaacagcacacgaccgatcggcgcgatctctcgatctggcaggcgctcaacgctctgatgagacgcgccctccgtgcttcttgcggcggtgaatgacgcgcgtgtacgatccggtcatgttggtgattgattccaacgcactttaccgacgggaatctcgacgcacccctacctggcgcgccaactgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacacagggtttcttgacacagacacaaaagcagaacaatcgaattgctccctcagctcctcaaagatgaggtttgcgatcgttgtcttccctaatcccccaattccaacaatggagatggtccttagatgctcggatgccacatgcccatcatctttcatcaacagatcgatgagctccttcttcggctgatcaaccccaactagagatgacacatcctgaaagatggtaagagctctttggtctacggtcgcattagctgtcctcatcaaactgatcccaccattcatatatcgcgcattcctctcccccacttctttgatttgtgccttgaactcagcaatcatcttggcaatccgacgccgggccatggtcttggtcagcaaattcctgcatttgacgatgaacccatccggattagcggatccgtcgacgacatggagcatgaactcgtcgaggctgtcctcgatgtcgtaggagagctcccgcacctccctcgtccaggccttgtcctgagggtcagcgttcccctcctccgaatccgacatcctgaggaggaacgcgtgcatggcggcgaactcgtcggcgaggaaactgatctggccgcgcaccccttcgaattcgccggccatggcggcgagcttcaccaggacggacttgagtgccccggtggccgcggtcaccagaaacccctccatatgctcctcgaccgtacgcaaagaaagatcctgcgaaacagaagcagaagcagatctagatcagcaggtggggaatcaacacgaaccgcaaaagacggcgggggcgaatgttgattgatggccggagctcaccgccgtgatcctggggaagctcggcggcgagctggaagagttccacgcagcagcagcagagactgatcagtggtcagtggagtggtggtcaactggtcatagacgaagaggacgagaacatgtttgactcgcagcagacggagcaggtggagaagtcgataggccgggcccacagcgagccagcgagttggttgctttgctctctccatttccaaattttactcatcgttttttattttttatttttattttctagcagtgcagaccatgggtttgagatgaaatgaatatactgtgagtagagccctataagggctaattgagtttacgattttctgttagcacgtttttcaaatactatttctgtctcattttaagtatagttatagtttttatgtccaacgtttgatcgtttatcttatgtgaaaaaattataaaaacaattagtcacacataaagtatcatctaataacaacaaaaatactaatcgtaatttttttttcaaaataaaacggacggtcaaacgttaaacataaatacaaaactacagtctatctaggaaagctaaaaacaaagagtatgagttaggaaagctaagtgccaaaatcagccttattgcacctgctctaatacacttgttgatttcggcaatcaaaatgtctttatttgtgggcgagcatacataacaacttcatgctcctctttaagtggacatttcaaaaagcttttgactctataaagtggaactacatcaacatagttttccacaaagatatgatgactgggttgtggggttgttgacaactttcggttttaagatcccgcaaaatagcatccccgcaaatgtgatacatcatgccatggacctatttcaaggagacccactttctatcatcacagcaatagacctatagcaacgactgctatatatccaaagcaacggaccttgggctgattagtaatccttgaggaaggtcggtgcgtttccgaatcttaatatatgcatatgactggcggtcttcatcgacctaaaaacaagaagatgtccaggcattgcaaaactttgggcaggcaactgggttgtgcgccaacatacaaaagtcacaggttgccctattagatgcagtgacatcggcctcgatgagatcctagaaaacatcctagtgaccagacctttgttcccaatgaaatacctcggtctaccattgtccattggaagactgcagaaaatagaccatcaagctttgttccacaagtcaatagggcggatggcgggatggcaaggcaagaacttcggaatggctggctatcacaacccgccctggcaccacctaatagtgacaccaaagagggtgcgccataggaaattggcgtgaactgaattccatggaaccgcattgccaataccagtttcagtacacaattattggtactcgtggtcaaccaagatatgcatcattgcaacttaggataacataaatagataattccaaattgccttaatcgagttttatctctaattggcaatgacggatattccaatctgggcccatatcgaacccaagtcaggccgtatcggccacttgccatatcggcttagtcaaactccgactctgtttctagctgatacgatgcctagacgatgcgcagtccgactccaaatccaactcaattccgcacaaaatccacttcaatcttgttccttcttttccaattctgatgcaaaattccgttgttaacagatggttaatttaaaaccgataccttccaaaaccgagccgagtcaagtggtggactacaaagtgcacgatgcaataggtcatcgagattctttttctcctcatcctctccgcgatcccctctctctccccctatctcttcttcttcttctcctcctcttacccctctctctctatccactctatctctctggtgatggaggtcggggagtgttgcaggggcggcgtgcttcccacggggaggtggcggcaagcggtggcgccctctcctctgccagatccagcgggaggggaggcggcagcagggtcgccacaggaaggcagcgctgtcgacggtgggtacccgtagaccagatatagagggtattggggtccattggtacgaggatctacatagtacgacaacaagcaaacaaaagacaaggattatactggttcaggctccttggtaagtaatagccataatccagttggtatgggattatatgatgaaaaccacagattataaagggaatagcagaactcgatgataccgacgagaccgtagtcgagttggtcccactagatctcccggtggcttggctcctgcgtgctccggctccgtaggctgtggtggatgtgttggtggtgatattcgatgccttaggtcctacccagggggtatcttatataccgcgggtcacttgatctccaagtaggactcggagatatcggacccctcacgatatggtaaagacccagtcttgtccgagtagaactccttcaatccgtagataccatccaaacaacgtatttaacaaccccacccctcaaacttccattcttttctaactattccagaaaccaaacacacacagagtggaggagaatttttttttaaaattacacagtacaatgcagacacatcgaatctttaacacatacatggagcattaaatataaataaaataaaaaactagttgtacagtttgcatggaaatcacaagacgaatcttttaagcctaattagtccatgattagccataagtgctacataaacccacatgtgctaatgatggattaattaggcttaataaattcgtatcgcggtttctaggcgagttatgaaattagttcttttattcgtatttgaaaatatcttttaatatccggtcaatgacaaaaataaatttcttttcaccaactaaactgttcgtctccccactaaaatccctaaccccatcgatcccagccaacaatcgaagcaccggcgccgccgcctcgtgaccggccggctgacggcggagagcgaagcgggaccagcgacggtggagagcggctggacaacttttcctgcctcaatgcgccgcctctttgccgcctcgtcctctccttatctcctgtctttcgtggcatctccatggtggtggccatcagcgcttgcgcgacgagttcattgctttgattccgcagccaatcgacctacctgtagtgtttcccggtgagcccttctcttctcacggtaatgtttgtgccttttgttgctactatatagattttagggcatgtttggatcaatgccaaaatatatagtattttttagtttaaatagttagtaatgtggtggcttggtttcaagccaaaggttggtaatgcccatgctcaatttgacacaattctagaactttcttcaccataatataaattttggctcctaattgacatcaatccaaacacattcattttcaatgttaccttaccaaaacattgctattgtaaaaaattacctagattttgattattttttttggtatgatagtaaaccaaacaagcctttataaaggatctggattgggaccaagtctgggtttttatttacacttcttgtgttgttgatttcttttataaaaaaaggcaaatgggggaaaaccacgcaattaatccatgatgatttccaaacacagagaaaagaggctcacagatagaaaccagaaaccaatttcaggcttggatatactagtattctatatgacttcattcctgactgataatacttaccatcttatttatgactttgatgctctttgtgatagatttcttcatggatatcgaaatatggctagcagcaatatagtaaatggcgaggagttgggtgaaccagaaagaagacctctcaacccttctgccaagggtttcattatttccttgggcaagcactctgccatttcccaaggcacgaaggatatagagaaaagcaatactgacacaatgaacaagttcattactcattgtagcgggaatggtgcagaagatgggaggacatcaagcgggaatgtcatttctggttacgaaggtgtttgtgggacaacctttggagtcatagacaacaaagctgatacaacaggagaaattgtggatgttactggttgtgaactgagcagtggagacaaaagagagcttggctgcaggggtaccacagctaattgtttacccaattgaggatggtgtaccccctatggagatactcccatatagcagccattgtgacggttctatatacaggggcacagattgctggaaaaaagagtatcatattgctgaccgtaatgaaagtaagtggtcgatctctttttcttatttttattcattattagggcgttttccaagctatagggtcaactgatatattctctccgtaaatctcgacttaatttttctttcctctgtttacttataatttttgattgcggtgcattggcatatataaatggaaatcttctgaaattaacaactcatggtttcattgcttggtgtgtgcaaaagcacgaggcatctaacgatcatacctttagcagattgcagcctgtgctgacatcgccctgggtgtaggacatcatactcaaggttgtgatctcactagacattgtatctcctatctatccaaagttttctgattgtccagataactccctaagccatttttttgcctggaaatttgttcagttaactccagaatgttattgatcttcttgtttcttataaaagcatgttttattttgaaaatttgtgaagtgatagatgtaatcatgccctgtgctatggcttttcattctttttggtgcacacatgtgcatactaagtgttgaacaggtctagctacaccctactatgcagatagtcatggaaatcacgaaaataattataatatagaatgtgttgtctaccatcgggaaaagatcaacataaaagaggatttctagaaaacgaaaaaagaaaatatatttcattacggggtgaaatgacctgtcttgctagttctgggagtatagtgaactgaggaatagtttagggggttataaaataaatgaaccttttcccttctggggtggttagagattactctcgttttagagttccagtacatttgcatggcatcaagatgaaaataacatcatatatgccaggttttccagagcacattccctctgcatcatttgcagaagaaaagctagatacaaccgtgcagtgcagctcagcacagcaaaaccccccttccagctcatcatcctcgcactgctctgattcttcaggctttcgttgctctccagtgagcaggaactcactgaaaggttcttcactgatttaaaactaatgcctacatggactccgatcttgtcaggttagctatatctgcgttctttctacttttctagtggagacaacacactggaagaacagatgttggataggttccttgcctgtacagaaaaaaaaaaacatgatcaatcccggactcctgatatggctctctttatccttgggatttcctagaagaaaaatttttcaagggagcggatagtttttcatttagatgagaggggaactttccaatgggactatggaatcctcaagaagcatgtttacattttgtatcgccagcatttgtttattgtgttattttaattttaacagaacttgtatttttctgtgaagctcggtgggaggcaatgatgttttcaaagcccacggattgcaacatcgacagcaatggaatttgcatgtcacacggaacttgttgtatgttgcaatttttctcattaaggttggctaaagtacctgcggaccatggtttggtggagttgtatggatacatagcagtgcgggataggctggatacatttcttaattattttgtcaattttagcagggatgatcccattgtcgtggagcaggcgtgcacatttatacatgtatgcaattattttatagttaataagtctgttaacatgttatcatcggagcaggctctggtttaacctagtcttctgacagtagttggatagttagtactgggccgaatatttggccccatgcttatcatgccattacaaaatctggcccatgacaataagccactaccttacaaagtcttatatatattgtgaaatgatgatttacaacaaaaacagatctatactatgaaactaagtatcatgtattccaaacaaaatcaaatagaataattctggactcttggttgctagcaagtaaacctcacaaaactgaatcatttgtttataggcatatgaacatgcatagcatgaatactaagtcttataggcacatgaatatattacatgcttatttgatttagtacctgtgattcagaacaaaatcaatttccctctctaacaccgttatgtattttgtacattctgtttgatacaggacaaagttcttggccatcaataataaaacatgtcttagatattccttactttcatttgattctgtagggtataaaaatattgctacaagtgaaacatcataagggaagcattcagctttagatatttcttactcttatttgattctgtagggttctctcatccacatggctggccctaagcgagggatccaattgatcggcactaatctaatcgaatatgacatgaagatcaagactggtgaatatatatatgaaaatgaagatctacagctgatcgatggtgtatcaatcatagatgacatagacaacatggaattatagctcgtttacatgccgcatccatggttattgtggcgcgattgacatagctgcaatatcacaagtgagtcgaccatagaggttgcaatatcacaagtgcaaagcagttttgctatgcgcctgatcggttgttttaccagtgggttacatgaagaaatccggctctttgatggcactataggtgagttccgtacgtggcttgaagtggcctgtggttgctgtagtgatgggtgctcaaatggatttgaagttcaaggtagccacagactcatgcatccctgctgaacatttgctgttccgtcgaggagatagagactgattttgcattaatcgcagtgaaggtgacttggtcgacttttaatatgaaaagttggctctgtgatgagtgggctaaaagtggggcgggttatgcccctaacccaacgggctggcccgcatcactaaccatgcctgccttgactgatgcgggccaaagcggcagcctgcactaacccaacgggcaatgatgtcgcattgctcaccattccagtccaggggaagtccatatcgctgctagcgagagatgatgcatggctagctcccttcgctcccctcagctaccattgtaagtttgtaagtggatcttgcttggtggtagtaaaaagaatatggccattgcagccatggccgcccgaggaaacgatgacagcatcgatctatatgcattcttcacgaatcagccgggttttttcagtgcttttgcttcaggagttccaagcacaggcggatgcaaaagcatgacctggcgataatggcatggtgttcgaagaacgctagagagcaggaagatgacattttagtgtgataacaaacacaaaaatgtaatgcatgaacggcaaggaatgcatcgaatgcatgtcgcagacagaatcacactgattttgccatgaacttcatcgaacacggaataatacagcaatgaaaggcttcgacagcagttcttgcctggttttatgtatcataaaaaaagcgctgcatctgacagcactgatgatggacgtccatcgtttttgccctgattcgtgtaataacccaaaagagaaggtcaaagtggctgcttcaaagctccagtgtggagatccatttgctgcaattttgttgcttgcctcaacaagcgccattgaattctgttactgcctcacttaggaaaggccgtaaaaacttcaatgataaatcgtactagcatatttcaaacacactgcaattaccaacattgtccagagcaccaaacttctcattgaaactaagagaaagtcttgactaagtactacccccatcccatatatttgaaatttttcagaaatatccacccaaagtgcttcagcaaacacaaccagggaaaaaacaaagagagaactttgttccgcaaatcaataggcacattatgaactcctaacagggtaaccaagttctcttaagtagactttgaacggatgaaatcaagaatcgtatcatgaactcagcaggatttcacctcaccaaacttgacgttatacctttggttcgatcgaaaatgtattgatcacccataaaggagcaggaaagatgatgtgagcgaattgaagagggagattgatcacccatagaggagcaggaaagatgatgtgagtgaattgcaacgcacgggtgtgagattatgggtaccccatacccacacggcatggttatccgactagttataggagataacttttatctatgtaatatgtaacagatcatgacttgggtattacgtttccttgtatattacggaacggcctaaagttctggtttgataatattgtaaagtagatttaggaaaccgataccgtattggttaaggtttctatcttgtaatcctgccccccatcctatataaggtgggcaggaggccctctagggggcatataagacaactagatcgtcagatctatatacactcggcggattcaaatccccaaacaggtgtagggtattacctctcattgagagggcctgaatctgtctaaatcctttgtctcggcatccatccacttttaggtctcgtgcgctaccccttttattattgccgaatttatgtttcaacagttggcgcgccaggtagttgtacgccgagtttcctattgaggagtgcgatggaatcaattttatgagtcgccagcttcgcctttgcctcaggagctttgacttcctcgccatcgacaacttcaacaagcctcgctctttgactttgattcaaatcagtcggggaagatctaatctagctaaggaggataacaaccactctaccacggcgagtttaagattcgatctactatggccgccgccagcgtcaccttcgtcagcacgctttttcgcttcagagagaaactttatcgtcaggagaataaccggatactactgttaacaggatcgtcgatagcatgggccgcgtgccttggacgatacacggcatgctacaaagtttgcagtcctgatcttgcaacatatgtggtgtacggttggctacgcacgcgcatcatggtctggctgactacttcgatcgccaaacagtccggccagcatctttcctcgatctcacagcgacataatcaggggcttcgtagcagctctcttattacatgcatctactcatcatcaccatgtattgcatggctgcctgctacaagccaaccaatcaagattccttaatctacaggctgctaccaacaatcgtaggcttgatctactggagcaaatacagatgcatgcttgcacgttcttttatctcctaatcagatatgatttgtatttacatgtccgactatgcgacagccatataacaggcacgttgtttccgatatcactgacacgatcttcatggacatggacttcatcgctgactggtttgttcgtcctcatggccagcctactacgctgctactgatagcaacatcatcttcaccgactggctcgcctccgtcgccgctgccgactggtttctccgcctacacggctggcctattatgccgccgttgttgggcgtttacgacttcaccaccggcctgccttcgtcgccgccgactggtgtcctcgtctatacggttggttggtcacaccaccgttcatgcgtgtccacgtcttcaccgaccggcctgcctccgtcgccgccgactggtgttctcgcctatacggttggttggtcacaccaccgttcatagctgtccacgtcttcaccgaccggcttgcctttgccgtcgccgactggtgtctctgcctacacggctagcctattatgccgccgttagtgggcatcttcgctttcaccgtcgaccgccttcgtcgccgccgactagtgtcttcattgttattgatggacgactttgttcccacattggccacctctgccatcaccaggggaatattacaaagctaagtcatcattaattttttttatatgatatttttttcctctgcctcactacatcaactggttcgccgttgactaatgagtcgggggctacagatgttatatcgtattttttaaacaattttcataatatttatcttgattgcttgcgacataatctgagtacaaaagtacctatcgagttatggagttctatcttcctatgctttccgtttggtttgtcgatggatagttgcctttgggccgattcctagcacccgggggctcgttggatggactgagtaacgcaaggttctaagtattattcagaataaatcaaaagcatagagataagataaatttattttctgctctttacaattgcaaaagtacccgagtagtaaattatgattcgtgaaactttattccattaatgacaaactcatgtcactcatatgcatgtttgggaagtgcctaggctgactcccgatgcttgggggctatgactagtcggacagagtgtttaaacgtacggagtcatctgctcggggaaatcaaaattgacaagaggagaaatacatatttataaatattttaaaatacttaaatttttctcgagtattatatttacatcagatactactcatcctatatgtttgttctgcaggatccagatccagatatgcataatagggattcatggctttcaaagcttatctcctacgcttcagaaatggatcagtcagaacatcaccgaccggcttgccttcgtcgccgccgactggtgtctccgcctacacggctggcctattatgccaccgttgttgggcgtctacgtcttcaccgaccggcttgccttcgccgctgccgactggtgtttctgcctgcacggctggcctattatgccgccgttgttgggcgtctacgtcttcaccgaccggctgccttcatctgctgccgactggtgtctccgcctgcacggctggcctattatgccgccgttgttgggcatctacgtcttcaccgaccggctgccttcgtctgccaccgactggtgtctccgcctgcacggctggcctattatgctgccgttgttgagcgtctacgtcttcaacgaccggcttgccttcgtcgctgccgactggtgtctccgcctgcacggccggcctattatgccgccgttgttgggcatctacgtcttcaccgaccggccgcctcgtctgctgtcgactggtgtctccgcctgcacggctagcctattatgccgccgttgttgggcgtctacgtcttcaccgaccggccgcctcgtccgccgccgactggtgtttacgcctgcacggcgggcctattatgctgccgttgttgggtgtctacgtcttcaccgaccggccgcctcgtccgccgccgactggtgtttccgcctgcacggttggcctattatgccgccgttgttgggcgtatacgtcttcaccgaccggccgcctcgtccaccgtcgactgatgtttccgcctgcacagctggcttgttatgacgccaactgatgctatcttctttacggctggctacgtcgccgtcaccgctaataggcgtcatcatcttcaacgcaagctgtctacgtctactgccgactagtttcttcacttccatggctgcatgattctgccagtgttgattggccttatcgtcttcatcgccggtcgtctcgtctgctgctgactagtgccctcgcctctacgtctggtttataccgctaccattattgttggtcgccttcatcttcattgctggctgacctgactactgccgattggtttcttcgcctctacggctgtgcaactttgtcaccggcaccgacaaactctattgccgctacttcgctagttttgctacttcaccagccacgacgtctacaagagcttcgttatatcggcatgcgtcaccaaatatgatgccatgttattttactacaacaagtggtattccaatcttcaatatttctactcggatatcttcaacatgcatcttcactcaagcaatgactactcgacgacaagaagctaaagttttcgactctatgttcagttgtttcccaactaactaaagagtcgggggcaacacaaatacacggctcaaaattcgacaggttttatgtcaagatgaagcaatcaactaatcagccaacgagttctatggaatctacttcagcaactcttattatttcaccagtaattttggtttctccacgccgctacaatctactccaaatttctcaattatcaagtttgagatttaatctacatgttcgggagttgtatcagtcttcattatgcacacgctcgcatcaaggaaactacttgagcttcaatatcttctcaatagtttgatggattattgtcactggcatcatcaccagcacctctacttcatcggccctgacgtcttcgccgttgctaaggggtgactacgtcttcaccttcggttgcttctgtcatcactagctttcatcgccgacttgttatttcgttttcacggttggcctactacgcaaccgccgaggggagacctcatcattatcattaactgctacattgctatcaatgggcaacttcatcatcacatttgatcatctctattgctgccaatcgtcattaccatcggttgcatttgtcgtcgtcgactatttcctgcattttcatgattggaggatttcgccattgtatttgatgcacgtctacgtcttcatcgttggcttgttttcatcgccaccgactgatattctcgccttcacggctggcttattatgtcgccactaatgggcattttcatcttcttcaccagctgtctcgtctgtttctgactgattattttgtcaccatggctacaaaattctgtcgctattgctgggtgccttcatcttcactgctagttgatatgactgcttccgactggtttcttcgcttccatgccgattgcatcagctattaccgatggacaattttgactatgacagaaggacaagctatatgctcaggggcttatcagctcaaacacaagcgcgaggattatatcttcaatttggacttcttccggatacatgcaacatgaattcgtgatcatgggtctattttctatgctcaaagactggactatttattattccccgtaagggttatcaatcgaatacttgcgctagtcgggattcaattattatatctatttaggagtatcccataagggataatcactcagatcagaagctattcatatgagctacacttggtctatatcactcggaagatttattactcgggagcatgttacatgcgtcatccttcaaagggtgtcgaaggcatattttttggcctaggcctaatatgtctgcagcccatattttcaggtgtggcctgtcacgttcttttagggacttaggcatctttttgcttaggcaaaagtgcacgtgattatgtgcccaataccttaaaatccttttataccgcagttactcaactttttaggagttggtacaatgcatcttaaaaggtgtcaaacagtaaagctttatatagctgctccgctgacttttttatatagtcatgacactgtttgggtttatcaagcaattgattagatacaatatcattgcttttcgccacgtaagtgtgcatttttattgaccaatattatggcttaagctgattatatatcttggtcattttccaggcggttggtaaatcctttatgagtttatttactcggatttcacaccacatatgccatatatttccaggtgtggtgaaaccatgtgtcttttagggacttaagcacatctgttaaagcagtgtgcgcatggcgtatgcccaatacattagaaatttctttattcgcaacatacaagcttctttatagctgttttgctatgtgaattttcaatgatgtagccaactttaggttacattcatcatattttacaaagcagtcggtatatcactcggatcatgttattcagggattcacaccgcatatgctacatattaatatcaagtcgcttggttgactataattatcgaaaccacttggttagttagattatttattccttgactatatgcttagtttgttcagctaaccacatagtcgggggctacacctattaggtgcatctagtcgatgcacctaactttatttttcagccctccacagtcttcatatttggaaaaagtactcgggagatcatggcgaagatgattgaagcactcggctttagagtaatctggttcgagagaagattatcttttcgactgtgaaggtctcaggggctactgtggagattatgggtaccccatacccacacggcatggttatccgactagttataggggataacttatatctatgtaatatgtaacagatcatgatttgggtgttacgtttccttgtatattacggaacggcctaaagtcctggtttgataatattgtaaagtagatttaggaaaccgataccgtattggttaaggtttctatcttgtaatcctgccccccatcctatataaggttggcagaaggccctctaagaggcatatgagacaactagatcgtcagatctatacacactcggcggattcaaatccccaaacaggagtagggtattacctctcattgagagggcctgaacctgtctaaatcctttgtctccgcatccatccacttttaggtctcgtgcgctaccccttttattattgccgaattcatgtttcaacaacgggttagccactagttttttactaatcacaattgcttagagaggtttaatgacatacttgaaaaaacaaatatatgatgtaggttgagtgtgaattcacttttcattggcaagttttaaatgtttttcctccacgatatttgcggtcagattatattgttatatactccctccattaacctttgttatgatgtttgaatattcatcctatttgctagtatgctaccaagtcctatatagaatcaaatgttatatgtatgacaaaattcctaagtagataagtaaggtgtcccatataagaaagagaagtagagtgtaaaatcaaaggtgtttttgattattattctgtgatgaacgattggcattgcagattattggttttgttatttggaatttattcacaaagtggttttggagatgattggattcacaggtgatcgcagatttatcattttatgtgaccggtcagaccgggctatgtatgccggtcagaccggcggtgatcgagcggtcggaccggccagtccgcggtcagaccggccgacgctgtgtcagtttcggttttgggttatttgtttggatatccgtgattatttcatgattatagcttctagatggatactatacgtatgtaatactgttgtttgctactaatgagtcaagttggagatagcttggtcttggaatatggtttctttgtttaattcatatgtaggtgactcgatgtctcggaagagtatttgcggtgatggaccgggagtcggcttggggataagacgacgtccgtggtaatcagagatcatgcgggatactaaggctagagttgatgcatgtggttgatggagattccatatgtcatacgatggaggtattgtgtgcgtatgggatgcggagtcgaatttggaaggagtccaaatttggtacgattggttatgtaaagtttctttcttgtattagagggtttcctaaggtgtttaggactcttagtatgagtttggtttgtggctttaggatgcctacctcgggtataaatagagggggagcgtgaggcttctcggtatcgcttttcacagcaattgagttgagttttgagttagggtttcgagtttagtcgaaatttttgtaaggattgctgttggtgcactttgtaaacacagagagaatcaataaagtcgtcatccactttaagagttcttcgatttgtgtttcaccgggtttcggcggtgtaatcggcggcacaccagcggtcagaccggcggcatcgcggcggtcagaccggtgggtgacctacggtctgaccggcggcgacatcaggcgcgacagggattccagggctgtccaaccggtcagaccggctaatctactttggtcagaccgatctcatcgaaattgagggtaacttttatttgcgctaaaagtttttggtttttgggtataccaaccattcacccccctctgattggcttagttcttgtgattcgatcctacaagtggtatcagagccttgttttcttctttggatttttatcgatctagagtttttgccatggctactcctgctaggttttcaactaagcctcatgttttcgatggaacggatttttctcattggtgtagtaggatgcaatcttacattttggctgaagattatgatatttggagaaaagtttctcatccttatgtaattcctgaagctattaatactgctgctgaaaaaactgcatttgaacaaaattgcaaagctcgcaacattcttttgagtggtatttctcgttcggattatgatcgtgttgcgcactttcgaactgcttatgaaatttggaatgctttgagtaactttcttcaaggaacaaataacattaaagaacttcgtcgtgatattttcaaaaaggagtatattaaatttgagatgaaacctggagaagctttggatgactatctctctaagtttaataaaattttgagtgatcttagatctattgattcttcttatggtgctaattatccacaatatgagatttctcgtcactttttgaacggtcttgatatgtctatttgggagatgaaagttacatctattcaggagtcagttgacatgtctactttgactttggattcgctttatacaaaattgaaaacacatgagatgaatgttctttctcgaaaagttgattctaagtcgagtgttttggtttcttcttcttcttctttggatgttgaagcttcttcatctaagtcttcttttgttgctgtttttaatgccacatccgatgatcaactcgaacagatcgaggaggaggatttggctttggttgctgacagaattgctcgagctatagtgccaggaacaggaaaagaggtggtccaaatcgttgctttgaatgtggttcaattcatcatcttcgttcgcattgtcctaaggtagggagaggcaaaagagaagacaaagatggcgagaagaccaacaacaacaagccgaagggttcatcccaagggaggaagctggagaatcttagtaaggcttttcaacaagtttgcgccgccttcgagccactaagtgatgtagatggtgaaagtggagatgatgataagggaaagaacatctccgatgtttgcttcatggcgcgtggtgaatctgacacaaagtatgaagataatgaggtaagtgcttttgaggaagctattaatattttgagtgaaaaaaaataagaagtgtgagaagatgtatagaaaacaggaatttatcattgaatctcttaaacaagaatatcattgaatctcttaaaatctcttattcctaatgatgatgattgttcaaattgtgaggttttaatgaatgagatttcaaaaattagagatgttaatgctgcacatgatttgaaaaatagatcttctcttgcttgtagttttactttgcacacacgcactttggatgagttgtttttaactaaaaagttgttgcaaaaatatcaaattggtttttatgctagtttgatgtttaacatgatttctgctaaaaaagttaaaacaacctcatgatgttttggattgctcaacatgtaatttgaataagttgaaattgaaagattctttaggttgtgttgagtacatggaagatgttgtgaaaaacaatgaagtgctttattgcaccaaatgtcgtaaaagcaaaggtgtcatggtgattgtgaaaattgtgctaatttggaaaaagaggtttcttatttgaaaaattctttgctaagattttctgatggtaaaaagaacctcaacatgattttggatcaatcaaaggttagcacacataaccgtggtttagtttttaatccttatgctcataattctagacatcctcctattgtgttaggtgttggtgctagaagtggtgagattttggttaaacctgattctaacaaaactgtgtttagatctgctggtatcatatctaccttgaatgcatctttttcaaaatccaatgttgtgcattcaaaatctcctgttgttgcttgtgttgctaaatcttctaatgctaccaatctgtctaatcatcgtgaaaaatatacttgttctttttgtggaaaagatgaacatattgttggtttttgtttcagattagctcataaacagaaaaaggagagagagattgcttttgcaaaatcaaagtggcaaaaatcgggttttccctcgaggaaaccggtcagaccgcagtgggtcccgcggtcggaccggtgaccggtcagactggctactgagcgtcggtcagactggcggtacagaggcggtcagaccggccactgtacctcggtcagaccggcctcggaggaaattttccgaaaattctataattgattttgcacgtggatatatgcctattggatcttctagtcatgtgtctcagtactggattcctaaatttttattatcatctaaccccagtactgaggcttcgacttctacttgtgtgtaggctttggtggcaaggaaggagaacgtgtggatcgtggatttcggttgttcgcggcacatgaccggtgataaaaattggttctcctcactcaaaaaggcatccaagactgaatcgattatcattggtgatgcttctacaagtgccgttctcgctataggtttggttaaggtaaatgaaaaatttgaattgaagaatgtaactttggttgaggacttaaagtacaatttgctttcagtttcacaaattgttgatgaaaattttaaggttcactttaagaaaactagaagtaaagtttttgattcttgtggtgattttgtgttgaatatttctcgctatggaagagtgtttaaagctgattttgaaaatcctgtttcacctgtgataacatgtttggttgctaagtttaataaagatgtgatgttttgtcatcgtagacttggacatgttggttttgatcatctcactaggttaagtggtttggatctagttcgtggtttgcctaaacttaagaaagatcttaatttggtttgtacaccgtgtcgtcatgctaaaatggtttctacttcacatgctcctattgtttctgtgatgacggatgcaccgggacagctattacatatggacattgttggtctagctagagtgcaatctgttggaggaaagtagtatgtgttggttattgttgacgattttcctcgatattcttgagttttctttatggcaactaaggacgaaacttttcaaccctttcgtggtttgtttcttcgattggatcttgaatttcctggctctttgaaaagaattcgaagtgataatggtggtgaatttaaaaatgcttcatttgaacatttatgcaatgaaagaggtcttgaacatgaatttgcttctcctcgtgttccgcaccaaaacggtgttgttgaaaggaaaaaccgtgttttggttgagatggctagaatgatgttggatgagtataaaactcgtagaaaatttcgggctgaggcgattaacactgcatgctatatttcaaatcgggttttcttaaggtcaaaacttggaaaaacttcttatgagcttcgatttggatgtcaacccaaagtttcacatttgtgtgtttttggttgcaaatgctttgtcttgaaatctagaaatttgtataagtttgaggcacgttctaccgatcgattgtttcttggttaccctgcacattctcgttgctattgtgtacttattttggagactaacaaaatcgttgaaacttgcgaagtttcttttgatgaggctagtctaggtactagacccgatatttcagatatattgtcataggttcagggggaggatggtcgtatttttgaagacgagagcgacgacgacgacgaggtcagctcggccagtcagaccgagcgccaggccggtcagaccgccggcatgccaccggtcaaaccaccacagggggtgcggtcagaccggccaggcttgtcgggttcgggtactgttgatgctgatcgagatggtcctctagagattacaacttcgaccagtgctgatacagaacgtgaatcaacttcagaagtcgctgctcctttgcatattcaatgacgacatccgccggaacaaattattggtaatataggtgagcggactacaaggtctaaaataacgactcatgatgtttgtgtaaattctgcatttgttgcttcttttgaacccaaagatgtttcacatgcattaactgatgaatcgtggattaacgccatgcatgaagaacatgaaaattttgagagaaacaaagtttggactttagttgaaccaccttctggacataatattattggaaccaagtgggttttcaaaaataaacaaaatgaggatggtttgattgtgagaaataaagctagacttgttgctcaagattttacccaggttgagggtttggattttgttgaaacttttgctcctgttgctagaattgaggcaattagacttttgttggcttttcctgcttcaaaaggttttaaattgtatcaaatggatgtgaaaagtgcttttctaaatggtattatacaggaggaagtttatgtcaaacaaccaccaggttttgaaaatcctgattttcccaaccatgtttttaaattgtctaaagctttgtatggtttgaaacaagctcctagggcatggtatgataggcttaagaactttttgcttgtgaaaagtttttcaatgggaaaggttgacaaaacgctttttgttcttaagcatggtgataatcaactatttattcagatttatgtggatgatatcatctttgtttgttcgactcacgctttggttgtagattttactgagactatgcgcagcgaatttgagatgagcatgatgggtgagttatcgtactttttgggattgcaaattaagcaaacacctcaaggtacttttgtgcatcaaacgaagtatacaaaggatcttttgagaaggttcaagatggagaattgcaagccaatttcaacaccaattggttctacagctgtgttggatcctgatgaagatggtgaagctattgatcaaaaagagtatagaagtatgattgaatctttttgttgtatctaactgcttctaggctagacatacagtttgctgtgtgtttgtctgcacgctttcaagcttctcctcatgcttcacatcgtcaagcggtcaaacgaataatgaggtatttgaatcatacactcgagtttggaatttggtattctacttcatcttctatatgcttaagtggatattccgatgctgattttggcggttgtagaattgataggaaaagtactagtggaacatgtcattttcttggtacatcattgattgcatggtcttctaggaaacaatctagtgttgctcaatcaactgctgaatctgaatgtgttgctgctgctagttgttgttcccatattctttggctttaatctactttgaaagattatggtcttacttttgagaaagtacctctcttttgtgataatactagtactataaatattgctaagaattatgttcaacattcacgcacaaagcacattgatattcgtattcactttttgagggatcatgttgacaagggagatgttgaattctagtttttggacacaaagttgcaacttgctgatattttcactaaacctttggattctaatcgttttgcttttcttcgtggtgaattgggaataattcatccttttggcatgatttgagtgggagttttgtatcacatggttttatcaagcaacaatatgacaatgagaaaaattgagaaaagagagctttgatctatacatatggtattttcttgtgcatgctagcaatactttgaaggtttatttgtctctagcatagcttgtatgtattctagtctttttatgagacttagattttgtttttaagggagatgatgcatgacactttaattctatacttgaattaagctaatatgcaatgttgatgctagcatatggtttgatctataaatgctctacttatatgctttattgaattaattgctcgttgtgcaaagagaataaaaaatatgaaaaaaatgaataccgaatccttggaaacagtcttgacataaggacgtattcgatgtgagcaaaataatgggta

SEQ ID NO: 60443 - DNA, 7550 bp, Oryza sativa
  unsure (1)..(7550): unsure at all n locations
tcgattgatcttcctcataacttgcgtacatgtctattatatctatgtacatttccagaagattatattattcataaaaaacggttggttagaagatggattgcagagggatttattcacgaggaacatggacatacattatatgaattggggcagaggtgtttcaatgagctgatcaatagaagtttgattgagccaaggtatattggcaagttcggtgaggtgaaatcctgtcgagttcatgatacgattcttgatttcatccggtcaaagtctattgaagagaacttcgtaaccttgttaggaattcctaacgttcctattgatcggcagaagaaggtccggcggctatccctccttgttaatactgaagagtattatagcagtttggaggagaataacataaaatatgtcctggataaaaaagaagatgatagcaatgagcaggaagataacagtaacggttttcatatcctaaaaaagttgaatttgtgcaatgctcgattgctaactatttttccacattctgtgaaagtcccatctttgttgcagtttaggcggttgcgtgtgctcgactttgaaggctgtgagcagttagaaaatcatcaccttgcaaatatagagaatttattgcacctgaagtacctcagcatcaaagatacaattgttaatgtgcttccgactcagataacaagactacgatgtttacagacattgaatgtagatgtaagaggggcaattaacattccaacacatatttatcgacttcgacaactgacttatctacttgttgatatgagatgtcaactgccggataaaattgggaacatgcaagcattgcaagagctcaaagttgtgaatgtgcttgcgcagtcactgaacacgctgcaaggacttggtaaattaacaaacctgaggaagcttagtatatttatgcctggccatcacgctgatgcggcagaaagatacaagggtcatatgaaagcaatgatctcttccatatgtaagctaggcagagacaaccttcattgtctaacaattcatatttcatccgtatcagcagatgacttcatccaggaaccatggtgccctcctccattgagtcttcaagaacttgtcatcaatcaggcgccaatgtctagggttccaagatggattggctcacttgtcaacctccaacgattaggtttatatctgaaggaactctcgcaagaagatgtcagtacactgggaggactgccagccctgctctctctcattctctatgtggaagaagtaattacagaggagggaggaaggcttaggatcagcagcagttatggattcccatccttggaacgtatccgaatcggtggggaaagttgcaggcttgagttgacttttgaaattgggtgcttgccgaagctacaacaactgaacctcgaatgcatggtagcagaagaaaaccacaccagcagcagtaatgttgtgtttggcatagagcatctgtcccgcctcacaaccatatattgctgtattcattacaagtatgaaaccagactggccaaggtggctatgctggctgcattggagagatcaatcatcagccatcccaaccaacccacatttacaaaggaggaatatggtgattttgtagatgagtcctgttgaaggcaaaatttttaatgtggatcagttcaaaggcgtagctcttgctaaggataatcatgttacagcaaaatggaaagttggtaggtaatgtgattttttgcaatatggatgaggcaatacattatttgtttcactgcccttctttttctatggcggtccctttacattttttctaatttttctaccttcaatagtcaatactgtcagtaacatatttggaattcgatgcagaagctcaacagaaggctcaatcatgcatgttttaaacaggtacagaatgttctaatttatgttggtcagttaggctttattgtaataatgctgttcttatagaaaaggattgctattttgtcacagttattatacaagtatacaaattggctccatttgtggtctattatgcattgctgtgtaaggaagcccagcatttgtttgcaagtcgtggtctcgagccacatatttgaagtcgatcactgggaaactcttatcctaatctgggttgcacaaaagtccaataaaagattaccattgacgtaggcaacttcccctgtttatagatgttttctagttcttgctgaccaaatggttgctagctagaagctcttttcctgatttggatggctcaatagtccaataaaatattatcatttgcataggtaattcccttgtttacagatgttctagtactctttcttaccaaaggttcacgaggcttgtcgcggcccttggagatgctctctttaggttcactcacatggtatagggtctggaggattagtatctgatttattggtgtagagaactttgttcaggaggaggttatgacgatgatcaacaaagttataagagggctctggaggtatcccatgtgcccatatgcatcatccaagcaagcttcaggaccaattcttattctcaaacaaatcagtttttttttagcttcaaccacacattcttattactgggtagattcagtgagatcacgaatcaccaaaacatttacaaaatctgtgagggggtctacccaaagagtgacctgggtcccaactcacacctagctgggcaagattatgaacaacgctattacgagagcgatggggcaaacgagaccttggagctagcaaagtgaagttgcagaagcagttttatttccgttaagattgttgcaaaagcagtgttgacctgatagttccctcttgcattcactcacatcatctctcttgatgttttttcctcctctttttgtgcatgaatttaagcagggaactggctcctgcaatttcattgtttttatcattggactggtcaatctttctttgtttattcaccctgattgtgtttgctgaagcacttttggtggatatttctgaaaaatttcggataataattagtcaagactatcttttggtttcttgcctctgataaaacaatgggaagtttggtgatctggaaagtgttggtatgcacagtgtgtttaaaactacactaatatgtttttatcatctgtactttttacagctttccctaagaaggcagtaacagaattcaatggcgcctgttgagccaagcaacagaattgcagcaaatggatctccaccctggagctttaaaagcagccaatttgaccttttctttttgggttattataagaaattcagggtgcacacaaacacaatggacgtaaatagtcggtgctttatttatgatttatgtattgtatttaaaccctggcaagaattgctgtcaaagcctttcaatgctctatagtgcacgtgttctctgacctgtgaataaaaaaaactccaacgaataaataaaccaactcgagtattttcacggaaatctattatatccgcnnnnnnnnnnnnnnnnnnnnnnnnnnnnnnnnngttctttgctgaagttaattcgcaaatcaaattttcattgtgtaaaaattaaatcatgagaattatattgtgattgtggttgaaacgctcaagcttgctgtcatttttaaataattcaatctcttactgtcaattttaaatactaggagagctcaggttaggccatctactttcaacctattcaccggatgtggttcgaaacgctcaagcttgctgtcatttttaataattcaatttattgccgtcaattttcaattctagcggagcttaaggccatcccggcccaaatgggtgccgttggcgaggagccttgttcacgccgttcggctcgccatcgcttttggagccggagccatctagtgcgctccctagtagaggtacgtgcctccctgtgctcctcggctccttttcatcgagccatggagctaggctctgtgttgggcgatgtcatgcctagcctcatactcatggacactgctcccgcaccagagatttcttcttctaccctcggccttgtcgctaggagtaggaacacggcggtgggaaggagtcagaggcggtgagatgatggaggagctgtcggcggtcctggtgaagatggatctgtgatacggccgaccagatctggcctcctgaccagccgctcgtcgtcgaccaccgcgtcctgcgccccgctcgatgtcgggcatcctgccctgcgtgttgcttgccgtgcggagggagagagaggcggcgacgggcggagggtgagggacaacgtgggagaggggatcctgttaccgacgtggtggatggcgacgagcggcgggagagagagagggagagcgaggcgacgagaaaagatgaggccacatggggtggctggctggcgggcggagaaaaaaaaaagaaagaggagaccaggctgtgaaatatagtagggacacacattgtggctggattcgagtactttcaaacagttgcctcagattttgtagggcccatttaagtgtgtcttccattgggagatatgtatcccatgccgtgtatagtctcgggttgtatggctcacctgaggctacttatagctatggctttcgttggggatgccctaagctatgcagtttcctggtcatcccttgggtgaatctatatcaggctactgggtatttatataatggtagtgcgagtgcgcataggggttggcaagctcggatgcagccatcttatatatcatcataataaggtttaggcatagctacactaataaaaaacgattttcctggacatggacccatttagctagattgcagacggaccataactggtcgtgtctggtaaaataagctcattttcgcgtgcggtccatttaagaggaccgcacggaaaaatcaccgcacgcgaaaataccactctctttccctcctacccactttaaatttcccctctttctctcctctcctcccgagtcccggcggcggcatggcgacggtgcgcgggatcccgcgggcggcggccaacccccgcacggatccggcagctggccgccctctccccccgagatctggctcccctcccctccccttccttccctccccagatccggcggaggggagggccatcagcggcagcacggccagaggggagcgcggatccgacagctggccgccctcccctccccttccttccctccccagatccgccggaggggaggggtgtcgacggcggtggagtatagtaaaaattaaagactatccttaatgataaaatattctaataattatttccttttctatattctcgtacaacaaagtttcattttataaacgttaagtgtcgatgtaaaggcgttatcaacataacaactatccatgtttctctttctttctcgcttttttttccctgtcagcaaacttacctcgtcaacaactctgtgtccactcttagttgccgttgtacatgcccttacggaagtatctcaggtaactcagacgatccaatgtctcagatccaatgtctcagatggattcaacgggcacgaaaatttagtccccgtgtttcacaaatccatctctaaatacattcactgtttcagcacaacagccgcctagctaagctactatatataataaatatccgactctcagcatggtactgaagggctcatcaattcttgcaactactctcaacttgttgcatgattgttggatcgttatggttttcttacaatgtttattttttaaacgaacaacacaggaccatgcgagtttcatatttatataggagtaaaatatatggccggttcttaaacttgagtgaagatgtcacttaagtccgtaaatttaaaaattatacattgcagtccacgatcttgttttattgaatcatatacaactggagaaaccatcttttgtgggttgcgcaaaaaccacaatagccctagttcatccaaaaaccgggactaaaaaccatttttagtcccggttggtcatctttagtccctgttcattcattgtcaggtcgtggtagataccctagtatttttagtcccggttagtgttaacaaccgtgactaaagatcagtactttactttagtcccggttatttataccaaccaggattaaagattaaaaaaagcacgcgcggaagggagaggagaaaaagcacgcatggaagggagagagacatttgcgcgcgggggagagaacaaaaaaaatctctatctctctttctccccctcaatcttattttcttctactagaactcatcattatcatcttatcctcttatcctcctcctcccctaggccctcccctctcctcccctcccctcttcgtcggctgcggccggcgggcggcgggatgcgggatgcggcaggatgaggtgggtagcgggtcgcgggatgtagcggccatagtggagagtggcggtaggcggtggcgccggtcatggctgaggctacgggcggcggggcgcggccgtcgcgaagggcggcggctaggcggcggtgggtgctgtgaatgattttgtgaattttgtgtcataaaattggggatgatttttagatgtttatgtgaatgattttgggatgtaaatttgtggatgattttgtgatgtttgtgtgaatgtggatgattttgttgttgaatttgtggatgattttgtgaatgaggatgattttatcattgagttcggtttaaaatcaacattcaagcagaaaaaacaataaaaaatgactaatgatggctgtgccaggcatgtggcgcagccctctttagacctggttggtgttatcatccgggactaaagatacatctttactcctgggtatttgaaccgggactaaagatcgccatctttgtcctagattctctctcccggtttgctaaaccggacttaaggggcttgcaaaccaagagagatgagggtttctctagtagtgatagccggtccaaaacgcgtttgatcagagctgaccgcctatgtggtgcttcacgtaggcaacatcttacatccagccccctccatatctcaacgtgctactaattttgtacttaccccctattgctactgtagacatcaaaatctcccaaaatatcccaaatcattttggaccggctatggtcagctatgctcccgtacatcttagcctcctcctccatgcacgtcatcgtcttatatgtaggatcgaatcacaacaactaagccaaccagagggggggtgaatggttggtatacccaaaagtgaatggttggtatacccaaaaaccgaaacttttagcggaaaataaaaattaccctcaaattcaatggatcgcggtctgaccgaagtagatgcgccggtctgaccgcctggttgccgtcgttttgactgaaattgtatcttcggtctgaccgccgagatcagcttctgccgcctgtcaccaccgtcggtctgactgcccttatgccgccggtccgactgccacgatgccgccggtctgaccgccggtgcgccgcctacattaaatttgatatgaaacttggagaag

SEQ ID NO: 60444 - DNA, 27109 bp, Oryza sativa
ccccccccccgtgcgcatggtccgcggtgagccgtgaggctacgcgtgggcccgccgcaccgcgtcctccgcgaaccgcgcgcatgcgccgcgcctccctccaaaaaccctagcacgccccgcgtgcacctcgctcacggtgagccgagtcgccgacaagcgggtcccacccgggaccacgcgggatggacctggcccaccggctctctcactctctcctccccgcccgcgcgcgcgctttgggccgccttcttgggccggccggcccattaagctcggccgagccgcccctttctctcgggccgcgccctagccgcccgaggaaagtctaatttccctccctccttcttttcctttcttttctttttttttaaaaaggatttaaataaatccttttcctttagaccaaaaatccaataatcttagaaattcaatatcttcccaaccgtaagtccgtttgactccgttcaacttccaaaattcctcaaatctcgaaatctatctaatggcacgcttagaggtcaataatagggctttatttttcgccgtttgttgagttgtcccgtttcgcgtgtagtttcggagcccgaagacccgcagtgcgaggatttcgaggatcaagctcaagatctcgagcaaggcaagccacctttgaacatattgagcctatatttgaacttaattatattgcttgcaaaatattatgcattgaaaggattgcacttaatctgtttgcaccgtctgcaaggcagaccggtgggcctacctaacttgttgcatctgatccttccattgttaattgttatatcatgttcccttgcaaccccttagttgcgcctcggtaatcgtgcactctgtatgagtatcgacggtcgccatcaaacttaaaatctgagaaacattctgagtaaaacttgggttttacaaaagactcggaaaacccgacacctgggtcggtgcttgcgaactaaatgaatttccaaaatcgcagaccggggaacgtaccgggtgtacggttacccgctcttgcacttaaggaccgtttccttggaatttcatccgaacataagacaagtacgaccacatgggtggaatgggacacccctggctgagtaattagctaatcaggggagccttgatgctgagagacaagtggattcgccggggtggtgtcggggaggacccctgggcttcctggcacagtatggtccgggacctaacctgttgttggtctgggacccctctcgtcagcatatggtgaacctgtgtcggctttcgaaatgccttgtcatgaaagccttaaggtctctagacgtggccgtactacacgggctggatgatccgggttagtaatgtcgtgtgggtaaagtgtaccccctctgcagaggttattaaactgttcgaacagctgtgcccacggtcatgggcggatgtgaggtgatttctagcgtagttttgtttgactactgctttgtgaaatttgctgatgaggtttgggattgatgtttggaaaatctgcggctgatgggatcagccaggctcgggtggccgtttgaaagctgttggccgggtgccaaccttgatcaattcaaaagactgatacattgcacatactccgaccggacgagacgcactgtctcatccgtgtcgtttgagaagcactcacttagttgttttcagaaaagagtttaagtaaaatcaattgcaaaaacaacagcctttccttgaagcctgcattaaacacttatttcccatggcttgctgagtactcctgtactcacccttgctctatataaataatcccccccagttgctgaagaagatgaagtagatcccgctgacgaggagttcttccaggagcaagtcggctacgatgagttttagggttttggcctagttcccaagtcgcgcctgtgatgtttggtccaagtcttggcttccgcttccctcttgtaatgtagttgtgagctcgggatctgtccgcagcccaacatgactgtactcctactctataataaagagacttctgttgctctgatattctgacttcctgtgataccagcactgtttcctgggactggtatcgattaacaggttaaattggagcgtcacgggctaattccgctcaggactagttcggggtgtgacacctaagtatcctgcatgatatctgaccatcacggacatcgccttatccccaagtcgactcccgatccatcaccggcaatactctcccgaggcatcaagtcaccaacacatgaatcaaacaaagaaaccatattccgagatcaagctatctccaacttgacttattgttagtaaacaacggtattacatatgcatagtatccatctagaagccataaacatgaaacaatcacaactatccgaacaaatcaacccgaaaccggagtcggccggtcagaccacgggctgggccgatcagaccgtgggctgagccggtctgaccactcgatcaccgctggtttgaccggcaacacatgcccgatctgaccggtcctgacaaaccagtaacacctgtatatcacctgtaactccaatcatctccaaaactacttcaccaataatctccaaatttcaaaaccaaaaatctcaaatgccaattgttcatcacagaataagaataaaaaacactttgattttacaatctaccccttgatgaacacattggcaaacccatcaaaaatgttttgttgtttggaaaaataaaaacaaatgtggtagagagcacaaaagtggtaaaaagcacacttcgtaccaaagtacacatcgtgctcaaaatcaaaaagaaaacttttctcacttttaaaaataaagaaatccccccttgaacaaaaaacatgctcttcccaaactcttctcccccttttgacaatgatttcatcatgcataggaattatgttcagtaatattcaagagcttagcatacatatagcatatcgtgtcatgtgtcgcaataaaaagaagatgaacccatcattaatatagcaagcatgcattaaagtataatcatgaaccaaagattttacaatgaagttcaaatcaacaatcataattcatgatttcgtactatttataatgcaacatcttaacaagcacataggttgaaaaataaacactatacatatccacctattgcaatcatcactctttcttgaaagagctctagcacaaaacaaccaagacaattttttaacttttatttgagcctgtttgctcattttttccctcaattatttcgggtatgtccttgtcgtcaagactgtttccaaggattcggcacccattatttttgctcacatcgaatacgttctggtcgtcaagactgtttctaaggattcggtattcattttatctctcatacatattttttattctcttgcacaatgagcaattacaaagctatttgaggaataataattcaataaagcatttataaatcaaaccatatgctagcatatatattgcatttttttaaattcaaatatagaatttaagtgtcatgcatcatctccattgaaagcaatatctaagcctcataaaaaaactaaaatacacacaagctatgctagatacaaataaaccttcatagtattgctagcatgcacaagaatataccatatgtataaaacaaagctctcttttctcaatttttcttattgtcaaattttgcttgataaaaccataatgtacaaaaactccccttcaaatcacgccaaaaggatgaactattcccaattctacacgaagaatagcaaatcgattagaatccaatggtttagtgaaaatatcagcaagttgcaactttgtatccaaaaacgtcaattcaacatctcccctctcaacatgttccctcaaaaagtgaaagcgaatatcaatgtgctttgtgtgtgagtgttgtgcaggattcttagcaatgttaatagcactagtattatcacaaaagagaggtactttctcaaaagtaagaccataatctttcaaagttgatataagccaaagaatttgagaacaacaactagcagcagcaacatattctgattcagcagttgattgaacaacactagattgtttcctagaagaccatgcaatcaatgatgtaccaagaaaatgacaagttccactagtacttttcctatcaactctacaaccagcaaaatcagcattggaatatccactgaagcatatagaagatgaagtagaataccaaattccaaactcaagtatatgattcaaatacgtcattattcgcttgaccgcttgatgatgtgaagcacgaggagaagcttgaaagcgtgcacacaaacacacaacaaattgtatatctggcctagaagcagttagatacaactaagatccaatcatacttctatactccttctgatcaacagctttaccatcttcaccaggatccaacacagctgtagaaccaattcgtgttgatattggcttgcaattctccatcttgaaccgtctcaaaagatccttcgtgtacttcgtttgatgcacaaatgtaccttgaggtgtttgcttaatttgcaatcccaaaaagtacgataactcacccatcatgctcatctcaaattccctgcgtatagtctcagcaaactccacaagcaaagcatgagttgaacaaccaaagatgatatcatccacataaatctgaacgaacagttgattatcaccatgcttaagaacaaaaagcgttttgtcaatctttcccattgaaaaacctttcgcaagcaaaaagttattaagcctatcataccatgttctaggttcttgtttcaaaccatacaaagctttagacaatttaaaaacatgattggaaaaatcaggattttcaaaacctggtggttgtttgacataaacttattactgtataaaacctaaaaccatttagaaaaacacttttcacatccatttgatacaatttaaaatcttttgaagcaacaaaagctaacaaaagtgtaattgccttaattctagcaacaggagcaaaagttttatcaaaatccaaaccctccacctgagtaaaaccttgagcaacaagtctagctttatttctcacaatcaaaccatcctcattttgtttatttttgaaaacccacttggttccaataatgtgcagggtaaccaagaaacattccatcggtagagcgtgcttcaaacttatccaaatttccagatttcaatacaaagtatttgcaaccaaaaacacgcaaatgtgaaactttgggttgacgttcaaatcgaagttcataagaagtttttccaagttttgatctcaagaaaacccgatttgaaatatagcatgtagtgtttatcgcctcagcccaaaattttctaggagttttatactcatccaacatcgttctagccatcccaaccaaaacacgatttttcctttcaacaacaccgttttgttgcagaacacgaggagaagaaaattcacgttcaagacctctttcgttgcaaaattgttcaaaagaagcatttttaaactcaccaccattatcacttcgaattcttttcaaagaactaggaaattcaagatccaatcaaagaaacaaaccacaaaagtgttgaaaagcctcatccttagttgccatgaagaaaacccaagaatatcaagaaaaatcatcaaccataaccaacacataccactgtcctccaacagattgcactctagctggaccaacagtatccatgtgtaatagttgtcccggtgcatccgtcatcacaaaaataataggagcatgtgaagaagtaaccatcttagcatgacgaaactgtgtacaaaccaaatcaagatctttcttaagtttaggcaaaccatgaacaagatccaaaccacttaacctcgtgagatgatcaaaaccaacatgtccaagtctacgatgctaaaacatcacatccttattaaacttagcaaccaaatatgttatcacaggtgaaacaggattttcaaaaccagcttttgtcgaaacaataattcagcaatataaagggggtagcgcatgagacctaaaagtggatggatgcggagacaaagatttagacaggtcaggacctctcgatgagaggtaataccttactcctgtttagggatttgaattcgccgtgtgtattatagatctgacgatctagttgtgtatcatgccccctagagggcctcctgcccaccttatataggatgaggggcaggattacaagatagaaatcttaaccgatacgatatcggtttcctatatgtactttacaatattatcaaatcaggactttaggccattccataatatataaggaaacgtaatacccaagtcatgatccgttacatatttcatagatataagttatcccctataactagtcggataactatgccgtgtgggtatggggtacccataatcttcacagtagcccctgagaccttcacagtcgaaaagataatcttctttcgaactagattactccaaagccgagtgcttcaatcatcttctcatcttcgccatggtttcccgagtacttttaccaaatctaaagactgtggagagctgaaaaataactgaatgtaaacttaggtgcatcaattagattcacctaataggtgtagcccccgactatgtgattagttgaacaagctaaacatatagtcaaggagtaaataatccaaccaaccgagtggttttgataactgtagtcaatcaagtgacttgatattaatatatagcatatgcggtgtgaattcccgaataacatgatccgagtgatataccgactgctttgtaaaatatgatgcgtgcaatctaaagttgactacatcattgaaaatttacatagcaaaacagctataaagaagcttgtatattgtgaataaagaaatttctaaagtattgggcatacaccatgcgcacactgctttaacagatgtgcttaagtccctaaaagacacatgatttcaccacacttggaaatatatggcatatgtggtataaaatccgagtaaataaactcataaaggatttaccaaccacctagaaaaatgaccacaatatataatcagcctaaaccaataaaaatgttcacttacgtggcaaaaagcaacgatattgtatccaatcaattgctttaaaaacccacacagtgccttgacttatataaaaaagtcagtggggtagctatataaagaattctggagttgtcggtaatcctctcttatctcttgtactttatttattactctgatttaatagaaatatcattctgagtaattaagatttacttagtgagaattacttcttggttagttcctaattagcatacgggatcattgttcactatagtccatttatttatagtgattgctttagtgtttgatcggcactaaagtagttattaattgcgtagatgcggtgcctgggtaattaatctccagtggttgatgcatatcccacagtacgtttgaggtgggtctagaggtggtgacagccctcaagagcacttaagtcctccctgtccgggtacgtagtagagcgaaatctgagaacaacgggttgccagtgcctgaagtattgcgttaggattaaagttaagcttttcctagacacatcacttctgaccctaaagggaggtgttcggcggtggacgctagggtttgttggatgcaacctgtagctgtcgttctacgtctattatagtttttagataataaattaaaacccaggcctttacatctaaaatggatgtacagagccatcctagatatatactccctccgtactcgtaaagtaagccgtttaggacaatatttaagtcaaaccttgagaacattaaatcatgaataactcttaagttgttgagtttgaaaatttaaaattatatgaatagatttgccttgaaaaatactttcataaaaatatacatatatcacttttcaataaatattattatagaaacaagaagtcaaagttgtgttttggagaccgtgtcgctgtgcaaaacgacttcctttatgagtaaggagggagtatatatatctgagaggtcgaagatgcattctatcccttgtcccacaattaagctcattgatcagctttcgtcatcatcccactgctccccgcatgttgcccaccttgttggaaataaaccttacacgatgtatctagtagtagctagttttacgttcctttctgttgatgcatgcatgttagtttttctgttgttgcatgcgcgagctccgggttgtggatgccgtgcacgtagtggctgtcaacgagattaactcgcgactggcctggacaacgggacgtgaacgcgtctctcggatcgcggggatggacgcgaaagaaccgggacgtgggatcgaatcctaagtctgttatttgcataataaaaggagaagaaaaaaaaccgaaaaggtgaagcttcatcgcaccacaaaactcagcgtgtttcctcgtgttcgcgtgtgtttttccacagcttgtttgtcgatcacttagggaaacctgacaagtggtatcagagctcggttcagagcgtggacgcgagatcgcgctcttgagggtgtcttcatgcctcgaggacgcacgcactccccgcgccggcggtcggcgtcaccgtccgtgcatgtttcaggttccggcggccgcgcctcgggcagcggcgggagcgaccgcgggctggtgatccaccgcgtggtcaaggaagcaggaggtgcggcgaactacccgctgttgacaagaaccaactacaacgattggtctttgctgatgaagatcaaactgcaagcccggtgcctgtggggcgccatcgatccaggcggtgtcgagcttcatgaggataggatggcgcttgacgccatttgcagcgcggtgccccccgagatgatctcgaccttggccaccaaggcctcggccaaggaggcatgggattgcatcaggatcctgcgaatcggcgacgaccgaattcgcaaagcaagcgcacagaaggtgcgcatggagtacgagtcgctcgtccttcgcgacggtgagaccgtggaggacttcgccatgcgcctgacctccaccgtcaatcaactcgcgacgctcggcgatcccgagccggcagacaaggtcgtcgagaagtacctgcgcgtcgcccgtcccaggttcacccaactcgtcctttccattgaaactctccttgatatctctacactgtccctggaggaggtgaccggcagactcaaggcaggtgaggacgccatgccattgccatcttcgtcctcagacaacgccggcaagctctacctcaccgaggaagaatggctagagcgccacaagaaaaaggagcaggaggcaaagaagaactcaggcagcccaagcaaccgtggcaagcggcgaggcggcaaaggccgcaacggcggcggcgctgaagtcggcggcgcggagaatacgaactccggagcggcccgtcgtgaagacaaatgccgcaactgtggcaaatacggccactgggccaaggattgcaggagcaagcccaagcgggatgaacaggtccacgtggcccaagacgacgagcccaccttgcttctcctcacaggaggagtaatcacacatgcacgtgaacaggagcatgcaccagcgccgtctgcgccaactccgtcatccgatcccatctacctggaggaaaagaagctgttcgcggcgctcgacgacgccgcggagcgtgatccgggcagctggattgtggactccggcgcctccaaccacatgaccggctgccggacggccttctccgacattgacacaggcatcaccggcaacgtccgactaggagacggctccgtcgtccgaatcgaagggcgaggcaccgtgctcttctcctgtaagaatggggagcatcgaaccctcgccaacacctacctcattccacgcctcgctgctaacatcattagtgtcgggcagctagacgagaccggtttcaaggtggaggccgaggatggcgttatgcggatatgggatgagcagcggcgcctgcttgcccgtattcaccgcaatcctggacgtctctacgtcctcgacgtcgagctcgcgcgcccggtctgccttacggcacgcatcggcgacgaagcatggaagtggcatgcacggttcggccacattaacttcactgcgctgcggaaaatggccagagagcagctggtgcgcggtcttccggctgtgtcgcaagttgaccagctttgcgaggcttgcctcgccggcaagcaccgtcggacgccgttcccacagcaggctcaacagcgctccctggagccgctccaactactccacggcgacctctgcggcccgatctcgccaccaactccgaccggcaaccggtactttctccttctcgtcgatgattacagccgtttcatgtggttgtcgctgctcccctccaaggatggggtggcggcagccatcaagcgcatccaagccgcggctgaacgcaagagcggcaagaagctacatgctcttcgcacggataggggggagagttcctggtccaccacttcgcggattactgcgccgagctgggagtccgacgcgagacgacggcgccctactcgccgcaacaaaacggcgtcatggaatgtcgcaaccaatcggtggtcgggacggcgcggagcatgctcaaagccaaagggctgccaggtatgttttggggggaggcagtcaccacagctgtttatctcctgaacaggtcgtcatccaaaagtattggtgggaagacaccatacgagctgtggaacagatcgccgccggccgtccaccacctgcggacgttcgggtgtttggcacacgtcaagaccaccacgccgaatgtcaagaagctcgacgacaggagtaagcccatgatctttgtgggttatgagccggggtcgaaggcgtatcgctgctacgaccctgcctctcggcgcgtgcacatctcacgtgacgtcgcattcgacgaagaggcgcaatggaggtgggacggcgagacggcgagtgagctggacttcaccatcgagtacaccactgtgtaccacccagctgtggcgaacgtgccacgagctgactcggagcagccggagctaccgactccgcccgcgacatcgacaagtccatgcacacctgccgccacggcgggcacaactgcgacatcggcggaattcgcgactccaccaaccatcgccgcggacgacctcgacgccgatcatgatgatgctccgcttcggttccgccgcgtcgacgagatattaggaccggcgaccccgccgggactggctgtgcgcgagttcgatgacgaactcatgatggcaagtgctgaagagccagcgtctctcgccgaggcgcaacagcaagactgttggcgtcaagctatgctggatgagatgaaatcaattgaagaaaacggaacctggctgctcgtcgatcccccacctcgccagcggcccataggactcaagtgggtcttcaagacgaagaaagacgccgccggcaacatcaccaagcacaaagcgcggctcgtcgcaaaaggatacgtgcagcggcagggaatcgactacgacgaagtgttcgccccagttgcacggctcgagtcggttcgtttgctgctggcgtacgcggcgagcgaaggttgggccgtccatcatatggacgtgaaatcagcgttcctcaacggcgagctcaaggaggaagtctacgtcgcgcagccgcccggtttcgtcgtcgacggcaaggaacagaaggtgctgcgcctggtgaaggcgttgtatggacttcgtcaagccccgcgtgcgtggtacaccaagctcgacgcgtcgctgctgtcacttgggttccatcgcagtgcctcagagcacgctgtgtacatgcgcggagctaacgcacgtcgactggtggtcggggtgtacgtcgacgaccttgtcatcaccggcggcaaccactccgagcttgatcaattcaagaaggagatgcgggagacgttccagatgagcgacctcgggctacttcggtactatcttggcctggaggtgagtcagaccgacgagggcatcaccctgagccagggtgcgtgcgcaaagaagatacttgaggcagcaggcatggttggatgcaacccgagccagactccaatggagccacgcctcaaactcagtaagttgagcacatctccttgcgtggatgcaactgattacaggaaaattgtgggtcgctgcgctatttggtgaactcgagaccggacttggcgttctcagtgggttatgtgagtagattcatggagaaacccactaccgagcatctggcagccgtgaaacgtgtgctgcgctatgtcgccggcaccatcaatcgcggctgcagctaccggaggaagaaaggagctgttcatcttgttggattcagtgacagcgatctcgccggcgacgtcgacacgcggaaaagcaccaccggtgtcttcttcttcctcggtgacaacttgattacctggcaatctcagaagcagaaggttgttgccttatcgtcctgtgaagcggagtacattgcggcgacaacagctgcttgccagggtgtgtggctggcgcgtcttcttgccgagctcaagggagaagaagccgacgccgtcacactcaatgtcgacaatcagtcggcaattcaactcagcaaaaaccctgttttccacgatcgcagctagcatatagagaccagatatcactacatcagagaatgcattgaggaggacagggtgaagatcgagttcgtcagtacaaacgatcaactggcggacattctgacgaagtcacttgggcgtgatcggttcaataaactgtgcacaaggattggcctcgtcgaagttaaagggacgtgcaaggtttagggggagatttgttggaaataaaccttacacgatgtatctagtagtagctagttttacgttcctttctgttgctgcatgcatgttagtttttctgttgttgcatgcgcgagctccgggttgtggatgcccatgcatgttagtttttctgttgttgcatgcgcgagctccgggttgtggatgccgtgcacgtagtggctgtcaacgagattaactcgcgactggcctggacaacgggacgtgaacgcgtctctcggatcgcggggatggacgcgaaagaaccgggacgtgggatcgaatcctaagtctgttatttgcataataaaaggagaagaaaaaaaaccgaaaaggtgaagcttcatcgcaccacaaaactcagcgtgtttcctcgtgttcgcgtgtgtttttccacagcttgtttgtcgatcacttagggaaacctgacacacctgaatcaacaagttctgtccccagcaaaaactcattcctgcccggccgtgtcgtaccggcaaggcgcgtcaagtctcgctgctcagcggtatatatatgccctggcaaattcgatcggttccagcgacaccattctctagaaggctaatagcatagtacagcatatataccgatatatctgcagcttttgttgagttttcttctgctctgtggtgacttctgaccctgatctgtcatctcctctttatacagatcactttcaggtttgtgtgctatatgcctactatatccctccggcttaaggctctgtcttgcgtgcttgtggcttaagcaagcttaattatgtccctgtatatgattcgtacatgtattctgtatcagctagcaacagattcatgtttctgttcctaatggaaaataattttcgggtttgttgttgccctcaaaacagacagagttttaagagatggagggagctctagtgagcacagcaaccggggccttgaagcccgtccttgcgaagctagccgctctgcttggtgataagtacacgatcttcaaggggctgcacaaggagatcaagtctctctctaccgaactcatggccatccatgcgttccttctcaatatgtcagaggaggagaatcctgatgcccaagaccaggcttggatgacggaagtaagggagctatcctacgacatggaggacattattgacgagttcatggtccatgttgatgatgaatctgccactccagatgggttcatcagtaagtgtaagaaatcgctcgcaaatatgaagactaaacgtcgaattgccaaggcaatagaagatttcaagagccaaatcaacattgtcggagaaaggcatgcaaggtatagatcagagaagaccatctgcaggaccagcaatacaatcattgaccacagggctctctctatctttgagcatgcttcaaatcttgtaggtattgaagggccgaaaaatgaagtaatcaaattattgtccgatgatgatggctgtgagtcaaagcaacaacatccaaaggttgtctcggttgttggttttggaggacttggtaaaactactcttgcataccaagtataccaacagctcaagggaaatttttcctgttcggttttcgtatcagtatcacgaaatccagacatgatgagaattctgagaactattttaagtgaggtgacacaacgtgattatgctgtgactgaagctggagatgaacaacaacttattattaaaatttccaattttctttcaaaaaaaaggtaatagtgtggtccctagataaatattcttttacatttccctcaaaaaaaatattcttttacatgaaaacgttggcacaattgaatttgtaatttttatttacatatgatctaatttagctatgcatgtttatagaatgatgtatgacgacataatatacgttgccaatatatagtttgtacagtatttagttattcggatgccatgcgaacgagaggggtatgtgctcaaatgacatgcatgctacctccgttcggaaaaagatgttattgcgcagaccaatgaaattgtgttagatgcagcaaaaattgccagtttgcccctaattaagcattattattagctccaatcacctacttttcgtcttggattgctacaaagaaccatgcgtttagctgtgtgccaactggaaattttcacctagaaaaccgaaaacgatatatctatttgagaacggagataatattccttatatagatatttatttcttataaattgattttggtcactatggatgttataaaattgaacacgtggattacaacttatggtcattttaattcttattattagttaattatatctcttgagttgctagctttccaaaaattaagtgcatgcacatacacttagagaacttttacaatacaatataatggaagtatttactatagctagtagtgtactatatcaggactagatcattatggtaaattatgtttgttgctaatctgtctctaattgcctagatatactctctccgtactcctgtactcctaaaggaagtctgtcacttttcaatatatgaaaagatttgtcttgaaaaatacttttataaaagtatacatatatcacttttcaataaatatttttgtagaaacaaaaaagtaaaagttgtgttttggagaccgtgttgctgcccaaaacgacttcctttacgagtatcgagggagtacaattttaattggttagaaaaattactcaataccatttgatcatttatactagcggtatatatatattggcagtacattataatggaggggatttggcctaaaataatttctttacacgtttaagtgaaaattgatagccaaatgcttcttttttttcgttcagagtagtatatattttccttaatctgttctaggcctaaagagaaatcctagctagaaagttcgatatatctaaatttaggagggaaaacattaaactaagtttaggaatagcatccatggtatatgccgtgttatccgaaagttttgttggacctaaatctatgctaatatatatcacccctaatatttatgcaggtactttgttgtaattgatgacatatggaacgtggaaatatggaacattattaaaggtgcattctccatgaacagtcgctgcagtaaaattatcaccactactcgcataagtgatgtcgctagatcgtgttgttcttcatttcgtggtcatttgtataatatacggccccttgataccgtgcactcaagaacgttatttcatagaaggctattcaaccctcaggaaaaatgtccatcacaccttgaagaagtttctgaccaaatattgaaaaaatgtgacggcttacctctggcaatcatagccatatctggtttattggccaacaaactaaggacaaaggatcaatgggaacatgtgaaaaattcaattggttgtgcacttgaaagaaatcctacggttgagggaatgataagtattttatcattgagttactttgatcttcctcctcatctaaaaacttgtcttttgtatctaagtatatttccagaagactatgtaattaggaagaatgacttgatactgagatggattgctgagggattcattcataaagaggacagtaataccttgtatgaatcaggagaaatgtgtttcaatgaactagtcaacaggaatttgctacaacttgagaagcaaaactacaatggatgtcgagttcatgacacggttcttgattttatcatctcgatgtccaagaaaaataactttgttactttagtgacttctccttgtctaactattgagggacagaacaagatccgtcggctctcccttcaagttggcagcgaggaaggaaattcaatccaacgaacaatgttgtctcatgctcgatctcttgatgtgttttggctgcatctacaggagatcccttctctagtggagtttcggcacttgcgtgttctgagctttcaaggttgcaggtggttgcagagccagcatcttgcaaatataggaaagttgtttcagctaagattcctgaacctcaggaaaacaggtctaaatgaactgccagaagaaatcggatttctgcagaacttgcaggcgctgaacttagaaggcagcaatatgcatcgactaccaccacatattacaaggctgggaaatttggtacatctatttactgacattcggattcaactcccggaaggtattgcgaagatgcggtcactagagacattaaaatgggttgacctatccaaccattcatctaacattgtaaaagaacttggccagctagagaatttgagggaactgaagttgtttatgcccaacgatgatatatgcgatgagcacgtgaaggttattgcctcttgtctagttgaattaggtagacataacctccgtcgtctatatatcgtgggttataccgaattgcctaacagcctcttaccagatccgtggtgcccttcaccacttaaactcgaagaacttgacatctctgactcacctatggtacaggttccgagttggatgcgctcattcgtccagcttaaaaggttaggccttattctaaaggatgtcagtgatgaagatctaaccaccctcggtcgcctaccttctctgctacatcttcatctcaatataccaagaggagaaccagggtacgaggataggctcctcatcagtggctgccatggattctcatgcttgaggcagttttatctcacgggtcagcagccaatttttacagcgggatctatgccaaggctagagctactcagagttgaaatggatgaatctaagccagagtttctaactaatgcttctcttgaaaacctcccctgcctcaccactgtgaaatgtttgcttttcaactttcaacgtggtgaggtggctcaaaatgggaagactgccatggcgagagcaatgagttctcatccgaaccaccctagccttgtgtatgagtagagctggcggtctttcatattatatatcgagctatatatttgatgcacaaccaccaaggaacagccagctggtaactgctaaccacttaattctctcaaacaacacatgattaatgcccagaatttgatcacctctttacactatcagatgatacaattattgtactgatgatggccttggggcacggtttcacgcaatctgcagtgacaaggttgcttatttactagcgtacttagttggtcatcctaaactcgatatcttttacagtgtttgcgaggtacttaaagatattaagagatagaacaatgtaaaccattgatcaagagaggggcaaggtacggaataaaagttaatgtaaccgatagcaacgaagtaaataactagtaaaatatgggtattttgggttaatcaaatacctagctgaattgatccgtattgtttggtagaaaaagttgtaaatcttacgaggcattttgtctccgatacattttgtatcattcggtcgaaaatgtaaatcttcccataaattttatctcctaaataagttttatcattttctaatatttgaatgtatttgagagaatagctactttagtccctaaagtttttctgtaggatcagtttagtccctaaccttttaaatggtccaaaaaaatccttaacctttgtcataagacctagaatagtccttggatccaccaaaaccatcatatggatatgccatgtcatcattcatgcaaaatctataatgaattgtccaatttacccttacgtatatcatagaaaaataaatataagggtgaattagatataaccataggaaaaaatactttttttcaccattttgaggtatatttttgctcttgcatataccatatatttttttaacattttccttttgttttttattttcctatgcgtaagggtaaattagacaaatcatatagattttgcatagaaaggtgacatggcatgtccatgtggcaattttggtgggaccaaggactatattagcccacatgacaaatttaaaggacttgtttggacaatatgaaagaataagaactaaaatgacccaggatcgaaactttaggtaccatattagctattctcccaatgtatttttgtgttgtttcatgtatcacaaatttataattaagttgacatgcatgtgtctatataatgtagcgtatgtgttcatgcatgcacgatgattaagttggaaacgatgatgttcaaattagccccaaatttctagcatgcttaacaagagtaacgcaagttattagttagcaagttcaaatatttgggacgaagatgtgagaataagatcaggatcccactaattaacacagttaattactatagaattaaagagaaaacattttttcttaaaagaatttcctccattgtagcgattgcaccctaatcaacacaataataaaaaatgacacattttttttgtccaaaataacatggctgcatgatcaacaaaacatatcaatttccttcttcacttactgtcatatatgttgtactttgatattttttttaagactttgtactttgaaattatagtatctacctatgttcatgttattgagggagaatatgcaaagatgaacaaacatgtaaatatagcgtattgacaatgaattacatatgaacctacaaaccgatgatcttttactgagtttatatgttctttgtgataaaatatcaattttaaaataaccacacgaacattcggtcatattttatccgattgtgttattagacacaaaatatcgggggcgtctaatgggcgggtgatcgctcccccgtccgtccagcgatcacccgtccgcgccctcacttatacaatacactcctccctcctctctccccttcctcctccctttcttctttttctactacagtaaaccacaaaaaaaaatttaaaaaaaaagttagaaaaatttatgcatagaaataatatatataataaatttgaattcaaattcaaatttgaatcgggtatgtaaacttttgacttataaactttgggtctataaactttaggtatataaactttagatgtatagaaatactatatatagaaaatatttaaattcaaattcaaatttgaatcggatataattcaaattcaaatttaaaacgggtatgtaaacttttgacttataaactttaggtctataaactttaggtgtataaactttagatgcataaaaatactatatatagaaaatatttgaattcaaattcaaatttgaatcagatataattcaaattcaaatttaaaacaggtatgtaaacttttgacttataaactttgggtcattaaactttaggtgtataaactttagatgtatagaaatactatatataaaaaaaattgaattgaaattcaaatttgaatttgaatcgaatatataaacttttgacttataaactttggttctctaaactttagatgtgtaaacttgaggtgtataaactttagatgcataaatttactaaaataatagagtaatacggtgccaaaaaaggaaaccaggtggagggagggagggaagaggggatcgatcgctaccccatagccaaggcgatcgattgcccattagaggtttcgcaaaatatcaacttaaaaaaacatcacgatcatactcttaaaaagaaaatgtaaatctaagaaaaaaaacacgtaaattttttttaagggaaaccgaaaactttattactgaggcaggccagccaaatcgctggtcaccaaatactcaaggcccggcggagtgccggcccagctacaagggtcaagcaaattacaacccagtttcgccagttcatgcactacttgttacattccctggggcaataattaaccaagaatgaaataaatcttctagaaatgacattcttgatctccagaatcacaccccccatgacagagagattgaaagagttctcctggagtgtagacttcagcagcagcgagcctatttcaaactctaccttcattatccccctttcacttgccgcccctacagccgctgcacaagcaataatctcagaatggaatgcatccatcatgttatcagctccgccagctccagcctgaaccacccgtccatgatgatcccgaataacatatccccatccgccttgtttggtgctgctgtggaaggccccatccgagttgatgttcaggacatcagaggtgggttttctccattttgccattctcctctccttcaacttcccctctttccaattcaacttcaagaattcctctccctggttatcaatgatatacgccaagtcaattgggtctctggctttacctccttccctcacttcattcatctgcttccaccattgccacaaacaaacgacagctctcatctgtatattctctgggcacccccaaatggtctccagcacacttcttgcattaggttgttgcgctagagataatctcaggtcttccaagttcatcgcctaccaaactttcttaacaagcttgcacttgaaaagcacttgaaaaacacgtgaattttgtaatgcaggattaccgacgatcatgttcctaggaaggaaatgtaaatctttttagaacacgtaaataacggaaatgagaatcacgggtatagtagagatgaggtaccgatgcggaacctgtgtacctagaactaagaagacaattatgcccttctccatcttaaaaaaaatatccttttacacttactacctaagtacctatatcagtacttaaatatcttttaagtggtatcttttattatggaccattagatttttaccaaacaccgtaaaatctctccttcaacatatagggaatgccttggctgtactctcgagcttccgttccatgaagcggccgttgtagaacaccggcctcgtcgtcactggtgatgaggacgcctattcacccattattagttgcaggcattcattgccgctaggtaagctggccaccctaccaatgccagcactccagccggcgccaccaacgctgctacgccgccctcagcaccctccattacgtgccccttcgtccacggaatcgccgccgcccatctcaaaccccttcttgcccagatctgtcaccctccactgcttctgcagggactccaccaccaccacgccggtcaatgtggccgccctcccctggggaggtctcctaggtctcggaaacgccagatcggggctctagcagcccttaattaaggcgttgtttaggcctcgtttacttggcaaaaacttttgcctatacgtaccacatcggatatacggacacacatttaaagtattaaacgtagtctaataataataaaaaaaactatagattccgctaggaaattgcgagaggaatttattaagcacaattaattcttcattagcaaatatttactgtagcaccacattatcaaatcatggcgcaattagacttaaaagatttgtctcgtaatttacacgcaaaatgtgtaattgattttttattttgtccacatttatactccatacatatgtccaaacattcgatgtgatgggtgaaaagtttttgttttggaaactgtggccttgtttagttcgcgaaaaaaaattttaggtgttacatcagacgtttgaccggatgttggaagggtttttgacacgaataaaaaaactaagttcataacttgcctggaaaacgcgagatgaatctttttagtctaattaatctgtcattagcacatgtgggttactatagcacctatggttaatcaggtgcaattaattgcacagtttgcatggaaatcgcgagacgaatcttttgagcctaattagtctatgattaaccataagtgctacagtaacccacatgtactaatgacggattaatcacgctaaaaagattcatttcgcggtttctaggcaagttatgaaattacttttttcattcgtatccaaatacccttctaatatccggtcaaacgcccgatgtgacccccaaaaattttcttttcgcaaactaaacaaggccgtaatctagacacgacgctccttcaatccgctctgccaaccagctcgtctccgcatcccatcgagccttcaaggagaagacgcaaggaaggtgctttatctaccttgcgcatgaccatcaagtggtgactatcagggcaatagcaatgcgtcccatgtatataccgaatctcagatgccacatgggctaaggaactgtggtagtcacaagattcacaatgtagcaactccaaagtggggtccacaaaaataaagttctccttttttttctccacttttccccatctccttctccctttcctcgggaccaccgctatccttcttctcccccatctctcacgccttcccctctctctcctctcatgctcgggtggcaacctgactcagtcttctctccttacaccgtgttgggtcggccaggcggagcagcagcctgcggaaacggcgccgaggtggccgggcagagtggcagcctctgaggcaacggagctaggcggagacagcgccgatgcggccgggcggagcgccggcctctgcggcgacggagccggacggagcgccggcctctatggcgacgaagccgggcaaagaggcgacggcaaccgagtagagaggcgaccgaagcggtgacggtgcaggccggagcagcggaggggtgggctcgccggatctagcctcaggttctctctggcgcggatgcggctccctatccctacccccacctcctctctgtctctctcccgctttctccccacgggcggatgcgatttttttagcaaaagttgattttttttttgacgaggttcttggagccaatgttgatcacgtgaacccggcgaaggaatggtcaccacttccctctctcctccacgcaagcactttttctacctggacaaacattgacacatgtcacgtgcgtgcaccgtgaatggcctcagagacccaatctgatgtttctcctgccatcgctcaggttattgtgcctatgaatgcactaaggccattcacagtgcatgtatgtggcgtttggtctcgatgcaccagctcggcgattcccctctacacaagcgttggtcgtaaccctgtgaagtccgcggaaccaattttgtgcactcgttcttctcacaaaatcaaggtcgcgtggcatgggggagaacggtgcagacgcattgtgaggttgtggccttacgggttcgtggctccgcgcttcccctccccatcccccgagctggcgatgaaggaagaagaagagatggcggcggaggaggaagaggaggcgacaaatctggtgcctacctacttgacgccccccgagccatgttgtcactcattgtcgtgtgtcgctccaacccaccggacccatcctcgttttctgatctatgctgctgctcgtcatcatcgcccactccaagccgcaacgacctctccttgacccctccacagcctcaatgggagcctccacgacccatccagatcgatgcgccaccgaggagagggtagaggccgcgctgccgctcgtccttgttgcccatagccatgggcgccgacgaggagagagaaaggatttggcaccgacgaggagaggggtgaagggatttagcgccagagaggggaggagagaggggagatctggcgagcttcgggcttgttttggccgcccggcgctgtcgcttcatggggaccaccgctgcaaacaaccctccgcctggctcgccgtcaccgcttctgcctttcacgagagcatgtgggttggggaaaggggaagcatcggttttggggagagagacggaaaaaggcgagaaaaatattgttttttcatggaccccagttaaggctacatagcacggtgaaacttgtggctaacattattctttggtgttcttggacctacgtgacatatgaggtctggcaaaattcgatgttgcactgctaatgccctaagcagtggtccctaggcaccacctgccgtcaccccccatctctagtgcaaccttcaccgcagagcacctggacggactggcagcgctcacttcgatgacaagctatgcccttgccaccaccacctccaagaactatgcatggaaggcaatggcacttctcggcgacacgcccaattgatgacgagtatctcagcccaacctcctacgcccttgatgaggagcactatgtgacatcctggccctattaggatatggactgtgtggctcatgagagccgtgtgctcctgtttgataccaccttgctaatgtagtgaaaagctggaaccaacttataatggtttgtccctctagtcgtatcactcctaggttaaccattttacacaaagcaaggatgaaagtatatgtgtgctatgtgtaagtgggcccacccataggatggactaggttgcgcggttccaaagggcgtgttgttacatgcttaatttttttccattttggttcgcgttaccataacatatcccattctctaattttatttattcttcaggagaatccaatgatgtgtggttttactttatggatcaacaccgtcagcccgacgtatgatggcagaagagtaactaaagctgaatgcaaacaaagtacaagagaatgaaggagcacaaagttgcagtacgtgctaaacgacgtagaagggggtagtagagaagcttaggcccgattcgttttcggccatttcttttgttatgttggtgtatgtgtcacgaatgtgttatgtttatctgtgtgttagctaatggttaactctctttttcatcgattaagttgatttgtgctaccgctgcaatatctttattctccttctattctttatccaccttctattctttttcatcgattaagttgatttgtgctacggcgacgtgaatatgtgattgtcttacgagggcaaataaattgcgacaaagctatgaaaccaaaaaagccaatgaaagtaataaaaaatatgtaaataaataatacctcattagtccaattattttaataaacaaataaatactagaactacaaaataataatgtattttccacctgagaaaaacataacatatattaaaaaattgctaacgaaattaaccaaacaaacatgtattaaaaaaataatttcggctgtacaaaggtaaagagaggacactcagattgtattgaaagcccgacagacaaaccatatatagtttgattgggattctatttttacaggatgaagaagtacacattacacaaagagcaattttacggtacatgtagagactcctagcagacataggtcgcgactacaaaagaaagtaaactaacgacagaaaacatctgtttttgtgcaacatttctaaacatatccaaggcagctatcagacatccaaacacaatcagacacatcatcatcttgctgcccatagagaattgcttcgtactgccgcgcatgtccaccttatacatggctgggccacttctctccatatttctgcatggcatcacattgccgcaactctttagtagactagtagccatcttatttgaggacattgcacttttctccatatttactgttccattttcacagttcatttgcccatcctccctgcaagtgacagcattattggaatatgatagagggcattgctcccgcgcaactctgctacctggacattatcgaattttcagcggttagattctgccgcgagagttgatcagttctttccatgcttcatcgatttacatatatggtgctacatggtgctagacaatctgcagtttttatcatgttggtttaagacaggtgctaccgcttgaatttttttccctataatatgtatagagagttgatcattgcattagtattaatatgtatagagagttgatcattgcattaagtataatatgtgcaagattaattaagtattaacttaaaaaacttgaaaataaattaatatgatttttatagctactttcatatagatttttttaaaaaaacaacacttaacagttcgtgaagagtaagctagggagtcgaagatgggaagaggtagattcaaactcaaccttaagcgtactgcccatacagttattgatttattagctaaacaacatcaatcaattcttttcatagttcatttcaaatttaagggtgtacagaaaaaaaaacaatcgaccatatgtctaggagtgaggaaagagcctgagtgagattaattattgatgtcgactgaactg

SEQ ID NO: 60445 - DNA, 121106 bp, Oryza sativa
ctagttgtgtagagtctaaggtataagtcgattgagtccgctggaaatattttacggctaaaatataaaaagatgaaaaatctctcactaattctaaaattaagctctaaaattcaaaatagatttcttctttgaaatgtgccgatgtgatatttttaattctgtaacaacacacgggcattttgctagtcacaagagaaacaggtagtcgtcgagctgctgctttagctatttgatcatctgactatctgagttactcaactattgcttatgctgcttcctttgaacacacatttactgtagttcaaaattgcagtggacctgtgtctaactaaggtagatctgtagaagtatttagagataacatagatgcctacctcatgaccttcctcgaagcaattgacaagatggaatgtgcagaatggttctacataaaaccatattactgagtctgcatcaccgtaatggggcataaccccaattcttgaatagctttcctcttcaaactcaagcactctatatgagggatgaagaaggataaattcgatttgtgagaataattttggatttttggtattagctataccaagtacttacggagcccctcttagcatcctagttgggttgagggtaagtggtgaatctatgatgatgttgtacctgcaatcattgaggatgttagatttcactaatttttctaattggtttgctatttctagaaaattcattacatcctattaaagctattgtgttcatgcatatttgaaagtttttaggtccactttacttttatataagaaaagtggagcttcaagagaacttgactttaatagaactattttgactttaatgaagttatagcttattttatgtggcatagtaaaaaatgaatatattatttttttggttattctgtacagttcaatagaaaactgctagacaaatattgactgagctgctgactaattgcaagcattgaattaggcacagttagaatgtgagttctcaatcctacagttagtagcagagcaactcagctggttgctgccataactgggatccatggatttggttattccatatatatcatttagggattaatagtgctctgtgtttcaaattctaatagattttttatggagtccatgtccatcccatgtgagttaagacattgttgttttatttctgtgtaatgtttaagaaatttgtaaatgacagtaaaccagacaaaattagtgtacttcatatcatgaaaaagaaacgaatatgatggttttctactagcttccagttggttctaatctagttcataagacaccattcctctgttcttcacaataaaattgctattttttacttaaaaattccctgttgaaaaaaaataaaaattaagaatcctcaagaagcgaccaagattgattgttttcttgtgcatcagtctatgtgaaatgtgctgtttagtatcttccatttcttgaaattaaataaatatactatttgaaataagagcaattcttgaaattaaataaatatactatttgaaataagagcaaaattttacatgcatctaaatatctaatgaaatcagaagagcagccataaaaacaaatatagctagctgtaggcaagaaacttacgtccccgtgaccccaatttcatgacaatatgtgcatctgtctagcttgagaccaaccttttgtttaagtttttctccatcctctgtgatgtttatgaagttaagcatatgaccccatttttattcaggagatgtagcagaagacaatggaattatgaaagtagataacctgagattatgccaactgttaggaaaggctgtaccgcattgatcccgaaaatgaccatctcttttgacccagggattacctgttaccgtggacatgatgcattgcatagctaaaacatgacaaaagaaagctaacagatgtacaaatgaaacaatggagcactagtggctttaactacagtagttgaactgttattattggaaaacttggaaagttcagatgaatgaaacttatagggactgaattttggctgtatctaccttcagtttgatttgtatatttttgcttgtcattatttaaatgatgtggtggccatctgttgtggtggaaacatgtttaaaagttacagatttccatggatatttctgcaataatctttagctatcttcttagttttgaagcagagtaatgctgtactaatttaccaacagaaaacaatctaactgtttccatgtaagaattaacttatagacagtattcatagatgctatgcttggttctggtgttcatctccaatgtcaaatcggctatgtgatgcttgtcagttaatctaagcacatgcattgcattctcattactttatttatggtcatggtactccctatttacgggccataaaaatctgatgtgtaagctatttagcttaacattttgaagaactaggcaaaaggaccaccgaccttggggtgtgctgtaaatggcaacttccattcaccaccgagatgccagctgcctagtgtactgaggttatgcaagtcaacctcgtggggaacatcatcctctgatgctgcataaactctccctgcatgctcaaacacgctagtgttgctcatgcttttcattacctttcggaattcagctgcacatactcaacagtcaacatatagcatttccaaaatgtttgcgacaatcccaaaaaaattacagaagaaatgcgatgtagtaatagcagcaggcaccatactgtgttaagaacagaggcgatgagcatggcgggagggttcccatcggtcatagggagaaagcatggtttctgacgttctttctcaatcctaaatgtttcagattgcacgtagcggttattgtacgagattgaccatgtgctgttattacttttgcagaagtatacagcatggagcatgccttctccttccacccagatgttatgggactgcccgaaaatggaactaacagattggaggcctccatagagagggtttccgcctgcattccacaatcatcagagcatctgggtttgttccatgacattttgtgaaaaaaaaaggaaatcttattcggtcaaacgtattactaataagcttgcatatgtgaattaccatttcttatgtagacaccctcaggaaaatctgctggaatctctccttcaatctctataacccgtgtgatctccccgatctcgtcgactggtgcaaaattgctctatagaagtgccaacacaaggtatgcatataatattttgccttctgctcgtttttcagctccttgtcagcaagttaactggaacagaatcgaaccatttgtatttacctcagtgggacgcaaaggttgacatttgaatgtgaaggtgtgatcaacaaatgaatccagcagctgttggtaagtactgttcatggcatttgatgcctctcccagtttggagcttagatgcacctgaatctccctgaaatacggctgaaacatgaaacaaagcagagtatttggtttacatttctcactcactgaaggatcacacatctattgctgtgtgcaagattgccaacctttccagtggatgctttctgatgagatagacgagcagctttaggggagatggatgacctggagctggagatgcatacgcgtggttgaagggtatacatggatggcaccgtttttggtctccctgtatgcacattttaattgatcgccggggtttctatttatatctgcacttcatgtgtgaatgcttttatgcccacacgtaactgtccgtatcacggtactttacaagcggtacggaaacgaaacaaaatctccatcagagagaacatgaagtgacaaattcaccgtacttttcagtcgtgattgcgtttcttgtgttatattagtaggataaattggagagcacgtgctctccatggagaagggagagtaattaaagcggtagatatttttgataaactatatagaaaacgctactacctccgtaaaaaaaaaaggtattttcttacctagtacctgtctagaaaatgcactcccttggctttttaggtggcgtttggatccagggacttaactttagtctttgtatttagatactaatttagagtattaaatataaactacttacaaaactaattacataaatgaaagctaattcgcgagacaaattttttaagcctaattaatccataattagagaatgtttactgtagcatcacataggctaatcatgaattaattaggctcaatagattcgtctcgcgaattagtccaagattatggatgggttttattaatagtctacgtttaatatttataattaatatctaaacattcgatgtgatatggacttaaaagttttagtcccatctaaacagggtcttaggacggagatcactcagactccgaaagggggttccttttgggcagtggtgcgccaagaaaataaatacttcctccgtccttaaaaaaaatttactacgatgtgacatatcctagtactaggttgtctttttttgggacggagggagtaccgtgcatcttggactcggttgtcttttttgtttttatacacgcttttccttattgtgcatagtgtcgcatcgctatgatagcttgcacgctattagtgctaattgcagtgctaagcgaattgattcgtgttaattgtagtttttataatgaaaatagccactttctccgtttcacaatataagactttctaacattgtccacattcatgtagatgttgatgaatctagacacattgtgaaacggaggaagtaggatagctcacacgctattagtgctaattacagtgctaagcgaattgattcgtgttaattatagtttttataatgaaaatagtaaacaaatagttaagttgaaaagttttgaaacgagtaaaatgttttcaaaatttaacttgaaagttcaaaaattgagttaaaagttttcaaaattagacttgatagtttaaattttgagttgaaatcttttaaaattttacttgaaagttcaaattttgagttgaaaattttcaaaatctagttgttagttctaaatttttagttgaaaattttaaattttagtttcatatttttataggaagtacttttaaattttatttgaaagttagcaaattttagtatatatttttaaattttttatataaaaaagaaacaacttcctatgaataaaataaaagaaaaggttaccttaattaaatccgtgataataaaaaactaattatttgagcaaatcataacctttcccgatcccactctaacaacgcacacgtaactggtggtctagtggggcggaatcgtgaacttatcaaaattcggaattgcttgtagctggtgggtcaaaaccgcacatgtgggtgtgggccaaaaacacgcgccaccttgcttgtcggtgcgcctgtgcggaacaggaatagtgattaaaacagatggcatctaaaagaggtacagatgacacccacaatacctccatactcttgtgttgacaagtccatactcccatctatctttacaccattttttttataaagaaataaacatcccggcctttgctcaagagagctacaacccattattacaatttagcacttcatatcgagtgtagtccaaataagacagcaaacatcacggaaaaataaagcgaaccatatgaagttaaaaccatgattaaacagggatgaaagctgtgaattatatctattctttttggttgatggataattttatctggttttgagataattttatctggttgatggaattcattttattttaaatggctataatcggttgagttatggatgataagacgtagaaaaataacaaatcaaacaaggaacatttatgtgtaaaactttttttcctttttatgtttcaaaagctaaggcaaatagaatctactgttgcggccaggggcatatcataggatatctagggctcaactgctcaagctttatgcttgggttatggactccagtaagtttcatattaatttctaaaatttatagaaaactatgagtccataagccagggcctagatgtggctcctggagcctctgcttatgactgataagccaatcaggagatgattagattgatgagactagctcacttctaaatacgtggtcgtgatatattacggcttagagcgttacatgtattttttcgatagagttgatggtaaaacgtagttttgtcaccgaacaaagaagaaagcaatcgctatctgattacttgtacagacagaactcacgctgcaaattcgtgtcgatcttgtacggatagacagtggctaattttgttcaccttgacaattccgtgaaaaattaatgatactttactgttggcctaacatggacagcaaatggagaatggtactttactgttagcctaacatggacaaaaatggagtccccatgagtgtggccgcaacacatgattggagtttacactgttcggcccatgttgcacgcaagttgattatccctggacgaactagttgaccaatgaagttagaggaagatatttttgtaaatttcaaaaacctttcacaaaaatctttataactatggcctggattagttcctaaattttttccccaaaacataacatcaaatctttggacacatgtatgtagcattaaatatagataaaaacaaaaattaaatatacagtttgtatggaaatcgcgagacgaatcttttgagcctaattagttcatgattagctatataagtactacagtaacccacatgtgctaatgacggtttaattaggctcaaaagattcgtctcacggttttcaagcgagttatgaaattagtttttttattcgtgttcgaaaaccccttccgacatccggttaaacatccgttgtgacaccaaaatattttctttccgcggactaaacaaggtctatctgtctttatattccagcaccttttatggtcgctacaaagcttggattaccgagatttggttgtgttaagactgttagccagtatcacgattgatatgacaggccaacatgaagttcatcttttcacactgacggtgtgtttagttcacataaaaattgaaagtttgattgaaattggaacgatgtgacagaaaagttgaaagtttgtgtgtagaaaagttttgatgtgataaaaaagttacaagtttaaaggaaaagttgggaactaaaccaggcctaagattcagcacttccttcgatttgcccggaatccaagccatatttaggccgagtttagttccaaactttttcttcaaacttccaacttttctatcacatcaaaactttcctacacatacaaattttcaactttttcatcacatcgtttcaatttcaaccaaatttctaattttgacgtgaactaacacacccctactccaaaagtgtcttgagttggttgtaattgtgacttcaatgacatgccttacctcgttcataaattgtgactacaggtgcctttataataaagcactctcttatttacttgtttcggtcataaatatttgccattaaactagggagtagatatttgatgttggggtgcgccggcgctgctcaattagaattcttgttagcaggatagtagtatcaggccctttctttgatgctttgctagtttcggagtcatttacttccttggagtttttcttttcttcccctaaccgttttttccttggcgttccttggcagtgacctgacctcctgctgttgtgttgtgtaattgaaattttactttcttctaatatattgacgtataatatttttgcgtatttgcgaagaaaaaaatgatgttgaacttataaaattcggatcatgaacaatttctcaagtgcttaatattgaacgtaatatggtatagatagatttggcttgaaaataactatcacaacaccatacacttgctaaggctgtgttctttgtgcgttgggatttgggaaccaccatagattccacaatgtttgatttgcacaccatacactatcactagcatagaaacacccattactgcgggtccacaattggctttgttgtcaaacgacaactgcgtcacgtcgaaggacgtggttctctcaacaatagtcggaagtaaagataattgtattacttggtcaaattttttcgggatcccccattaggctatttataaccctatggctcccttcttttaggttttgggcttataggggaatttacatggttgcccttatgatagggacattattgagggcacactgtgtcctttacatatacgggcttctaatgggccaacagactcggcccagtcatggcgaaggggctcctcaagggcacgacggcccatcgggccttcttctggcaaggcctggctttggcgaagctcgcgtgcctcgcgatatggctttcatcatacagccttcgcccgcgtagtcttcttctgacaaggtccatctccagcgaagtccgtgtgcttcgcaacatggctttcgccatgtggctttcacccatgcagccttctcgggtgtggagcgcaactgcgtcccctcggtcttcgccgtacgtcttcggcttgaatccttgctagcgcttcggtttcggcaggtctggtcgaaggacctcgtggtatacctccaacaagcccctcacgggcaagggtgagtatggagctctggctgagaccgtgcaaaatttatggtatggcatgaggcgccccctttcggccgatgttcctactgaaacctgttctcgttcctgcacaaattttgacacttttgttatttttgctagtgctttttcccaggcaaattgtcttggaccttcgccttctttatggcgaagcttttgtcttggctttactgcctatgaatagtgttgggctttttgggccggctatccattgtttttggcttttcactgttcggcccactctaacgggaaattaccgttccgtatacccccctagcgacacgtggcaagctctaattgggtggtaggcgaaccgtcgcgtgggtgggttatatatacttccccccggtgtcgcttttacttttaccccgagtcactttcaccatctcctctaccgggagtattgccctgtctgccttttgtgttcaccggctcttgttgtccactttgactagcgtgatctcaactccttcactagcctttctgtacttttcggtcatggctcctcgtaaacctgctcctgcttcgaccactggtctagacccgggaaagatcgacgaagagcacaccgggtatcttggtgcttcgctcattgatgaggcggagctagcgaagctggtttcgatcagggtcgtgaccgaagaacaggcctttgcctctggcaaggcggtggtgccgaagcctgacgagaactagaccgtagtcttcgtcgcattcttcgatgcgggactccagtttccttgcaatgtcttgctaccagagatacttcggctttttgagattgtattgccccagctcagcccttccgctttggttcgggtcgccatcttcgactagacgtgccgaaccgcgggttttgagccgaccgccgagctgtttggagcgatcttctacgccatcgtaaattcgaagacggtggtcaccctagccggtacccgaaggacggttttcgggagcacgaattttaacttccaccccgagcgctccaatttatggtctgtgaacgtgtccatgcctaaatgggatcgtcattggatgtcgatgtggttttaccacaccatcccctttgaggccgcatcggacgcagccaagaccatgaagtggcagtgtagggccatcgcgcccgtccgaaaacccaaagtggtgatcgacgacgcgatggaagcttgcttcaccctacttcggaagatcactcttcggcttagctgtcatgatttggtggaagagttctatatgcttcagattcttcccctttagcagacatggcaagtcgaagtaaacaaggaggaggaggcggatggcctaccgaaacttgtgctccccggaggggcgaattgtgagtttgctattcaattcaactttttttggtgttattgtttttgttatgcttccccttcttattgtgctcattcctttgcctttatttcgatagtacttatgctgcctaaggccgaaagtgaggcctgaagaatgatcggggagcttaccataaacgagcatagccagctgcttactcatcagatgggtggctgggcgaaccgtgttttctccggcgagctgccggcctgggcaaaccctatcaaggtcgtcatcattgacgaagatgatgccgtaccatctaagaagcgcaagtgagttaaaggaagttttctacgtgaaggacatggctagcaaaccaaagaaggggaaagggcccgatgagccaagacgccacgtggttctcccaggcaagaggaaaatcgtcggagtcaaggataagactgacgaacattacaatctgtttgagggacaacctccgttcgcagtgatggttgacccgaacatcctcctatcaaaggaggagaccccttactcacgtaaggatcatagcgaaggaacaatagtgaggagaaagtacgtgaggaagacagtgacataggttgttgtatggacgatgtaaattatttgtaatgtactgaaggtcaaacagcttggattaatttttaatatattctccttaacttcatgattttatttattatgaatcataatccatttaaatatgccatatgctaattatatgtgactatagatatttattaggatttttaaaccatttaaatatgccatatgttaattatatgtgattatttgtatttattacgatttttaaaccatttaaataggcaatatgttaattatatgttattattggtatttattaggatttttaaaccatttaaatgggccatatgttaattatatatgattatttgtatttattaggatttttaaacaatttaaataggccatatgttaattatatatgattattggtatttattaggatttttaaaccatttaaatagggaaggccatgtacttatttgacgagtgaggcctaattattatttttggatacaagcagctccatgtgaattcatgtgtatgtctgttcatttttcgctacaaacagctccatgatcttttgtattaccagataggacgacgtggccttgttcacaaatggttgacactttcgtgacgtaagtgttgtgttttgaatgccttgcaaatcatgtggctgacacgacactcactgtatcagtgttagatgtaggatcgaatcacaataactaagcccaaccagaacggggtgaatagttggtatacctaaaaacaaaaacttttggcggaaataaaagttacccttgaaattaacggatcgcggtctgaccgaagatgaacgtcggtttgaccgatgtagatcgatcggtcgaaccgccaagatcagctgccgctagctgtcgccgccgccaatctgaccgcccttatgccgccggtctgaccgctgcttgccgccggtctgaccgccggtatatcgccggttagaccgccgagacccggtaaacacaaatcgaagaacttttaaagtggatgacgactttattgattctctctgtgtttacaaagtacaccaacaacactccttacaaaaatttcgactaaactcgaaaccctaactcaaaactcaactcaattgctctcaaaagcgataccgggaagcctcacgctccccctctatttatacccgaggtaggcagtttaaagtcacgaaccaaactcatactaggagtcctaaacaccttaggaaaccctctagtacaagaaacaaactttacataaccaatcgtaccaaatttagactccctccaaattcgactccgcatcccatacgcacataatatctccatcgtatgccatatggaatctccatcaaccacgtgcatcaactctagcctaagtatcccgcatgatgtctgaccaccacggacgtcgtcttatccccaagccgactcccggtccatcaccgcaaatactctcccgagacatcgagtcacctacacatgaaataaacaaaacaaaccatattccgagaccaaactatcccaacttgactcattagtagcaaacaacagcattacatacgtatagtatccatctagaagccataatcatgaaacaatcacggatatccaaacaaacaacccgaaaccgaaaccgacacagagtcggtcggtcagaccgcgggctggccggtctgaccgcacgcataccgccggtctgaccggctaccagagcccggtctgaccggtcacataaaatgacagcatcctgtaaattcacttgtaaaatccaatcatctccaaaaccacttcgcaaattaattccaaataataaaaccaataatctccgatgccaattgttcatcacaaaataataataaaaacacctttgattttacattagatgtctgatattaacacatgtcaagtatttctcattgaattataactggtgatgaagtgatacacttactatataatcaatattttttagatggatatagtgatttttcagtactcactgtattatgaaatctggtctaatgcatctggggtatttactcaattttttagtttcatatcaacgaaaattggattagctgcaagcaatctagattactcccttttacaaatgagattgttaatatatttttgccctgttcaggtgaacaaccttgattcatatagggtatcttcattgcggtgccacaagtactactgcatctcagcaaactagattggtaaggattgaagggtttgttgtataaaataggccagatgattaacagctggaaccaacaagattgtaatataccctataatgttagcctactcctttttccagatgcaagatgctatcgtacactaaatttgggcttcattttgttctgcttttatgcctccaattttttatcagtgtactgattttttgttgagaaacacagtacaaacgcaggcgctcacaacatgcgcacactcacccctatgaacgcgcgcacacacaccctacccctatgagcacctccaaaagacaatctatcaaaagcaacaggccttgtacaatctttttattctaaatgactgatgatagggcaccatgcaggatttgtcgccatgttcttcctctccgtccacggctgcaagctctccaaccaggtcaccggatccccttatttgtagggtcgctaggtaaatgagttgcttccatgttctacttcaatagcatttctgagggcaacaattcgatgttggcaggttttaaatggaccaactgcatgtaaatacaagtttgcattgcttgctggaccgtagatatttcatattgatagccgcagggtgaaaatatctccatagcttcaataagagttgagatagttttaggaggtattatccctatatctaatatctatctcctaatttgtctttgatgtgtacaactgaactaattgaaatcaaatttcaactaattgatagtctttaaatgtttgctgaaccaaggttttaaggtagatggcattgcaaaatgtttgtaataattgttttgataaaaagttaatgagctgcaagttcttaccactgcatctgaccacctgacataaagctagctgaatatgaccatgatccatctgtagctttgcacattaggccttgtttagctcctaatttttttttcccaaaaacgtcacatcgaacctttggatatatgcataaagcattaaatatagattaagaaaaactaattgcacagtttgcacagaaatcacgagacgaatcttttgagcctaattagtccattattagccataagtgctacagtaactcatatgtgctaatgatggattaattaggcttaataaattcgtctcgcagtttccaggcaagttatgaaattagttttttttccatcttagactaagcaaagtatcgaccatataaatggaggagctcacttcacttctcaacccactcaagcaagctcaattgctcttcatacattactattagtagtatagtgctaagtggagtagtatagaatagtgttcggaagtcctcggagtcttcagaagagttttcggtatggctctagcagctcttgtaatattctgtaatactctccaaattaatgcaatactcttctttatacatctttggaactttgcttagtctaattactggtcttactttatatctgcattatgttaattgtgtaggtagcctaccagagaggtgtaatggtgttggtttaatgtctgatttatcagttgctctatttcgagtgcacggatatagagtagtatttagtaatgtgagcatggtgcttagattattaaatattattaattgggcatatatgttgcgggacagtagaggtgggccgttgatggtgacagctcagtacgggtattattcctccacgttagtgtatattcctaagacaaattcctgggagggtactccttcgttttagctccggttggacggccatgacaggctgtcgtaagaaactcggcaactcggggtggtctctcgaagtaccaggaggacacttttagggggtattggccacatgattgtacattagtagatgtaaagcgaggatttgagtgtatactagaagtatatgaatcgaatgctttctatttcttttcccactaagttagaattatttcatgatgaggatttaatcagctttgcttcgtgtcactctacccctgtattacacttaacccctgtttaggctttgacaattataagtagtatatgtataaagtgcattagcaaagttcactcttattatcttcccttgggattaaaaatatgatactttggaatacttccgggtaaaatgctacaattgtatatccgtgcgcttgcggattatatctgtaaccataaatatcctaggggaatactcattcccagcaatgtcgttaagaagtactaacaagcatttctagcgtcgttgtcggggaagattaataatgagttgactaagctaataactttatatatataatacctctgtatgagtcactatcctttgcaggctaaccttgattgcttttatttgtgtcgtgaaaagaggatagtgtataactggtttcaacttaccggaaaactttaacgagaatccatagtccttcttccggagagtcaagcctcgtgtcatccctccacagaagaggctctcttaaaagaaactagccatcccaacgtcaccaagtttcatgaatagggccaagaagacccttcgcgaattcgctgctccgtctgctgacaacgtgcctgttgacccggctgtcaacatgggacacatcgacttcgatcttaagagcagcctgataactatggcgcaggcaagcccgttctgtggcaagctgaacgaggacgcaagcgctcatctgcaacaatttctagagatctacagcacctacactgtaaagggtgtcagttcggacgctgtcaggcttcgtctgttttcattctcactcctggggaaggcgaagcaatggttctatgcgaaccggatgacagtcaacacttgggacagatgctccaccgcgttcctctcaaaattcttccagatgggcaagaccaatgcctttcgtaggagaacatcaagcttccagcagactagggatgagacgatattctcgaagcatgggaacgtctgcaggagtatgtggccacctgtcctcatcatggaatggacgactgactcattctgcaaagattctacaatggactcattccctcatctggaaatcatctggatgctactgctgggggtgccttcttctcaaagacggtccgtgcggccattgatcttattgagaagatggtatccaacatgggatggagcgaagaacgactctagaccagacaacgcggcatgcattctgtcaaggagacggagatgtttgctgctaaactgcatctcctgatgaagagactggacgatcaggagaaggccaaaccgcaagccactgtcaaggcattagactcgcacatcacatgcaaggtctgcgagaacactggtcactcagggaatcattgcccggagacccgtgaggaagccatgttcatggggaataatggctaccggccgcaaggaagccaggggtggaaccagccccgaccatactatcaaggaggcaacaacggcaacaataacaataacagtaacttcaatcagccctccgtgaaggacttagtttttgcgcaggctaaaacaaatgatgctataaacaaaaagcttgccttgaatgttaaagttcttgagaatataaatgtcaagctagaaggctttgcttccgctttccaaaaccagctgagcttcaacaaaatgatagactctgctggtgcaactagactctttagtacctatgaaggagacgggaaggattccggggcagcccgaaccttccctaaaaaaatgttaaggcgataaccacgaggggaggaaaatccactcaggatccgccatatcctaacactatagggaccaagcaagctagaaaggaggcacagcccgctagcataaatgaacccgaggaagatgaggagatgcagctcaacaagatcgcgccgcaggaatactgtgacacaacgcggctgccgtttcctcaatgttggaagaagccctccatggacgagcaatttgctcggttcatggatgtcatccaaaagatccacatcaacatcccgttggtggatgcattgcgggtaccaacataagcccgctacctaaaggacatcccgaacaacaaaaagccgttgcctaccatggagatggccaagctcatggaggagtgtagcaacgctatactccaccggctgccggaaaagaagaaagatccggggtgtcccataatttcatgctcaattgggacacaacacttcgatcaggcccaatgtgatcttgaggccagtgtcagcgtgatgccgaaggacgccttcgacaagctgaactatacggggttgattccaacaccgatgaggctccaactggctgactcctctgtctgctatccagtgggcatcgccgaggatgtgccaataaaagtcagggatttcttcatcctagtggatttcgtcgaacttgaggtggagttagataaggagacgcctttgattctggggcgtccatttttgagtaccgcggaagccaacattgatgtgggggctgggaacatccggttccacatcaatggaaaggagcagaaattcaactttagaccaagagcagagcaatgctctatggtcaagatcaaatacgacctgaatgcacggaacatgaaggaagttgaagtgcagccgccaaaaatggacagcctcgtaaccttcatgaagaaatacccttcatggtgaccgatctatcccaatcacttgatttatgtatatatcgacgaaaatattatgtgtcattgatatctacagccgatcgaatagatttactcttacttattcatgactgccgattgattcaaatatgacgtcggctcaaagataaatgatacgtcatcggtggctagccgatcggctatcgtttaaggatttaactgcgatttctttgtctttatttcttgttgattgcaggatcaaatcaactggcacgctcacgaatctaaaggcaagatttttggacctgcactgaagttaagcagatcttccaggcctcgtgttttcgcatcaacatttatggtattgaaatacttttcgagtatttgaatgcctactttacattatgttcatgttatattgaatatactgctagcttatctaggagatgctttggtgcaggtataatgtttgcatatgcaattactctatgtcatgacgatgatattagagtagtatctggtagtttagacgtcgtgtctagattacgagatatcattatttggggttatatgctgcggatgagaggtgggctgctgatggtgacagctcagtacgggtattcctccacacgtgtatatagttctaagttaatttcctggggaggatactcctccgtatttagccccggttgtatggtcatgacgggctgtcgtgaggaactcggcagtcaggggtggcttctcgaagtaccaggagggcatcacatagagggtattagctagtatatcagataactagaatatatgtatactatgtatactagaagtataggaatagattctctttctcttttctttccacttagcttagatattttattatgagaatgagtagcttactgcttgtgtgtcactctacgcttggattatcttaacccctgcttaggatatgattatcacaaataatatataaattattagtcaagttctctctacatgatcttcccacggtataaaataaatacgatacccttgtaatactctcgggtgaaatgctacaatggtatatccgtgcgcttgcaaatgaactctataaccataatataccagaagtatttatgcgccattgctgggaattatatttctaatagtgtcgttaagaaataccaacagtgatctaaccctaagttattgtgagatatgatatagtgatatagagttgctataatctagatccaagcttgatttaaattctggatgatttgttttttgaaatgataaatttgcatgttcctcatttgatataaattcctaccacagccaaatatagtttgcacttacaaactttatacaatatttggttacttgtatatccattgaactttgtcaaatcttgtgacttgtgtagatgcttttcatactttatgatcaagatcataaacccatatatgcacacatatgctaagcttctacactggaagatagcatccatgtcatcattatccacaaataagctctccatccatgcttcctttccaaagaaaaatcctttgcaaaaataaaaaaaagagggaaaggtatggctatgagaaaataataaattcttgctctcccaaaattagagcatgatgaaaaaaaaggaaaaagaagccataccctctctatgaaaagttaaaggatattttggaggaaaagcataagcacaaaggagaagcattttctttatctacattttgttttccatcatattttccgccatacattccacacactttgcacgatcttgatctaagtatgacttgctatctgctctagtctaaatttttgacatagtaatatatgtgaatgcaagtattcctcatttgatctttaccaagctccacatattcaaccttagtatagggatcgaaaagttttgtttcccttttgtcctttactcggaacgagcaaaggttcaagcttgggtggtttgttgacggttgttacagacaaattttgaccgtcaatataactaaaataatggagaattagctatacttacaatgcatatttgttttcaaataatatagttccacttgtacttggagaataacatgttgcaggaatttatcaaataaaataaagagaaagtgaagaaacctcactcctaagcaagcaaatggataaaatgggcccacaagtcaggtgtaacagtcggaaactgaccttaacttccacaaccacctaaaggacccacttgtcagccactgtaccgaaggggaggtcggttggagccgaccctggttcggccgaaccaggggcaagccccaaactgttgtttattagaacctttcggaagatcgggaaccctagtgcacatcaggagtagtatagaatagtgttcggaagtccccggagtcttcggaagagttttcggtatggctctagcagctcttgtaatctcgtctataatacattccgaataaatgcaatactcttctttatacatctttggtactttgcttagtctaagtattggtcttgctttatatctgcattatgttaattgtgtgggtagcctaccagagaggtgtaatggtgtgggtttaatgtctgatttatcagttgctctatgttgagtgcacgtgtatagagtagtatttagtaatgtgagcatggtgcttagattattaaatatcattaattgggcatatatgttgcaggatagtagaggtgggccgctgatgatgacagctcagtacgggtattcctccacattagtatatattcctaagacaaattcctagggagggtactcctccatatttagccctggctagacagccatgacaggttgtcgtaagaaactcagcaaccggggtggtctcttgaagtaccaggaggacacttttagggggtattggccacatgattgtacattagcagatgtaaactaggatttaagtgtatactagaagtatatgaattgaatgctttctatttcttttcccacttagttagaattatttcatgatgaggatttaatcagctttgcttcgtgtcactctacccctgtattacacttaaccgctatttaggctttgacaattataagcagtatatgtataaagtgcattagcaaagctcactcttattatcttcccttgagattaaaaatacgataccttggaatacttctgggtgaaatgctacaatggtatatccgtgcgcttgctgattatagtaactgttgaccatccttaaatcataagattttaccatcaatacttgcatataatgaaataaaatatagtatccaacttagtggtagggtttattactaatcatttccactagtgttggtgaaatatgtgtatgcgggtattttgagaagaaaacacatccgtcaagcgacaaactgtacctccgcgcattcaggacacatttacatagattggaggccccataagtcagttaaacacctccaaatggcccaatccatcgggccaatgggctgagggcctcaaaattagtgtccacgaggaaaaacgggccgatcagagccgtcctgagttcgatcgaaccgttcctgaggctgttgatcgccattttccatgtggacggccctgattacttcctgatggcagtttaggggcattttggacatttcacataagctgtaaccgtcatacctgcctataaatggagtagctcactctcatttccaacacacaactttgagctgaattacaagaggctctattgtattttttgtacattagaacaaggtagagagtgaggggaagctctggaggggtgcccggaagtttggcgctcatccgacttctttctcgacgactgcagtttcttaggaggaattctggaggagtaccggagctggcggtacactctgctccaggttcggagaacttcttctataaagtaagcatttgtgtttttttcttatgttatttaattacttagtctaagtaagatatatttccatctttgtgggttcattgtttagtattcgtactaaatgctctagtactaggactacggatattgaaggaagttcctgcgcaaatattagagtaataattaataacttagacgtggtgtctaggttagagattacctttgtttgttgtgtatcccacggatttgtcagaggtaggcggtaggtggtgacagccctgaatcccgtcccagtaatcctccacattcgggtacatcatagagctatagccggaaccacgctggtagaaaagcaggggttggtgcccaaagctacagataggaaattacctttgcttagcgtagataattaaaacacatagaaatacctctctagcctagcttgcctacctattgttgatgtccttggatagtcttagccttaggtagattacacacgttccctgagttcaatatccttttgggatcactcgaaggtgaagtgctacatcggtatttcgtgcgcttgcggatttatctgtggtcgtaagaaataccaacagtaaccataaatatgccaggactatttctggcaccattgctgagaatgactattcctagtagtgtcgttaacaagtaccaacacccaccattaaagcatattttagtttaattatggtggtacatcataatataattaaggacataattataatgattcccattgtgagctaattgatctatgcatggctaagtattgctaaaccaatcatctagtcaattataacccaagttatcaatgacataagatattcaacaggctaagtacgataggcatccatcccacatgacattctaaaacaataaatttaatagaaagcggtggattttgtaaaaataggttcaacgtgatcaatgttgtatgtatgacttgccttgctcttgagctgacgaaacctcggtaccacttcgaaataaactggatcactggaactggcggaatctagacgacaaacaaagtacacaagaaatacaagcaataaggctactgaaacaacaaaagaaaccaattttaatggatgttatacattttaacggattcactgcaacttgaatgggttaaaatggagctcaaattatttagttatgaattttacaatatgagctgcatgattactaataatcggaaaaccataatcatttattacatattattgcccaaagataaatagatcaatagaaatatatctccggtaagcaagtctcacgagttaatgactcaatgagtcaatacttcgtgacacgggaccatccaaacagtcaactgaaccggcgaacggaaccggcggcttagaacgactacggctaaaccggtaaactagacacggtttacagtagagatttggtaaacgataggccgataggaatttagggatgcacctagggctttgcgactcagctaccgagctacgggcagcgaaccaaccatgaagacgttgcgggagagcggtggcggcgatggctaaggctgcggctcagctaggcgacggctaggcgcacggcagtggcagctagggccgcagcgcggcggcggcgctagagcggtggcgcggcggcactatggtttagcgggactaaacaattagggttacggcaataacgctaggaaaaataatacctaaactaggggatcacgggaaagttcctcaccaaactgagacgatcggcgaggaggattcgacgatgatgatccggcggcaacacatgggaacaacggcgacgctagatgagaaacaaacggaatagaatagctaaattgatggttgcagtggcaaacacaccaatagagagggagaacggagtatcgacgacgcaacggcgacggcgggaggcgacgacagtggccggtggcagcagcggcttgcggctaggactaggcaaaaatagattagaaaaaggtgggggactaggacttatataggagaggaaaaataggagaggaggtgggaccggtggggagtcggattaggaggggaaaggaggccaactcggatggggagagggggagggcgcacgcggctagggggagagagagggcgcgcggccggctagggggagggagagggggagggattaggattaggactaggactttcccaaaccggaaaagaaatgcgctgttatttttggaaaagaacggaaacagaacaggaagctgacttagactcgtctcgtcatgcaaaacgaaaccgtggatgaagagaggagtgaatcgagcacattttaggaaaagaatggaaacagaacaggaaattgactcggattcgtctcgtcatgcaaaacgaaaccgtggacgaagagaggagtgaattgagcacgattcacgaccaaaggcgggagagaaaaaatattattaatttaaatcctgacaattttttgttgaacgaataaatcctgacaatttaaattaacaacatttattccgatggtttttgagtcccgttaatggtttttgagcaaagagaattcgggaaaaaaaattctccctgacattttcgattattaaataccttggtaatttgggttttatcttgtttaactaaagtaatttctatagacaatttattggtgaattagaaactaccgaaaaaggaaaactccgggtgtgacagtatatatagcatcgtcttttggaggacaaaatttaaattcttagcgaaggcatacgtaaccgtgccgtaattaattaaaggatattttgccattatgttgattgagtctatacttaatcgatccttctgttttgtcttgtattcctccgaagtcatcaacaacttatcaatattgcagactaatttaccataacgtctctattgctgaacttcaaaattttccaatcacataacaacggttcgttgaaacggtgaatatatatagaccacgttagcttcgtaaacatccttttaagagaaaaaaaactacgatatcctggtaagatggcagttgggatatcagcatccggcatgattatgtgctcgaaaaagtgtggactaagtcaagtcaaaattatatatgcataatgtgcttatttgatcatatatatttttccaaaagataatcgcatagagaataaatttgtcttgtgacatggaaagattggatttacagaatcaaacttcttggttacacactaatatacaccacgaaaagtgtacgagttattactattcgttctaacagaagatgttttgcctttttctatatattcattgataaaacattgtatatttataacatacttaaaaaaatattcatgcattgcaacaggttaaaggaattttaattttacatattacttaagtccacactcagagtaaaatattacactcatgcttggacctgtgagcaaaatttccatccctacacactcaggatatcctactctagaaaggaagttcaaggttgatctaaagagctggccattatttgctggatgaaaataggagccctgctatcatttttgcatccatgcaaaatctatacatcatgatgtccatctatactgaattatagctcatgatgtcactataccgaattatatatcattatatacctcatgatgtcaggacgtatgatgtcactatatacaccatgatgtgaaatttggaaggtttttatgctatacgtccataaaaacattgtctggatatccttcaatctccaaataactctgtcactatatacaacatgcgtatagcttgtgcatggatgcaaaaatgatagcagggctcttattttcatcgagcaaatgatggcctgctcctttcgatcaaccttgagcttcctttcgagattaggatatcttgcggagtgtggacttaatatgtaaaattaaaattcctttaacttgttgcaatcactactagaagaattgtttttacaggcggcgaaaaatatatttcccaggtggagaaaagaacctctcgtaaccaaagacctacaaaaatagatgattcgaaaataatgttcacagccggcatctcggcatctccatcttcgtaggcattagatccacccgcctacgaaaatattttcagtgcacgaaaaaaaatctgttgtcagttggcctctccctctagccgacggctctctacctctatccacctccgcctctgcctccgccgccgccggctggctcccctcttccgtctagatctgggaagggaggggccggtgctgtctgtgccaccgccgcaggcggcggcggacggatctaggaggaagggaaggagaggattggagcgtcaccgccattgtctcctcttccgtctagatctgggagggtggggaggggccagcgccatatttgagatgaaggggggagggcagtgcggacggctgtcagctcccctccttggacgttgccaccgctgcctccttgcacgcgccgagccgctgacggccactggctcctccttcttgcatgcactgacagtcatcggctccacctactttgacgccgccgcggcctccttacgcgccgagccgccgacggcagctggttcctcctcgtccttgtgcacacggacggccgtcagctcctccatctcctccgccgctgccgcctccttgcgcgtgctgagccgccagctcctgcttgcgcatacgtgctttgaggagatggagagggacaggccggttggacgagtgaataaggataagtagtccgcatgtgaaaagtaatttttgctggcgaaccacttaagaggtctgctagcgaaaataaaagtatttttacgggcggttctcttaagtgatccgtccggaaaaattgatttttgcaggcggacgacgatcttacccccggttgctattttcgtaggcggccatttgggttcgagggacatatccacctgggaaaaaataagcatacatctgcaaaaatgattcttctagttatgaatacacgaatatttgttttagtatatatatatatatatataacatatatacaatgtttcatcaatgaatatagaaaaaggcaaaacatcttctgttagaacgaatagtaataactcgtacacttttcgtggtgtatattagtgtgtaaccaagaagtttggttgtataaatccattctttccatgtcacaagacaagtttattcactatatgcgattatattttggaaaaatatatatgatcaaataagcacattatgcatatataattttgacttgacatagtccaccctttcgtgtattaataatgccggatgctgatatcccaactgccatcttaacaggatatcgtagtttattttttctcttaacagcatgtttacgaagctaacaaggtctatatattcagcgttgttcaacgaaccgttgttatgtgatcggaaaattttgaagttcagcaatatagacgttatggtaaattagtctacaatattggcaagtcgttgatgacttcggaggaagacaggacaaaacagaaggatcgattaagtatagactcaatcaacataatggcaaaatatcggaggcgactccccgtcgggcggccgatagggaggggtaaaatcggggcgctgcagcgccacgtatgcgtgaaaaacactttaaattattttttcttttaaattatttatccaaatcatgatccgattgcaccattaaattcgttgcaattaaatctttaaaacaagaccacacatggatatattacaacgaaatttttttagcttattattgaattatttttaaatgttgcacgatgttccaccaggttgtcagggttatggataccacatacctaatagtagtcgactaaatttcggcaggacccaccacataccatgtcctatacggaaacaaccttcagatataggaggagtttcatataaggaaggatgaatagagtcctacatggaaacaacaaggactactcggattgtatccatattggttttccctacttctacttagacaaggggacacctattggtataaatacaaggcctcctaggaggagaggggagacggaacaatagatcaagacacaagatcaacatacaagccaacatgcgccaagacaagacgtcggatatcgacttcagagataagcatggctagtcccctacggtgtctatgatactgatatgagagatgtagcgctgtctttgatcttgctgaatgcggattcgaggaggaaggctaccctgttgtcgactacgagtcagcacttcagaccgccaagtcgacaacagttagataggctaccccaaatattgtactggtgtgattatggtgaataagagcaacgaccagcttcggccaacaagggtagggttattacctgacaattcaggggtccgaacctgtataaaaatcctcgtctccgtctcttttacctcaatcttgcatatatccgagtaccaacgatccccatactatgaaaataccggaatcgcgacatcaaacgtcgacacacgtcgacacaggtatatcggaattatttcactaagtagataaaaaatgttttaatcgtttaaatcagatgttgttttaccttatataaaaacaatgtttcagcaaatagtgaaaagatgtttcagtttactgcaatatttgaaccatacatagagaaacaaaaaatgaaacgaatttccttaatagagggtttccaaaataggtgggtgatttgttgtaaaagaatgtttcgttcactgcaacattagatcatacggactcaaacaactcaaatagatatcccagtagctgcccaagattagatggaaacataagcatagtaggaaacgtaaatacgttatctgcttgtctcgtctgtttgccatgaaaataggaacgaaaatatttaagcgaattgtcgaaacatgaattcggcaataataaaaggggtagcgcacgagacctaaaagtggatgatgcggagataaacgatttagacaggttcagaccctctcaatgagaggtaataccctactcctgtttggggatttgaatccgccgggtgtgtattgatctgacgatcaggttgtatcatatgccccctagagggcctcctgcccaccttatataggatggggggcaggattacaagatagaaaccttaaccaatatggtatctgtttcctaaatctactttacaatcttatcaaaccaggactttaggccgttccataatatacagggaaacataatacccaagtcatgatccgttacatatttcatagatataagttatcccctataaccagtcggataaccacgccgtgtgggtatggggtacccataatctccacagtatcccctgagaccttcatagtcgaaaagataatcttctctcaaaccagattactccaaagccgagtgcttcaatcatctttgccatggtctgccgagtacttttaccaaatctgaagactgtggagggctgaaaaataattaaatgtaaacttaggtgcatcgactagatgcacctaataggtgtagcccccgactatgtggatagttgaacaaactaaacatatagtcaaggagtaaataatccaaccaactgagtggttttgataattgtagtcaaccaagtgacttaatattaatacatagcatatgcggtgtgaatccctaaataatatgatccaagtgatataccgactgctttgcagaatatgatgcgtgcaatctaaagttgacaacatcgttgaaaattcacatagcaaaatagctataaagaagagcttgatgttgtgaataaagaaatttccaaagtattgggcatacaccatgcgcacactgctttaacatatgtgcttaagtccctaaaagacacatggtttcaccgtaactggaaatatatggcatatgtggtgtaacattcgagtaaataaactcccgtctggaaaatgaccaaaatatataatcagccttagccataatattggtcaataaaaatgcacacttacatggcaaaaaataatgatattgtatctaatcaattgcttgataaacccaaacagtgccatgactatataaaaaagtcagcggggcagctatataaagctttactgtttgacacattttaagatgcattgtaccaactcctaaaaagttgagtaactgcggtataaaaggattttaaggtatttggcacttgatcacgcgcactttggccctgaaaatataggctgcagacatattaggcctaggccaaaaaaaaatgccttcaacaccctttaaaggatgacgcatgtaacatgctcccgagtaataaatcttctgggtgatatagaccaagtgtagctcatatgaatagcttctgatctgagtgattatcccttatgggatactcccaaatagatataataattgaatcccaactggcggaagtattcggttgataacccttatgggggataataaatagtccagtctttgagcatagaaaatagacccatgatcataaattcatgttgcatgtatccagaacaagtccaaattgaaggtatgctacttgtgtttgagctagtaagcccttgagcatatagcttgtccttctgtagtagtcacaattgtccattgatggtagctgatgtagttggcatagagacaagacgaccaatataaagataatattgcccaccagaggtggcaaaaatattggtggtagtgaagatagtgataccaatcaaaagtgatgaagttgcacagccgtagaggcgaagaaaccagtcggcagcagtcaggtcagccagcaatgaagatgaaggcgcccagcgataaagttgtgtaaccatggcagcgaaataatcagtcgttgacagacgaggcagctggtgaagaagatgaggatgcccactagtggcgacataataagccatccgtgaagacgaggataccagtcggtggtgacgaaagtaagccgacggtgaagatgtagacacgcatcaaaggcgatgacgaaatccaccaatcatgaagatgaagaaaatagtcgccgacgacaaatgcaaccaacagtaatgatgataagcagcaacagagatgatcaaatatgatgacgaagttgtccatcaatagcagtagagtgggctatgttgaagaggcttgacaggatattgatgaagatgacgatgtcggtgatccagtcaatagcggtgtaacagccgatgataatgacgaagatgctcatcagcgtttgcatagtaggtcaaccatgaaggcaaaataacaagtcggcaatgacggaagtagccagaagcgaagacgtagtcacccattagcaacggcagagttgtcagggccaatgaaatagaggtgctgttgatgatgtcagtgacaataatccatcaaactgttgagaagatatcaaagctcgagtaatttccttgatgtgagcatgtgcataacgaagactgatgcaacgcttcttgatttacgaagatgactacagaacttagtgttatagctgttgtagatgcttcacttggaggaaagtagatgctgttgtccaactcatctaaactgagctgattggttgataactccaaactcccgaacatgtagattaaatcttgaatttgatactttaattatggcagcgtccagaaaccaaaattgccggtgaaataattggagttgctgaagtagaatgtctgctccgaagcaaatatgaagataatgactcctagagttgactcgttggctgattaattgatttcttcagcttatcgaattttgagagtcttgtatttgtgtagcccccgactctttggttagttggaaagcaactgaacatagagtcgagaactgtagcttcttgtcatcgagtagccatcacttgagtgaagatatgtgtcgaagatgtctgagtagaaatcttgataattagagaaccacttgttgtagtagaataacacggcattatatttgttaacgcatgccgagatgtcgaggttcttgtagacgtcatggtcggtgaagtagcaaagcttgcgaagtagaggcaatagagtttaccggtgccgaagataataaagatgaagccgctccatcatggtgacaaagttgcatagccgtgatgaagtgaacacgagtcggcggcaacagaagcaaaccggtagcgaagacgcgtagttgtgaagataaaaacaccagtcggcggcggcataaccagtcggcgatggaagaagtagaatgatgacgaaaacgaagacgtctttgaacagcagcaaaataggccagccgtgaaagtgaagacaccatgggcggcagcgaaggcaaaccggcgatgacaatgacgacagtcaatgatgatgaagacgcgtagccatggaggcgaacaaaccagtcggcgttagataagacgcccaacaatgaagacgatgacgtccatcagtaatggtagcggtataaaccagccgtagaagcgagagcagtagtcagcagcaaaccagacaaccgacggtgaagacgataaggccaatcaacagtatcagaatcatgcagccatgggagtgaagaaaccagtcggcagcagacgcagacagcttgcgttgaagatgatgacgcctactagcggtggcagcgacgtggccagccgtgaagacgataacaccagttggcgtcatacgaggcggccggtcggtgaagatgtagacgcccaacaacggcggcataattggccagccgtgcaggcggagacaccagtcggcggcggtgaaggcaagccggcggtgaagacgtagacgccgaccaacggcgcccaacaacggcggcataatatgccagccgtgcaggcggagacaccagtcggcggcggcgaaggcaagccggtggtgatgttctaactgatccattcctagagcgtaagagataagcttaaagccatgaatcccttttatgcatatctggatctggatcctgcagaacaaacatatggaatgagtagtatctgatgtaaatataatactcgaagatataattcaagtattttaaaatgtttataaatatatatttctcctcttgtcaattttgatttccccgagctgatgactcattacgtttaaacactctgtccgactagtcatagcccccaagcaccggaagtcggcctaggcacttcccaaacatgcatatgagtgacatgagttcgtcattaatggaataaagcttcacgaattagaatttaatactcgggtacttttgcaattgttaagagaagaaaataaattatctttatctctatgcttttgatttcttccgagtaatacttagcaccttgcgttactcggtctatccaacgagcccccgggtgctaggaatcggcccaaatgcaactatccatgacaaaccaaacggaaagcataggaagatagaactccataactcgataggcacttttgtactcagattatatcgcaagcaatcaaaaaaaatattatgaaaattgtttaaaaaatatgatataacatatgtagcccccgactcactagtcaacggcgaaccagttgatgtagtgaggcagaggaagagcaaaatatcatataaagaataaatgatgacttagctttgcaatattccccttgatgacggcagaggtggccgatgtggaaacgaggtcgtccatcaataacaatgaagacaccagtcggcggcgaagaaagcggttgacggtgaaagcgaagatgcccaccaacggcggcataataggccagccgtgtagacagggacaccagtcagtggcagcaaaggcaagccggtcggtgaagacgtggacgcccatgaacggtggtgtggccaaccaaccatataggcgaggacaccagtcggcggcgacagaggcaggccggcggtgaagtcgtagacgcccaacaacagcggcataataggccagctgtgtaggcagagacaccagtcgccggcggcaaagccaagccggtcggtgaagacgtggacgtccatgaatggtggtgaggacgtagacgcccaacaatggcggcatagtaggccagctgtgcaggcggaaacaccaatcagcggcggcaaaggccagccggtcggtgaagacatacacgcccaacaacggcggcataataggccagccgtggaggcggagacaccagtcggcgacgacggaggcagaccggcgatgaagtcgtagacgcccaacaacggcggcataattggccagccgtggaggcggagacactggtcggtggccaaggcaaaccggtcggtgaagtcgtagacgcccaacaacagcggcataataggccagccgtgcaggcggagacaccaatcagcagcggcatcgtccgacgtgttctatagagaccatggcaaatttggcggtggctctaacaatacatgtaaagagacaaaaatagtctctagttagtatcaagaaaattaatcctgtggatgtatatttgcatatatgcagcacacatatgttatttggttggccgattgatctcctgtagcatgaacattatatgcatccatacaatcagattattataccaatcttctgccatgcgtgcatacaggtcgcgggtccgagtccggatcgaattagactcgggcaacgaggtgcatgcaaaataataaaccacagatcaaactgagattggtagtagaaacaaataaaaagtgcagatgattatgggtattaatcaatgcatgtatgtatgtatgtatgtatgccatctgctttctgcttctttatatgttgtgacaccatcaggagtctgtggcaattggagtatttcacgtgtggcttccacattacgtctcctatacgtatccgatggcttgcttgatagtctcccagcacgatgagtcgtgcacaggtggtcggcagatctcatcgacctccagtacacgtattcgaacaaaatatcggagagtaaatcaatatatgattagaaatcaatctaatataaaatattgaaatgacaaaccagggattagaatcgtagttctaattgagattatcctcgaccgaaaaagatgtcggcgattcctgaaattgtttccatcgcccttattgacggaaatcttgacgcacccctacctgacgcgccaactgtctaaacatgaattcggcaataataaaagggatagcacacgagacctaaaaaagtggatagatgcggagtcaaaggatttagacaggttcaggccctctcaatgagaggtaataccctactcctgtttggggatttgattccgtcgggtgtgtattgatctgacgatcaggttgggtcatatgccccctagagggcctcctgcccaccttatatagaatggggggcaggattacaagatagaaaccttaaccaatacggtatctgtttcctaaatctactttacgatcttatcaaaccaggactttaggccgttacataatatacagggaaacataatacccaagtcatgatccgttacatttttcatagatataagttatcccctataaccagtcggataaccacgccgtgtaggtatggggtatccataatctccacacgaatcaacagaaagtgctggtgtaattagctaattaaccaatcgaaacagatcgctgctgttttaattggatgaactgatgtgatcgttccacatgtggtttgcacacgtgggcgcgtggcttgcgagtacatgacgatgtactgaacaaaagcgagcgcacgggtggcgagacacgcgaggccaggtgcaacattccaaacgggatcatcggtcgggctgaaattaaaggaaagtcacgctaaacgtggcacgtgcgaacaaacaggacgggaaacgcgtggaacaggaaattggaatcggacaaggcgatgtgtcaaaggcctgacaaaaacacctcgaatttttataaaaccaaattaaaaaccgactaaaacacagatctaaataaattaaatccaaaataaataatacacaattaggcccataattagaaggacgttgtggctggcctgttaagtgcgttgggcccatgtggcaggccacggcccaagtcggtacaggtgtgctaagagtcatcgaattcgattgaacggttaggatcgctcgtgatttagataaagcttgttcctcgtccacagccttttcggccgcaacttccgcctccccttcgtcctccccttcctcttcgccgtcatggtcttcgacattatcttcctcatcggcatcaaagtcggaggaggcgggggccagcttcacttgcccgcgcatatgcttcctggacgtcccctcgtcgccatcggccttgaagggttttgcccggggtggaagatcaccatcatacacccgattcgcccaaccggccacctgccgcgtgagcagttggctgtactcagtgaccgacacatcgccgatcatcctacgggcttcggtgtcggcctgagcaagagtcagcactgcgaaaacaaaacgtgtcaaaacatcaggcgtcgaacagataaaaaagggggggggggggcgaaacacaagtgcatttagagaaaatctgctattgtttgctaaagacttgtctgtgttatattattttcataagaaaacatatagcaaatcttctcttatcacatattttatacttattactgttttgctctaggttgctgaagtttctgtagagattaggatgaaaaatgctaggaacagaaagttttcaacctgcttccatatttttttcaaactcaaaacgaaattatgacatcagccactaaattattgcatatttttttcatgattgagtcttgtcgtttgtttttctttcctttccctcgtcgttttttttgataatcttatatctgatgttcgccctcttcgtcccctctattttttgaactagattcttgcggctcattgttcgacagagcgaaccatgcgggctcgccttgacggattcaagaactgtcttcgagccaaggatgacgaactgggccgcaagagcttggagatcgagggcctcgttaacaccctcaaagaaacgaattctgaaaataagcggctccaagccgagctggagaaggggagcgaggcgaaggccgagatcgaatgactcaaggctgagctccaaaaggagaaggatcaatccgccaccttgactgagtactataatcttactgagccgaagatggaggctcttcgccagaaggccctcaaggcagaggcgagcgctgaaaaagaggcggaacggttcacgcaagggatggtgaaagccaccgagtccaccaaaaccgcatgccgtacgcttcgccttgccctcaatgatatgggggagagggtacaaggagtccctagagaagatgcctccatctttgacttctcggagtggactcagcaggccggcagggcggtctcggattgcgccaccgcgtacggcgattgctgtgcgcgtgtgtcggcggccttcaccatgggcttgctgcagcagttcgggtgcgaacacgtcgccgaattccctaactttgcgaagggggattgggaggtcagctgtcaagatgtttccctcgcgctttgtgcctggcgcaagcagttctggcaaaaggatggccgatccactaccaaggcgcgtctgcttgaacaattggcgaaggcagaggcggcaaaccagggcgaagaggcagcggccggagagggtggaggagatgcccaagatcacccagaggtgtgaggccctccgcccgctctttagattttgtagttttcttttggcatttgccgtggagggcgaacaatgtaaatttggccaatggccctccctctttcgtattgtagccgaataaaacggcctttctacaaatagatcataaatctctactacataaaaaattgaagatgtttcccttgtccgtttaattagaaaaaagtgcaaaaaaacatataaaaagaaaaaaaaaggaaagtccgattcgtgataaaaaacataaaaaaggaaaagaaggaaactccgattcaatgatcgctcccatgcgcagttgcgcccaatcccgagtccgattacatgaaaatgtaaaagtcaaagcctcttatttctatttctaaagccacaattaaaattttccgacaaaattccccaaattcgaagaaccctaatttcgggtaagaaccctaagactcaaaatctaaatcaattaagctaagggtttggattacttaccagacttgaagcccctatgctcaccggagcggcaccgccacaccttcaccttcttgcagtcgcgtcgggttcaccgtgcgtgcgcgcgcgtgcgcgttcctctctcccgccgctgacgaggtccgggccactcggcgctcgccgtttgcgcgcctgcctcgccggactaccatgacgtggcatggcttggcggcgcccttaggtgcccccctcccccagccggcgaagcagtatccgctcggcggtcgtcactgcacgcgcgcaccagctcgccgaaccgctgtcgccaccttcgctgtcgttctgcttgctcgtcgccggagagaaagggattgggagaacatttgggagctagggttttgcccctctctcctcatcggcgcttcatccggcgcgtggacaatcggagccgtccatcagatcgttacacaacatgaaagcttgtatagaagattcatgttttttatggtatatttaatttttagaaaaaatatttttatgtggtatataagagaggatttgcttaaacaagagataatagcataaaaataaatatcttatgtagtgtaggaaagatcatttgcattaaaaataacaataaaatagtatattatatagcatataacatataagttatatcttttttaaaaatagaaaagtaaaaaaacttgaaacttttatacaaattttccaggttgtgtaagagatcacataaaatttttcatatttttatgaaatttctaatgagataaaacaattattaatcttgtatgttcgtaatggtatttggggtgttttttaaaagaaagcccaacccaataacgtatcataaaaaactaataaagttgtcagctattatagaaaaagataatatcgatgacagattattaaactctgctatatgatatagaataaattctctcctccctttttctctctctcccggggctcctccttcccggatggcccaagccacgctaggcccgcgcctcgctcggcctcgtggcctactcgcctccccgcgcgtgggccgccacctcgcccagccagcccacgccgctcgcccacacggcctgctcccgctcatcgcttgggccgctttctccctgctgggccaccctgcggctccccgcgcctcggcctgggccgcttcgcccagccggcccgtttcacacgcgcgacgcctacgatagcccgccctgcagccctgctgccgattcgtagtctcgtagatgccgattgtcgagtccagccgtaaggaacaacctcgctggtgataatcaaatttagcatgtcattgtgatttaggtcgaaattatagaagtacggggttgatcagctatatttggctaatactactagttaattagcttaattagcattaaacgtataggaataaggaagaaatcggctgccaagatcaagctggcagtcatacttgattatccttaatcaagtataattaattagcggcaagattagtatttctttctatgcagggtttgcatgcatgaagatggcaagtttattcctttttttgataaattgatcctggtagaaaacttatttcgaaacttgtccctataaaaaactatatccaggaataggctgtcggctcaacgccactttggcgctgatgttgttcctatcagcgccaacgggatcggcgctgacatcgcgccaacgtggcgggcgagacgtgacgtggcagggcctcagcgccaatgcacttagcactgacaccttgtacacgctaaatagactgatgtgcagcaatgaattaatggtgtcgctagtggtgcaaccggtagtttctttcctggtgtacgttaggactagggtttgaatcccaggtcagccattttcctttttttaaaaatcatcaatctacgtgcgtgcatattaaatcatcaatctccattttcgtttttttgtcttcaaatcttcaatgtacttttttttgtttaaattaatttttattaaaaagaaatatcacatttagtacaaatttaaaaagtagaagaatggattaaaaaattttagagtcaacttttaaaagaaatatcacttttttataaaaaagaaataagaagaatggatttaaaaaaactaagtaaaaaaaagtttagtaaaaacataaaaggagagggttctaaccatggtcactgtaacgaccccattcaagtacctaccactgagctaagccaaacctcattgttacatttgcttttgcttttacttctatttactcagtataaaggccagcgccgctgtagaccatattctgatgtgatgttgcgatctttttttccaccatgtatatatctataactaatataaatattcatatttttccggtcgtcacatctaattttcgtccatacacacaatccgatttggttagcaatagcaatagccatagaaaaaattgtaaaaaaaaaaaaaaatcagcggccgccgacaccaccaccgccgccggactgagaagagtcagatccaaaaacaaaaacaaaattcatccactctttgccccaaaaaaatcaatctcaatcatcacaaaatcacaacataatcatgcaagaacaacatacatacatcatgcctgccgccggatccgccctcaaccattgccaccgccgccgacgccaccgccaccgccggagggagccgccactaccggatcaacccgcggtcgccgccaccgccggcggatccacccgcagacaccgccgacgctgccaccgcttccggatccgacgttggggccaccaccgccgccggagggagccgccactgccagatccgcccgcggatgccgccaccgtcggagggacgctaccaccgccgtcggatccgccgttgggaggaagggacagccgtcgaggccgacgggaagagggagacggggagggacggccgtcgccgtcggctccgccacaccccgttgtcgccgcgccgtgccggcgagacgggagggagagggggagaaggagcggcgccgccggaggggagaggggtggaaagcggcgccgctagaggggagaggggagaggggagagccagcgccaatagggaaagggagagggagaggcagcgttgggcgagggaggcggccggcagtgggagggaggatgggggacgggcggacagctgagccgatgggggtaggggagagttagggttagggttttgattcatttggaatcgatctgaaccgttcctcaaaacaaacggctcagatcgatcaagtgttgggctggcctcccacacttatgggccgatggaaggccagcgggtccaacaaacgtaattaaaggaggattttgaggaggtaaattagactttatttatcaaaattagcaattaagacctgtaaattccaagaaaatttcaaagggtgtaatcaatatggagaatttaataaaaattaaatccaattatatacctacctacttaaaaaatacccaaatatttcagaagagttgtatttcatttagttagaatttaatatgttttaattcaattttctcttttttctttccgttgcaacgcacgaccacttttgctataatttcaaagagtgtaattaatattgcagaaaaattatatttcattaaattacaattcattttcttcatataaatagttcaaatcaaatttcagtcaccatatcattatccggtgcaacgcacggacattttgctagtatatatatatatatatcaaaaacagagagcatcattaatcatttatatgtactaatgtacgcacgtagattgaacatttgaagaaaaaaaaaagaacgaaaaatgctgccgtgatggggattcgaaccctggtgctagggtacacaagcaaatgatcataccattgcaccacaattgcatttcttattcttttaattaccctgtacagggggttagcgcgatgtcagcgccagttccattggcgctgataggaataacctcagcgccaacctctttggcgctgagccaacggtctatttctggctatagtttttggtagagactagtttcaaaataagttttctacaaggatcaatttatcaaaaaaaaaaaaacgaagtttatttgatgtttgcacttgcacacaacgcagatgggagccctgctgcctagctagcggccggcaagattagaccaaggtgggtgatgagctacgtaaaccaagacgaactgggagtctgggagctgatcaaatgcatatttccatgggcatatgcgcgctggatgtgttgatgagctgaacttgacatattgccaggcgcatggacgcatggttgcttacactactacagaaagcgtttttgcatacgggcggaatcgatcttcacatgcggttggccggcccgcatgcgcgaaatggtctgcaaagatcaccatttgcgcatgcggccgtcgcatgcggtcacttaagacggccgcatgtgaaaatagatcttcgcatgcggtccatataagaagccgcatgcgaagatatattttcctatgcggtcgacctaagaagaccgcatgcgaagatctattttcgcatgcgggcgtcttaagtagaccgcatgcgaaattcaatttccgaatagctaaaataatatttattctagcattttggtgattcgtaattaatattaaattattgagggatttattatcgtatttcggagtagtaagcatataagataagacaagtgccgcagtaacaaacatgtaatacataaccattaattcaatcgtaatttacatacaaatatataatacaagtggcacagttttttcatcatatgtataattagtgtacatgttattacatatgttctttctcccactctctgagaggtttaaatttgtcgtccattgcgagttcactctggttgtcgtagaagagacctcttgcgttgcagacatcgcgacggatgaatcggcagaggtcagcggccacgttcaagatagtagtgtggttgaatcgttgtgcaatatatgggatttcggggatctgcacacataaaggaaaataaaacggtactcagtgagaagtgtgtgcgagatgggtttctttgtagagaagagttcgatgacctactcggttactggttgttttgtacctcccatttactctgagcatctcgcacacgtaataaccacacaagttggttcctggtggttgtttgtagcactgcgatataattatggggaccgatctcagtagatatatttagtatatatgtactgttcgataattagttgtattggtataaatttgatagtaccggccagccagtcctgacggataacttcttctgggatggaatatgtactggtccacctcttttgtggtagtacttgtgtgctatgtttgaaggaaacaattgttttattagtagttagaagactggtgatcgacctaaacaatttatagtaatgaaatgtttatcacttacaaattcaaaatagtgaggaattccataaatgtctccttgtcatagtgtgcggggtctaatgatatgatcaattggtctttcggatatacaaggaataatatgcagtggtctctacatataagataggcttattggagacagaaaattccgaagaagataaattaattaaacaaaaagaagagagagcttacgtgaattggtaggggaccattaagacatctttgtcggcgtgcgccaacattgcttttgccaagtatgttgctacttatagcttcttcctcttgtgcaatgtcttcacatattcttccttttcttccggggtcttgccaaccaattgctcgcagtcctgtctcagctctacggtgtgttgtgttttgcatattcttgttggatcgacgtatccaacctttgctccagttctatcagtttcgtggaattgcatactgtacaatgaataaagaagaaatgagatttgttttatttgtttcgaatgaaacgtgcaacatgtaataaagagttcagacttacagacagaaagccgcaacgagattaacgtccattttatctagcttgtagagggcgtaaaggtcttggaaagagataaaaaatatcccattaggaccactcatgaaagcgcctttcctagatgccttcatataccattcgtgcattaccctcatttcccatggtagcttgttcataagataagttggcaagaatggcttgccatactcataagtttcaggcacatcggcagataaccaggattgcacttcatcttgggccgccagtactgacttctgggagtctgacaagacgtgagcaagttcttttctcttctcagaattcctgaaagctgaaaacatgaacttctccttatccttgtcaatctcctttgggtcgtatgtcgatatcaactttggaattatacgacgaggttccaaagtattagacttcggttcggatgtagtaccatctggtatgtgcacttgttctaccagagcagattggggtgtaggtggagaggtttgaactgagggcggagccgggggagcatgctttttagctggggaggtgggagaggcttgaactggttgcggggccgggagaggcggttgttgagaaggggagggtggtggtgtaggttggcgaggcggtgacctaagcggtggtggtgacggcggatgtcgaggtgacggtggttcaggaggcgacggtggtgcaggagcggcagctgaggatggggttgaagatcctgctgcaagaacggccgcgctcaggattatgtctctgcggtgccacaagataaactgattcactgcatcaccgagaagttcaatcccctcaggtgcaggtatgtctagttccaaggaaacgtggtcgctatggaccttggcgacctgtacccttgcgtaatcctcagggattgccgtgttgtggaattgacgtccgggtatcgctaaacccgttgcaacctccttagtctttccagcgcggccgattggtacgacgagactgcacggagttggtccagttatactatccacagggaaggtacttgtctgcactgagcctacactgctgggtacattagttgtttgctgtgcggattgtgtgggttgctggctatcagggaataaccttggaaatgctgtcgggttttcagctgccaacgagtagaagtgttccttcacttgcgcatagatcttgtccgatagttgttctttgtatttgtctctcttcttataacttggtgcgtcttgtggaaacccgaccttccaacttgtctttgaggacaaaccccttacacgtccagagtgttcagccgtccccaacgccgcagtaagctgatctcgctccctccgtgggacgaactgtcctgatctttctttctcgactatctgctgcaaattagtagtcacttcttctatgtctggagtctcgaatagtgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcggatgcataattaatgcaagggaggtacaagggaataataatatagggattaagttttgcagtaaacagcatttaaaagacacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaggacacatcttcctcacgtgcaaacacgtgccacataccaccacggtatacggacggaagacgtgacatagttcccaacccatcctagccataaacaagagtaccgacccaatcccacctacggccgggatacccgggacaggcaggcagaactgagcccctagcagcagggcaccaaccctctgccatatgacatctcgactaccgggccgcagctcgtgtagccttcatttgtcctggagaatgtccatcgacacccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccataaatagagtgtccactagttagggttttatttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacaccggcttcaacttccacgaagagcggatcttccgaagctgcagcgtctacacgaccaacggaaaagaaaaaggcttttactctaataaactccaaataacaagcaggaacaaagcacaaaaatgggttctttacatcttaaggaaaaattagagacttgaacggtccaattccgagttcaaatggccaagatatggccatttgaagtttatatgctctttaaatggatatttgcgaatttcttcatttaaattttaatttaaaatcgaattattgcgtcagccgaggggagagggcgcgcggaccgggtccacgggagtggggcccacgcgtcagcctctcggtccacggtggaccgggagcacgcggctggcggcggtcggcgccgtgggtcccgcgcgtcagccgcacccgcgggcgcgggcggctgacggccgggcccacctggcagccgcgagggcgcgccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacggcgacgacgggaacggcggccgaagcggaagaagacggcggcgcggctcgggatgacgagggcgacggtgctccggcgatgttcgggcgaggaggaggcgcggacggagtcggcggcaacacggcgaagcggacggaggtgtcgccgagtaaggaggaagtccggagcggcggcggcggcggaacggagctcggcggcgacggcggagagagaggagcacggcgcgagcacgaatccgacggcgagagcgagcggcgagcggcggaaacggaagagcgaagcacggggatcgaataaatagcaacgggagggggagagcgcggccggggagagaggaatcgcgcgcggagatctcggccgccattgaagacgccggcgacgattgcgggatgaatccggacgaatccgagggagagagagagggaaaagagggggaatcgggagagggaaacgcggggagtaattcgcccctctttatggcgcgcggggaaggcgggatgcggcggattcggcggcggcggcggcgctagggcacgggcggcggcgggtgcggcgcgaggagggagatgacaggtgggacccacccgtcagcgagggcggcgggcgggcccgcctgtcagcggcgcgcgcgcgcgggggaggccgatgggccgcgggggaagagagagagagagggagggaacgggccgagccggcccaagaggggagggggggggggaaaaggagacttcttttagggtttttctttttataaacctttttaactttgttcatttcttttcaattattatttgtgctctgaaaattccactaaaatttgagggctccttttagaccaaggagaatttaacaaaaattctccgggccacatttgaatttttcttgcacgtattttagtgtttgccaatttcttttcgaattttaattaattctattattccttttagcgaatgatttttatttcgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccagggtgcaccttttggctgactcagactaggttgcggtagttcaatgatgcttccgttccagaacttctcatgattcatatcttcggagtcaacctcggacaagttatcaacttcatgtcatgcgtcgatatcagcttgtcattactagggtaccatgcttgttatcatgagaatatcatgcttgtcatttacttctaacttaccactattcacttcatgttgtcctcagttagcattcaacgtattcctgtgcaccttcagccttgatgtgttctttcccattggatcatctcccaagacatggcgtcgcctggtaaccggggcttgcacttttcactccgtgtagcatctgataccgagttgaagatttcactccttgccttcatagaaacacttttacctaggtcatcttgcttacttaatgacaaggtgactgttgtgggggaggcaattactatcaggggtcttccttgagcgatgcagagcatgtttctgtttatcaatcacctttcggcctacttctttcatgcttgagaacatctttgccaatctcttttatcaatcatctttcggcttatctctaacaggtggtattctttaatgtggattgcggacgcttctggggacgatgaggtcctttggcttgctgcctttcagtgaaaccttgaagtgtttcaccaaaagctatactgactgtctttgcctttgatccgaaaaagacacatctgaaactcttagtccaaataaatgtctctttggttaatcgcttgattttcttttccatcatcaggttggttattaactcgaggttagaatatagttcctctggcacgagaccctaggtctcctttgtcagtaaacaattatacacaggatcacatatccgcatcttccaaaagaatcctcttagaacttgtttttattacaaatctctcccatagtacatgaatacaaggcactgtcttaagcaaaaagggaaggtgcttaacatcggtacattgtttccactatgggttagaattaacatgaggcctcacaggtacggcgtttgctccagtgaccacaaggcgagtgacttgtcttcttcttgcataatggccggagtgatgacgcaggttacgcttcggctgtggacaatctctggagaaatgacctggttctttgcagttgtaacaaatcaatgccctttttactgagttgtccgtctgagaacgatcattctgacccggtgttggaattggtggttggaaatccttgctaacattggcatcagtggtaccatagttgctatcaccattggagtctttctcagagtcaaaattgctaaggttgtcattctgggttccaacattgatactatcgttgacatcttggtgaatgctactgacattgcacgctttattcgagtggccactaatggggcaagatccatggttgttggtggtatcatcatcattagtattgctagtgttgttgtctgcattgcgtccatcttcttggggcggaaactcttgatgcgcaacagaagatccggtgatctgaagtggctcagtgcgctgtctttggttaccacctggaaatactggcatgttgacaatccttctcttgcagttcgtcatccgattatgctcactttcgagttgcatggctttgtccacaagtttctcgaaatcttcataatcctctagaagtagttgcactgcaagctcatcttttaacccctgaagaaacttctcttgtttgtcttcatccgtttccacatcttctggtgcatagtgagccaaacgatagaactcgtgtaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataatttgcactgttgctggactgtaggcacttgaacgttggttgcccctgctgggttgttccaattctgtaatagttgaaaggttgttgccaacatgttggtttggttaaccacaacttggattagctctggtgaggtttcgttgatgcttttctcattcccattggcttgggttcttgagtcatcggatccatcattcccgtagcctttgttaccagtgttatccatctgtcacaaggtagaggttgagaggggaagcatacaaggaaagaatagaccagaactagggacaagaccttaaaggaactaactctttttgttgatgtgttgtttgttttgcttattctgcaagttgattaagcaaacaacctagcatggttacatcacaacccactgatgcaaaccacgcgctacacacacaagcaaggaacacacgactaacaacactaccctatagggtggcttaggttcagcgacaggttctccaagatcttcactcctgcttcacagctggcttcactgcttcctccacttcgctagcggatcctgcagtctttcggagcttcggcaaacaactgacgacatcttcttcttcacaaagctaaccaactagtactagttgaaatctgaagaaggaagaagagggtaaaccttttgcaaatagcattaggggaaggagaaaaagaggaactttcacaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcggatgcataattaatgcaagggaggtacaagggaataataatatagggattaagttttgcagtaaacagcatttaaaagacacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaggacacatcttcctcacgtgcaaacacgtgccacataccaccacggtatacggacggaagacgtgacatagttcccaacccatcctagccataaacaagagtaccgacccaatcccacctacggccgggatacccgggacaggcaggcagaactgagcccctagcagcagggcaccaaccctctgccatatgacatctcgactaccgggccgcagctcgtgtagccttcatttgtcctggagaatgtccatcgacacccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccataaatagagtgtccactagttagggttttatttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacaccggcttcaacttccacgaagagcggatcttccgaagctgcagcgtctacacgaccaacggaaaagaaaaaggcttttactctaataaactccaaataacaagcaggaacaaagcacaaaaatgggttctttacatcttaaggaaaaattagagacttgaacggtccaattccgagttcaaatggccaagatatggccatttgaagtttatatgctctttaaatggatatttgcgaatttcttcatttaaattttaatttaaaatcgaattattgcgtcagccgaggggagagggcgcgcggaccgggtccacgggagtggggcccacgcgtcagcctctcggtccacggtggaccgggagcacgcggctggcggcggtcggcgccgtgggtcccgcgcgtcagccgcacccgcgggcgcgggcggctgacggccgggcccacctggcagccgcgagggcgcgccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacggcgacgacgggaacggcggccgaagcggaagaagacggcggcgcggctcgggatgacgagggcgacggtgctccggcgatgttcgggcgaggaggaggcgcggacggagtcggcggcaacacggcgaagcggacggaggtgtcgccgagtaaggaggaagtccggagcggcggcggcggcggaacggagctcggcggcgacggcggagagagaggagcacggcgcgagcacgaatccgacggcgagagcgagcggcgagcggcggaaacggaagagcgaagcacggggatcgaataaatagcaacgggagggggagagcgcggccggggagagaggaatcgcgcgcggagatctcggccgccattgaagacgccggcgacgattgcgggatgaatccggacgaatccgagggagagagagagggaaaagagggggaatcgggagagggaaacgcggggagtaattcgcccctctttatggcgcgcggggaaggcgggatgcggcggattcggcggcggcggcggcgctagggcacgggcggcggcgggtgcggcgcgaggagggagatgacaggtgggacccacccgtcagcgagggcggcgggcgggcccgcctgtcagcggcgcgcgcgcgcgggggaggccgatgggccgcgggggaagagagagagagagggagggaacgggccgagccggcccaagaggggaggggggggggaaaaggagacttcttttagggtttttctttttataaacctttttaactttgttcatttcttttcaattattatttgtgctctgaaaattccactaaaatttgagggctccttttagaccaaggagaatttaacaaaaattctccgggccacatttgaatttttcttgcacgtattttagtgtttgccaatttcttttcgaattttaattaattctattattccttttagcgaatgatttttatttcgggatgaatttatcaggacgtgacaaatagtatgtctccctcatccgagacttgacctgtgctgcgcgcccaaacccagttcttgctacgttcaaccatggggtctaccagcaggggcttaccggccgcggcaaatctttgctcgatctcccgccattgatcgacgtgaccagcgtatccgctcgaccccaatctatggggatatctgttcttcttcgcgagctcggacatttttttcctcaaagccattgcttcagttgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctgacctctgatccaggagggaacacaaaatacttctgcaactcattccagagaagtgtcttgatgttgtcgtccactgtttcccacaacttgacattaatgggacaacgcgtcctgactagagtgccacaggcgttgctgaacttggaccgcactatcggtggctcgacgggctttccatcctgatcgagagcaatcacgttgtaagtttccttgggtaatttatttttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaggttcatgtcacatcatagttagggaataatacatggctaacgattttcagcacttacggcctgttcgataggtatgtagtccggatcatcatcgcggggggcgacttgtgttatttccattggaaacgggtcacttggtgtgcgccacgtttcttcactagaagcgtctggctgcttattgctaccggaattttgaggagcgttaccttcttgaggcgctattggtgcgttcgatggaaccttttcgttcgacatcttccaacttgacgtaaaaaaatttgacataagtcccaattttacgtaagtcccaatttaacgcaatttcacataagtctcaatttgacataagtcccaatttaacataagtcccaattatacataaatctcaatttaacataagtcccaattatacataaatctcaatttaacataagtcccaattatacataaatctcaaattaacataggtcacaatttaacttattttcacataagtcccaataacttaatttcacataagtcccaatttaacataggtcccaatttagcatcagtgacaattaaacagaaatctccatttgacataggtgccaatttaacaaaagtcccaattatacatagatctcagtttaacaaaaatcacaattatacataaatcccaatataacataaatctcaacttaaacataagtcacaatttaacataggtgccaatttaacaaaagtcccaattatacataaatctcaatttaacaaaagtcccaattatacataaatcccaatttaacataagtcccaatttaaacataagtcccaatttaaacataaatctccatttaacaatccacaattaaacctttctcaaaattaaacaatccacaattgcacatatcacaatccacgatgcacaattaaacaatccacaatccacaattgcacatttcacatttctttttttaaaagtaaatgttatcgagcgacggcggggacgacctggcggcgacgatggcaacggcgaggggggagaggtccgtgcggcggcgacggcgacctggcggtggcgacggcgacgacgaggggggagaggtcctggcagtggcgtcggcgacggcgaggggcggggcgacttcggggaggagccagctgtagcggggacgacttggcggcggggacgacctggcggcggcgatggcaacggcgaggcgggagagttccgtgcggtggcgacggcgacggcgaggggggagaggtcctggcggcggcgacggcaacggcgaggggggagaggtcctggtggcggcgacggcaacggcgaggggggagaggtcctgacggcggcggcggcgacggcgtggggcggggcgactttggggaggagccggcggtggcggggacgacggcgacgacgacttgggaaattttggcagcctggcggctagggtttcgcgggagccgggacttagaaaattttggctccccgcgctccctatatataggcgcagatcatcgtatgcgggcggcttaagggaccgcatggaaaaatatctttccatgcggtcgacataagccggccgcatgcgaaaaagatctttccatgcgggctgttaagccggccgcatgcgaaaaagatctttccatgcgggctgttaagccggccgcatgcgaaaaagatctttccatgcgggctattaagccggcatgcgagccagccgcatagaaagatctttttaccaaaaaaactcatatttttttttctctaagtaaactgtccatatatatttttttcccaatatttcgccacaattatacattccaaatgtttttggcactaagaaaactcatgaaaattgctcaaaactcgtaatcaaatgttacatgctaatgattacaacataagggggacctaaattcatgcacgtacatttggaatacaatgagaactaaaggttacaaaataactatgacttaataaccttggcaacaccatctgctcgaacgtacgacatatttgcttcatcgattgttctctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacttgagccatacgctctgctaaaacccatggatcatccttgtggcctgttttactgtgatcgactatcgttagcccgtagtcatcaacggaaacccctattgtgtctttaacccattcacaacggagcacagggatctggatgtttaggccatagtccagttcccatatttcttgaatggtcccataatacgacctcttttctccactcgtgtcaatcgcttcgacacggatcccactattttgtgcggtgcttttcatgtccttcgtagtcgtactcaaggtaaatccattgatgtcgtaaccttgccatgaattgacaatacttgaaggcccacatgccagtctttgtaaagtaagttcctccacagaatcaccaactggcaggtttagatctttcaaccacagaggaaagcgacgcttgtgctctcttgatatccaatcattggaccgccctgggaagcaggctttgatttcttctaggtgtcgctcaatgaatggctcaacgatagcgagctgttgaagaacgctgttgtgtgccgcggacacctttttgtaatcattatcgaagaactgcttcctaccaacagtaccccttccagacaatctaccttcatgtcgatgaacaggaatgccaatggcattagcatcctttatgtagtccatacaacactcgactgcctcttcagttgtgtatccctctatcattgatccttccgggtgagcgcgattgcgtacatagcctttgaggatcgacatgtaacgcttataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctgaagcggacctaattccaaaggatcaaataccttctgcgaaattcgattgaaaaagtagcacaactttgttataaccacctttgtatggactggtttgactgcccttatagcaattggtaggaacaccgttagcaacctatgacagtcatgcgtattgtatcccgaaatggacaaatccttcattgatactagcttcctgatgttcgatgcgaaaccagtaggcactctaaccccttgtaaacatttacagaaggcttttttctcttcaagtgtcaacaagtaacaagcaggaggaatctcggtcttcccatttggcagcactactgggtgaaggtcatgccgtatggacaaatctacaaggtcgttacgtgacttcaatccattcttcgttttactcgggatgtccagcaatgtgccaacggtgctatcaaacacgttcttctcgaggtgcataacatcaattgcatgtcgaatctctaggtccttccagtaatctaagtatttaaagaaaattgaatgcttcttgaaaggcgacgcagtaccgttgtcaccatcagctttcttcctctttactgtcttcttctttccctttccatatacaaccttaatcttctttgttatctcatacacgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtatgaagttttctccagacatattagacatccagtcttccctttaatctgcccagataatgaaaagtttgcaggtaggtcattgatggtaacaaatatgatcgcacgtagattgaagtctcccgcttaaactcatcccatagtcgtaacccctctttccaaagctcctccatgtcctccatcaaaggctcaaggaaaacatctatgtcgattccaggttggtttggaccttgtatgaggatagtgagtagaatgtactttcgtttctgacatatccatgttggaagattatacattgtgagaaggactggccatgtgctgtgcgagctgcttaagtcaccaaacgggttcattccatcagtgctcaatgcaaaccttacattcctaggatccttagcaaattctaggtgttttgcatcaaatgtcttccactggcgagcgtcggcgggatgtcgaatcataccatctatttttcggctctcttgatgccatctcatcaactcagcatcagtcgggtttgagtacagatgcttcaggcggtccttaattggtaggtaccacatcaccattgaaggaatcttcccgcgcttacccttatcagaatctggatcggtacactctgaatctacgggcccattccccgttttataccgacttgtgccacacgttgggcaacattccaattccgcatattctttacggtataatatgcagtgattcttacaagcatgaatcttttctacaccaagagataaaggacatatgagtttcttcgcttgatacgtgttcgatgatacaaagttaggcttaggaagcaacacacggaacaaactcatcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcctgccaattctccaatcctcgtgacctacccgctagcacctctggttcaacatggcgtagcatatcctctaaatcaaaaccaccatcgaaatcatcactatcggtggaaacatcgacaaccattctttcacgcgaaatgtcttcgattataaaattctctgcctcattcatctcgaaacttaactcttcatcgtcatcttccggattggcgaattccccgtgataggtccaaaccttgtagttggcggtgaatccgtactccattatgtgacccaatatttcaccaggatctaccaacaatttctgattcttgcaatgacggcacggacaaaagatctttgtcatattctccctcaaagcatgctccttagcctgatcaataaatttagatgcttccttaataaatatcggctgcgttctccgcatctcatacatccatgacgaccgatccatctaattatataaaggcaaaaaatttacagataaaaaaatagaccgcaggtatttcatacaaaagtttaaatgcatttgtctcccaaaaaaatacaacaatacatgtaactagtatgtacaattgtttacatgcaaaatttgcccatcaaaacatatattttgaagctagattttgcaaaaaatagttagaacaaaccttgtcaaaatattaaaaaaactccactttccaccaacgaaatataacaaaaatggagccaaatgaagcaggatagagagttcttcacctttcgtatagagttcaagtaaaaatttcgagttgaaaacctccccccctaattggtgcttgctttacgagagagaaagcttcgttttcaaatggtcaagctcgggcctggaggagcatatatggccgatcatcgcatgcggctaatcaacccgcccccgggggggcggtttttgcaggcgccgccacaagcggcccgcatggaacctaccgaccccctcgtacagaaaaacgatttttgtagtagtgttaattgcgggctggcgcaagaggacaaatttaggctgtgtgatatgcgaacgtcgtcgaagcagattttttttttttgacaatggaatagaatatcccggcctttgctcaaaacgagctacaaacaattattacaaagttacacttaaaaaagagtgtagtccaacaaaacattgagaacacgcacttaaaataaaaaataacccatctaagataaggagaacacgttattgaagtctacttgtgaatctccaaccataattggcaaaaagttgcataactgtcgtctcaagcctacggcatgcaaccttcataaactcgccatcttcatcacacctttgtagctgagcccaacaccggagccaatatgttgccctgaaaattacctgcatatatgtaatagatggtgatttgtcaaaaaccaaatcattcctgcttaaccacagagcccaacatattgcagaggctcccacaagtataagcttactccttttcttgtccacccccaaaagccaaccataaaaaatatgtgatatactactaggagggcatagaccaaaagaatattgtattgctctccatataaagtttgtataatggcaattcatgaaaagatattgaatattctcatttttcattaaaaaacaacatcttaaactacctttccaatttcgtcttgctaaattgtctttggttaacacaacccctttaagtaagtaccacatgaagatcttaatcttaagcggcattttaagtttccaaatcattttatttctctcaatatagccattattaattaaagcaagatacattgacctaaccgagaaccttccattctgattaaagttccatctaaaacaatcagaagaatgattcaactggatatgtacaatagaggcacacaactcatacaaaaaaataagattctgaccaactaaagctctcctaaaagaaacattaagtggaacagatctcataacactagcaattgaagaacctttccttcggacaatggcatataaagagggatacttatctttaaaggctaagttatctaaccatttatcttcccaaaatctagttgttccccactattcacaatccaggaacccatgtttaagaaagtatcctaaactttcatgagacctgactaaaactgaccaaaaatgagagtcaccttgcttcttatcaacttcagtaatagacttattatgaagatatttcctcctcaataagtcttgccaaaccccttgttcattaattaacttaaacaaccatttgctcaaaaggcatttattttgtatttccaaattatgaacccctaaaccaccctgatctttgggctggcaaatgatatcccatctagtaagtttgtactttttcttatgatcatctccttgaaaaaaaacgagatctataataatcaattttttgaagtacccctttcggtatctcaaaaaaggaaatcataaacatagctaaacttgaaagtacagaattaatcaacaccaatctaccacccacagacatatacttacctttccaactactaagttttttttcaattctttgttcaataaccttccagtctttgttacccagctttctaaaatgcattggaataccaagatattcgacaggaagagagcctaacttacaaccaaagatattagaatattgatcgtaatgatccttcgtttgaccgaagcaaaataattcacttttgtgaaaattaattttaagaccagagagcttttcaaatacggataaaatcaattttagattctttgcttgctgtaaatcatgctctagaaaaatgatagtatcatctgcatactgcaatatagataaaccatcatctaccaaataagaaattacaccatttatagaaccaacatctttagccctcttaataagtaaagcaagcgtatcagccactatattaaaaagaattggagataaaggatccccttgcctaagacctttatgggtttgaaaattattactaatttgatcattaactttaataccaacatgacccccttgaataaaggaagctatccactgacaccatttaggggagaaacctttcattcttagcgtcttttgaacaaatgaccatttgaatttgtcataagctttttcaaaatcaatcttaaagattacaccgcttttattcttgcgatgtaattcatgtatagtctcatgcaaaataaccacaccttacataatgttcctccccggtataaaagcagtttgagtaggactaatgaccttctaggcaacactcataattctattcgtagcaactttggtaaaaatcttgaaactaacattaagtagacatataggcctatatagctgaattttcatggcctcaacacacttgggtagtagaataattgtaccaaagttaaaagagaatagaggtaaagtaccgttatgaaaatcattaaagagatccattaaatcatgtttaataacattccaaaaaacttgatagaactcagcaggaaatccatcaggacccggtgctttattatgttccatttggaaaatagcctccttaatctctttctcattaaattgttgcgttaaagcttcgttttcaaaatgagaaacttgaggaggttttttttatcagatcgtcttttaatagactgagatattgcaaacgtatcatgtagaatatgtacgtcaaaagaccagggcatagcgtatatgtatctataggtatactagcaaaatacccgtgcttcgctacagtgtattaaaactaaaaatatttatttttagccaaagttattttcacactgtttggtacttttgcttgataggaaaagtctcaaatgataggtgacgccgctttttttttcttttttttgggattatcgttcggtttttatgttgtgatttgtactccgttcacgattaggattttgtatcatctttgatttttttcaagaaaaagtgcccgcgcgttgcaacgggaagaaaagatgagaaaattgaggaggagttaagaaagatttacttaattaactaaaatacaaatttctggaatacttgtattttttaagtattttttaagtaggtaggtgtttaaattaattgaaaagtaaagttagtgtaggaaataaaattgatatggctagatttaattttaattaaattctctatagttaattacactttctggaattttcttggaattttcagagcttaattgctatttttaataatacaaatatcatttcagcatttatttaaatagtaatctaaataaaatcctcattacacctgggccattttcagcccatggccaccctcagtccacagccgagccggcccgctttcattccttattctcccctcctcctcggcccgcggacacgcgtccgacccagcaagcaacgaaaaactaattaccctccctatctcactgtcgtgtgggcccatcactacagtgtcatcccctacctccgtcaagttcctcatcttcccgacgcctcccgatgtcaccgccttcataaaactcggccgcatcctttaagataatatgaaattagttgaggggtttcaatccttatattctcctctttccgttttcccaaaaatcaaatcaaatctgcttcatatctagctgagaataaagccctatccaaaccctatttttcctactgtattacgatgcaacccatgttatttttccgcgctaactattggagacgggcaacgcacacacgcgcgagagggggaagagggaatcgcacgattgatggacgaaaataagtgtgacgaacggaaatttatgaatctttatattagttaagatatggtcgattgggaaggcacccaacatccaacaattgaattatctgctgtttactttgttctatttataccttctatttctttgcttttttgctcagaaagtaatctttcgtcgtcatgtaagtacgatagttatcttcttttatctaaaaatattctttacaaatgtaaattagtttttgattccatgaaagtgaattgattgctttcattaaccggttttgatcttaattttaacgactctattaattataccgtaagccgttaggtaatcttttgttgaaaaaaaaagcgtcaatacttctcaactcgagagaccagcactccatcttcactaatcataaattcacaattcctaatctctgttgttcgtgtagtagcagcaagaagcaatttccgatataattgtaaatgatgttttagagaatattaagtatggttgtcgaagtgacaactgcgtacgtcgaaggacgtggatactcaatagtcactggaaacggtgaagtgtattatctttcttttattttttctggatccccgttacatggccctaggagcctatttataaccctattactagttcccctattggggtttaggtttaacaggggaatttacatggttgcccttatgaaagggacatttacatgggtatatagtgtaattaaggtatatgggcccctaatgggccgactggcgaacgctggcccagtggcctccgggcttgatcggctgagatggcctcttgggcctccttgaagttggacttgctacggcaaagtcatccgccttcgccatacactcttcgccatatagtcttcgcccaacatgccttcaaccttgtgggataccggtgcgattcttcacccttcgccatctttgcttcatagtcttcgccatgggggcttcacctcaacagactcgacgtcttgggcttgaacccacccctggttgcatggtttcggcaggtccggtcgaagggtctcatgacataccgccaacaagcccctcacgggcaagagtgagataggagcttcggctgagaccgtgcaaaccatgtggtatggtatggggcgccccctttggaccgacgctcctgccgaaacctattctggagtcctgcagagaaagtgtgcattatgtgtacgtgtacttttatggttagtaacgttttctaggtttcgcgtcttgcgaacggcgaaaccgtttttaattttctctaggccaaaatgaacagtgatgggctttccctcttacgattgggtggggagacgaaccgtcgcctgggtgggctatatattcccccttcccctttttcaccgccgcactctcgtcattttcaccgcgagcgctctctctttctccattctttcctttcacgacgccctttgatttcctagatctttcgcttgttctcccttttcgccaccgcgcacacctttcaccatggctcctcgcaagccgaacccagcttccgcgacaagccctaatccaggccgaatcgacgacgacaccaccgcctttctaggggcttcgcttgtggacgacgacgagctggcaaagcttgtcagcgccagcctgctggtggaggggaaggccttcgctccgggaaaggccgtggtgccgaaacacggcgacaaccggacgatggtatttgccgtgttttttgaggtggggcttcagtttccatgcaacgttttgttgccggagatccttcgtcttttccaggtggagcttccccagctgagcccatcggcacttgtccgagtcaccatcttcgactgggcgtgccggaccgccaggttcgaaccgagcgccgagcttttcggcgccgtgttctatggcaccgtgaactcgaagacagtggtcaccccagccgggacaaagaaaacggcgttcgggagcgtgaactttaatgttcgccccgagcgctccgatctatggccggtgaacgccgccatgtcgaagtgggatcgccattagatggcgaagtggttctaccactccatccccttcgaggccggttccgacgcggcgaaggccctccgttggcggcgcagggcaatttcgccgaacaggaagcccaaggtcgccatcgatggcaccatggaggctcggttcaccctgcttcgcaaggtctgctctcggcttagctgccgcgatctggtggaggaattttgcatgcttcggattttccccctctcccaatcgtggcatgttgtggtgaatgaagacgaggaagttcacggcttgtcaaagctcgtcatgcccgagggggcgaacagtgagcctctgcatttcccttacgtacttgtgactcgctctttttgttcaacgcttgatgtggcgatttttcgactttctgcagtgttgacccttgctcaggttgacactgaagcccggaagatgatcggcgacgtgtcgattactgagttcagccagctgcttacgcggctggcggccggtcgggcgaaccgggtatatgtcggtgaactgcctccccggacgaagtccttcaaggccgatggcgatgaggggccatctaggaagtggctgcggggcaggtgaagttggccccccggaagtgcagggcccctgcctccaccgactctgatgctgatgacaaagacactgtcatagatcacgacgacaaagaggaaggggaggatgtgggggaaacggaggttgtggccgaaaaggccacggacgaggccgccggcaaccgcgccaagacgcccagctacactccgactccgagccccgagcacgttgggaccggggtggagtcgaacttctccctcctccgccaaatggatatggagggggtgaaggcgctggttgcgatcgccgcaaccaaggtgacgaaggggggttcgatcaagaaggcccccaaaaagaaagggctcgttgatgtcgctcgcatttttagcgacgacgagtcttcggacgagacccctacttcgcccactggtcggagcttgggtctttcgaccgctctcagcgccatggttgatgcaggtggagctcggggggagtgtggccgctgggctttggcctttgctgaccggattgtcagggtcgttgctagggtctttggcagtcctgtgcggaggactgtggttttcgccgcttgtcattgagaaggggaagaagacggtcgtcgagacgtctgcttcagagtattctttggtggccccccactgcgcccctgctgacttcgagactggcgcggaccttatccccttcgtcgagggggtaagtaatctcgtgtctctggctggcagcccgagcctattcaccgagctgaacgagttcgacgaaggctattctgccatcaagcgtttggcggttcgggtatgttgttctcctttttgtttactttcagttgtccgtcttcgacggcttatgttaacgcttgtcctcttcgccctctctttttcttttgatctagattctcgcggcccattgttcaaccgaacggactatgcgggcttgccttgacgggttcaagaaccgtcttcgagccaaggacgacgaactgggccgcaagagcttggagatggagggcctcgccaataccctcaaggaggcgaaggctgagaataagcggctccaagctgaattggagaaggggagcgaggcgaaggctgagatagagcgcctcaaggctgagctcaaaaaggagcaagcacattctaccgctctaaccgattactacaatctcatcgagccgaagatttaggctcttcgcctagaggtcagcaaagcggaggcgaacaccgaacccaaaggaggcggcggtgaagcttggtgatgatggaagtgttgggatacgcgtaggctacgatagcataaatcaaaattttctatcgcgtaaaccaggaaccatgcaagtattagatcatagatcgttaccactcgacgcgctgcacagcggaagaagacgctgagaagtcgaaggaactctcgcgaagtagcgcgcgtcgatgtagaggaagtagtcgatcgcaccggctcgaccttctcctcctcgtgctttctcctcgccgtattcccacgccgatcagcaccgcaaaccagcggcgtctctaccggtatccacacgtacagggacggaacgccacgcgcagatgtgcttgcacccgcgcgtggctagggttttgctcggggagggaagtgatggctagggtttctcacgtattgcaatacctccgccggtcacacccctcacgaatatataggatccatcactcgggcctccaaggcccataggactcctattcggatccctatccgaattaagcttatattggatccctatcaaatccccttattccggcccattaagcatgcgaccctgtatgttcatatatactcggctgtaatctgaaaactccttttcggtccacgcgtcaacagcggcccctagcagaacgtattgacccaccgggcatacataaagatcatatcggttgaacctctagtgtatacttgtataaacccctttgcctcacgatatcgattaagctcaaggctagatatgtggcatcctctaatagctaatcattcactcgaacctgttgatagattatataacttgtgattgacccctcaatcacctttggcatggctatgcacttccataatctacaacatcgaggggcctagagatatctctccataggaggggcaaatcccatcttgattatacatatcccactacatatttcatagcatacccgaaaactacttttatagctacccatttacggagtagcatttagcagttcttaagtaagctactacacatgttgagaaccatgataatctcaggtctaaggattcaacaccaacactaaatgagatcactgatgacacaacacatatggctcttgcagtgtctcatgttgggtctatccaataacatgttcaccaacatgtgtccacattattaatttggtatctctataccatgatccatgagacatgatcatcaattaaaacatgtgctgatcatataaacatatttgttccacatatgatatttgattagggatcctttagaaatagtaacaaacaacataaagagtctcatgaaagaatcacatattcattaaccaataaggagttatctatttcaaggaacaatgtcggataaatatgtaaacaaagtatgtgatacaatcatctctatgattgcctctagggcatatcactaacaggaaggagcagcagggcctcgctggagatcaaaacgcggcggcgagctcggtcttcatggcgacgaagtgcttcccggggtcttcggctttggggagatggctgctgagcttgctattgaccttgcggagccgagagaggtggcggcgctgactggcgacggccgaagcgacggcgcacggcggctggagcggcggccgaaggtagagagagaaggggctcccggggagagcaattccggcgacggcggaagacaggacttgagggagaggtagaggacaacgagggggtcctttatataggcacgggagctcgggtccaggcccaaatcgacggaaaaactacgggaaattctagggatcttcgccggaaaaaggaaagattgatccgcgaaattggaaaggatttccgtagaaacttttggggatttcttggggaaaaggaagaggagattaagaggattccattcccagaactaatttggaaataggagcaacggggaggtcggatttggaaggaggaggcggcggcagtgcatgcgcacggcggacagtcggctcttcctgagctggaagatgaacagtggcgcaggaaggcaaaccagacttttggctgggcttctattgcacagcccgatagaaggaggaatgcaaaccagactttgggaagggataaggccggccgaatagaaggaagaatgggcgaggactaaaggtgaactggtgtgattatggtgaataagagcaataccggcttcggccaacaggatgtagggctattacttgacaattcaggggcccgaaactatataaaaatccctgtctccatctcttttaccttagtctcgcgtatatcctagtaccaacgatcatcatactatgcaaataccggaatcgcgacataaaacgtcgacagtggcgcgccaggtagggcgatttttggtgcttcaaggtttcgatgagatgggtttacgagatggattctccaacaacaagctactcggcgacttcggctgtgggaaaatctaacctgatcggagcatatcttccgacgagattgggactaccgccgccgcggagaaccatgatgtcggaagcagcctaaccctcgacgcgtgcgacatcaactggtgcaaggcatcggccggccgagtccaagccgaacccgacaccgattcctaccaaccaagcaagtgtgtcgaggagccaaaaatcaactgccagagtagtgctaccatgttctgactaggacccgatttttagtcagttgacacgggcgtcaactcatcacggccggcgtcaagtccaaccaatttggataacgtccatatgtgcatgcatcagatcaattaacagcaagtgcatgtgtttactgcattcatgcggctgtacacctggagaagtaagattgcatcgatctaatctactccgaatacacatgtcagaaatgtaattagtaggttaattaatttaattgatctactaatttcgtagatatatccggcatatatctacacaggtacgcattattttatataaaattttccataccaatattcagatcatacaacattgtcggatttataatttattatgtttacctagagcatgttttttatacaatatctgttgcgcgggtgtccctgatgttaaatcgactacgatctaacgctggggactcgctctgtcttcttctgtataaatcatgcttgtttacagtttacataatgccctgatatttaatctgctcgttatatcctgataatgctagaagattcatgcagttttttgagtacatactcgatattatctgctatatatcttgtcttctagaaaatatttttcaggaacaattgagcactcgagtaggttgtggtcaagtacaccgcattatcgagaacgatctcgacaaatgcagagtcgtcgcgcccaacctaccaacgaaaactgacaacctatctcatagcaccggctgtggctggactatttgagaaaaggttgttaacggataattcctcgtgaacgttgtcggctttattacctgacatgattgtgaacggacatccggatatgctacaagttgggtgtgtgagtcatgctagccacatgagatgcgcatgtaataaaccaattccagcgcctccataggtgttcgagagtcgaggtacgactacagcaataacgcagcggtcctcgtactacgacttcaaatgatcgagagacacctactcactggtcctcaaccagtcaattgtagcgatctctcgtacatttaattctagtggttgagttacgactactacctggttctgaccagaggtgtagtgattctcccattacctctacttcaacaaagttgatatcaggtgcacaatatcgccaagtgttttacccagagatcccttaccacaaaagacacctagcgttgaaacctatcctaatgtccctttacgccgtcttgacaaagcctctgaggaacctaaggaaacttcggctggggacgcccagagcggataaggctttgtcggatcctttagagacgaaagaccatgtaagatctggtcgtgtaagagttctcgccgtgcgtattaaccaagccgtgtaatcgaaaatggattttccaacttcacggctgggggctaggatcagtgcttgttcaaccgaggcaggtgaaaggtccaagagccttatcctccaagaacaattcgccgacaataaggctaggggctagggagagtgtataactcaacaaactgactgatcgaagtcggtaaaagagtagacgctcatatacaaaacattggtctgtaagtttaatgcattttcggttttccatacatattataacatgttaccctttgagcgttcgctcgggggctatttctatctaatattcttttctgagtattgattttaggaaaattctattcgacattatcgaaggctccatgtctctatggttctacaccaagatcgactaaggcgagtacgacaaaattcgacaaggcttcgtcgctgattctacgccttctcgatcactcgagaacagttggtggatctcgacaaggaatacggaatgaagaaatggtgtacccaccgagataaaatttcttgacttcaatccaaattctcgattacagcaagacgggagacttagtcgtatgctttgaactttcttggttgacgtcagagattgactcagacacaccctttaggtgcccgcacgaggctgataaaggaagtctaacgttatctctgaattcaccaagaacggtcacatgagctcgataacaattactctaaggtctgcgcgcggttgagaatatgaatttgttcatttgcatcgaagtctggggctactgtcagggttatggataccacatacctaatagtagttgactaaatctcggcaggacccaccatataccatgtcctatacggaaagaacctgtggatatgggaagagttccggataaggaaagacaactagagttctacatggaaacgacaaggactactcggattgtatccatatttgttcccctagttctacttgcacaaggggatacctatgggtataaatacaaggccccctaggaggagaggggacacacccaccatagaagacacagacaacatagacgccacaaagctacaagccaatacaagccaacatgcgccaagacaagccgccggatatcgacatcagagatacgcctggatcgaccctatccggtacgtactgaggctagccgtagggatctagcgctgtctctgacctcgccgggcacgaactcgaggaagaagactaccctgttgtcgactacgagtcagacctacagaccgcaaagtcgacaacagttagataggctaccccaaatattgtacttggtgtgattatggtgaataagagcaataccggcttcggccaacaggatgtagggctattacctgacaattcaggggcccgaacctgtataaaaatccttgtctccatctcttttacctcagtctcgcgtatatcctagtaccaacgatctccatactatgcaaataccggaatcgcgacatcaaacgtcgacaacttgggcaccctaagtatttaacaaaattgaaaccagctcatttaatgattaatttaatatgtgaataattactgaaatagtccttgtattattaaaattaggaattgagctccgaaaaatccaagaaaatttcagagagtacaattaatcatggagaatttaataaaaataaaatccagccatgctttatatttaggaaattttatttcccacatttaacttcacttgtaatttaaggaacatttaatataaattctattaatattttattaaatactttataaatcctgaaacgaaaattcaggctgtgacaaaggcgaacgatgtaaatttggccaatggccccttccctttcttactatagccaagaacggtctttttgatatatggaatggatgatccaagtttagccaattattatgcttgatgcctttggcatatatgcttgcgtcattttcgcattatttttgcatactagagagtgcttactctttttgcccacttttacgtttcttgtggagtcttaactttgcacttcgtcatttgccctttctgcactgttttagcagggtgtttgccgaaaattgtgtgttcggtccccctttgggaattggcgaaacaagaacgagaagttcgtggcggcgaagggtttgccaaaggtgcgatgcccgtttcggcctgtttactgcgagatgataataaacggcaacagctacaaggttttgaaggttgccggctgaatgcgggcgcaccccgggagaaccctggaagactacgaccgtatccatacagaacgtctggaggacatggttcgcttttggcgaaaccatcagaaaacagatcgtcaggaggcgatctcccaatgtcgttatagtctagtctgtgtttcgcccccttccctcttagggtcgtgtataatattagtagtgatgacgaacctgattcgccaaatcattccttagggagtgaggattgttgtgggggcgaatgtgtaatttatctgtaagctaggctgtaaagccgttgctttctttgtctataccatgttgtaagacttgtattcttcgattgttttttcgaagttgataaagatgtgttttacttccttttcgctattctttgcattgtcacttttcgtgctttcgttaggtcggaacgtgttggcccatttgcgtatattagcgaaataggtctgctgacttttcagctttcggcttccgttttcgatctgtagtattctgcgctgataggagcgcttgtgttttcatattgatcgagtgtaacggtgttcggttagttgtttcccgaaacaagtcgtcggagtacgtcacccaaggttgtttcgacaggctcggattaaagggtgaatgccggtgtccattcggccacgaagtcagctaggacttcagacttgatggcagtgcgggcgaggaaatgtaggttgaagggagataactccgccacccacttgctgagccggctagtaatttccttgccccggagctcttagcccaaaggatactgtgatggcactgtaactttgtgggcttgaaagtagtgtttaagctcgcgcgaagccatcactagggcgtaagcaagcttctccatttcaatgtatcgtatcttcgccccttgcaaggcttcggagacaaaatacactggtttctggcctgactctgtttcttggacgagggccgcactgaccgccaccggcgaggctgctaggtagagtagcagttcgcttcctagtgctgggctgaccaaagcaggtggactctgcagatattgcttcaactcgtcgaacgctgcttggcattcgggtgtccaggtaaacttttccgcgccccggagagtcttgaagaaacgcaagcctctttcggccgcttttgagaggaatcgactgagtgccgcaattcggcccgcgagcttttgtatttcgcgtacgctcgacgggggcttcatttgctgaatggcatcaattttctcggggttcgcctcgatatccctttcagaaacgagaaaacccaacaaattgcccatgcgaacaccaaaaacacacttctcaggatttagtttcatacccgccgcgcgtaagttgtcgaaggtcccctgtaagtcggacgcatggtcgaaagccttgtggcttttcgcaacgatgtcatcaacataagcctccacatttcaccccaactgcttgtaaatgaccttgtacactagcctagcgaaggttgcctcggcgttcctcaggccgaaaggcatcctgaggtagcaaaaggtgtcgaatggtgtgatgaaggctgtcttagagatgtcggctggattcatgtggatctggtggtagccggagtacgcatccaaaaagctcatgagttcgcagctagttgtcgaatccacgagctagtcgatccgcggtagggggaaatggtcttttgggcacgccttgttaagttctgtgaaattgacacacatgcgccctttgccgtttgatttccgcaccagtatcgaattcgccaaccactcggggtgatcgatctcctggatcaccccagatttgagcagcttttgcacttcggctttcgctgcttcttggcgattagcagacatcttgcgcagcttctatttccttggcttggcattcggcctgaccgccagatgatgcatgatgagatatggcgaaacacctaccacctcgtcggggccccaggcgcagatatcaatgtttttcttgagcacctccaggatgttctcaacttctctttcgcccatgtcgcccccagcgatacaagtcttgtgggattggcatcatcgacctgcaccttgatcaccctgccatgaggggcgcgcttcggcgtgtgcttcgcccggtcatgcggttcggcctcatcattgtggactgctctgttgattacggccaaatcgccctttgatgtagccgaaggttgaagcccattgaccacgatcactcttgcagggccaggcatcttgagcttgagataattgtggcgggagatggcttcgaacttgttcaaggttgcgcgactgaagatggcattatagttgtatgggatgtcgacaacgtcaaacagtatttgctctttgcgcctcttttcacttgtgccgaaggctaccaccaattgtacttggcctaggacttgaactgcttctccgtcaaaaccgcgaagcgaggccggtgcttgggtgagggctagggttggcatccccatcctggcatatgcttcggcgaagatgacgtcggtcgaacttcctccgtcgactatgattcgccggacttcgaagccaactacctcggccgagatcaccagggggtcttgatgcgggaacagcactccttcggcatattttggcccgaaggaaatctactgattcaagtatcacggggcctcttcgcttgccgaagtgatgttgtgcgccattcgcagctgcatcttcttttgctgttttgacagttgattcggcgggtcaacctttgtaatcacttggattactctgcgctgcacatcttggcgctgttcggccgggggtgcttgctcttgaacagcttcgtgaggtgcttcaacagctactccttgttgcggttttggatcttgcgcgttgccatgctgtcgaatgtttcggcattgatcggtggtgtgcgaacagcgtccatggaaggcgcagtaaaggtcttttctgaccttcttgcgaacgggctgttgatggctacttgcttgctgggcgtcgaactccttgcggagggcttgaacttcttcaacaaccatcacggccttgcgtggatggtcggttctgaatttcctccaagtcatgggagcttgacctggccttggcggttgtcacaccccaaagttctcctcccaagcctaaaatttaatttataaatgaccctaagaaaatgcaggtgcaaatcaagagaaaaccctaagaaggtaatgcaaataataatcagatttgacatgtggaatttttcttgagttctacatgtcgaaattcattaacaggatttttagtggaattttcagagctctagaaataattttaaccaattaaaattgagcaagcaatattttaattccagggaaaatccttttttttcctttttctttttcttttttcctctctttttcctcctttttttcgaatgggccgtcggcccattctctcctttccttccccctcctccttgctaggccggccgcaggccgaggcccagccaggccgtcccgccgccctcctctccggggtcaccgacaggtggggcccacctgtcgggtccttcccccacctcccgccgatctcgctcgcgccgccgcgcccgcaaccgccgccgcacccacgtctccgcctcctccgggccacgtcgaccacgcccgcgcgtgcgccgcgtctcccgcgcccactcctctctctctcccgctcgcgcccgcgcccgagatggccgggattcgattttcgaatcccgcctctctctcctccgccaccccccacgtcggccggcgattcccgcctctcccggccacgtccggtcccctctccccctatttaagcatcgccgtcgtcccctctcactttttccccattccgccgtactctctcgagcctcccatcgctcccgcgccgtgcaaccctttgccgccgccttttccgctactccggccgccgctagccgccgttagggtcgccgccaggccgcgccgtcgccgccgtcgggttcgcgtggccgagatccaccccgtccacccctcctccgtcgaggttcgtcgccggagccctcgttccctcgcactcgggtgagcaccacctccaccgccgccttcggccatggtttccggttgccgtggtccatcttcctctctctaatccctctcttctccttccttagggcaccccgaagctcgtccgcccgccgacgtcgtcctcccgtggcttgccgtcgctgttcgccatcgtcttcctccgcgccggccaccctcggtgaggcacccccctcccctcttttcccctccctctccctcctagccgccgctttagcgccgccgccggttagtcgtcgctttagcatcaccgcccttcggcgccgcctttgcgtcgccgtctccgccgccggatgccgtcgccggcaacgcgacgcgcgcgtgccaccgccgtcagccccgggtcggccggtcggctttgatgccgagccgagcccggcggctgcctccaccgccgcccgtccgatcggcccgagggcgatctgggccgtcggtcccgtggaccggcggtggaccacccgcgtggtcctggtccacggtgaaccgctcctcctgagccgctgaccggtggggcccgcttgccggcgccgcacccccctctgtgctgacgtcagccctgggatttattgcgcaataaatgatttaaggtttttcttgtatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgtttgccttgtatgtcgctagattccgtttcttccgacgctcccgtgtacttcgaaatagtcgccgaggtttctccagcagcagagcaaggcaagtcatgcttgtcacttgaacatgttgatcctatattgcaaatgctctattgttttctttcaaatattgcattgttttataatattactatgggatggttacctatggttaccagttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttctgatatgtcgtggtggcatgtgggcgcacggaaacgtgtcgtggggctgtgtcttgtgggtacagttgtacagctctgatcagagtaaaactattcgaatagccgtgcccgcggttacgggcggtcaaccagattcaccgtgattagtctcaccttagtgtaatcttttgaatttggataatttaggtggatggttgggcctgtcgcaacgtgggttagcgctggacagaggatgtttaattaataattacaactgtttgaatctttcagcttctgtttataaatgctcgctttatgcaaatgaacctgcttagctatcccttgttgaatccttgcatcatacccctattcctgtatgacttgctgagtaatattgacaaataaaagttccacaagatgctatcgaacaagtggttttttcttccccttttaccatcactattagcctacccttaactatactccattgcaccacacataaagtgtatttttgcatatattattctaagtgtgaaatggacttttcacatagtttatgggagactaacggtgatacaatgaaaggtaggggtgaaaatggatcggattatatccgatctgatccgttccaaatccgtcctaaacgaggatggtatggaattttagaaatcggcggatatggatgcgaatgcggatagtaaggtgcggattctgattcggatgtggtatctctaaaaaccgataaatgcggattatctggtatttctatcggattatcccataggtcgtttgccggataatccgaaaatatcaacccatgtaaccactctatctgggcatataacatgagtcggcccatccaatgacctaatttatcaattaacctaaacttccttgtttgaggcttttgccgtctcatcttacacttaagtttatgaaaggtcgtttaatgattattgtattgctgtcccttgcattgataactcaatgttgtattgattgtataaacatctaacatctgataaatttaatttgtttcccgaaccgagtctgcaccgactccgcaccatttccaacatccgaaacaatccgctctgcatgcgcacatatccgcacccgcttcgaatctgcttaaaaaatggtttagaatatggttgttgatgtgaaaacacggtggcctgggagatttgcttaactccagtgcaggtccaaaggttgatgagatgcgggtgtgccaatcagtttgatcctgcaactcacaagatatacaatagcagatcaaatagccgatcggctgataagctgatggagtagttccagtcgatgccgatactagccgatgtcaatagggttttgatcaaacggctatatgtccaatgtagataacgatataaagacaatcggctgatggtaatgtaatccagtagaaaccaatcggctaataatgatatgagagcataaacactaatccgaaggttaaagcttacatcggctgaaagtccgatgtcattaaatccaaacgattagataaacaatgaaacctttattgcgatcggctaaaaccaacttgtatgtaatccttgtaagccgatgcaacgcccatgtaactcattggctgaaaccccgatgaaacccttattagcaatcaagaagcaggctagagatcatggttctaaatacgacttagtagatcgaatgtactaatgcatcactaagtatgaaaagaaacacaatatctagacaatcaagcttttgactaatttttagggtggtggataccttagctaatccaatctagtaaatcgatttagccgataccggcataaacccttaagcgagaatcagctgatatgactaaatcgatatactaaaactagattaactaagatatatgataaataggtaggcaaaaatatcaaccgaaccagagcgatccaagaggtcgaagcgatgcagccttgaacaacaccattatagccgatacaattgccaggactggcggaacgtaggacttacccccttcgccgaagatcgaaagccgatgcaaccccgcgtcaagtgctaaggtttcgccggatgataaataaaaacctcgggaaagagggtggctatacgccaagagtagctgtattgatctatgagataaattaaaattaccacatatgtacatatttatacccatgggtagatactagtccttgttggacaagaaagaaacttttcgaaagataaaaagaaaacataaaatccttatgggacactaaacacactttcctaaagataaaaggaaacacaaactcttcctaattaatagataaactgccatgccacatcttccttgaacacggtctcttctagataagctttctttaattgattaattttcttaatctgattactagcgacttgatgactctcatcggctgattccagaactctgaagccaatactaactctaggccgatcaggacttcggggcttaccaaatttcactgttaacaatggtgtgaccactatccgtccgaatccgatccgtttccacccctaacgacaggatgtcgttttagattagtggtactaggttataatattctaggaaagagggagttatatttacatatattaatgatttaagatttgatggtttaactgtacacattttaaaatgtcatatatattcgagaagctagtagatagtaatgctttgttctgcatctgaccgtatgtgtctgttgtgatgaaatgactacaaatcgggtgcccgatttttcctaaaaatcaggcattattttaccccttatgaaagagtgtttcagcactaagtgaaagaatgttttagttcttgaaaaaagtgaaacgcaatcggatcgccagatgaaacaatttggttcaataaataaaactaatgatttaaagccattgaaagatcaacaagttccgagtgaaatcgaagacaaaaattgaaacaccataaaaaaatccaagtgaaacactttgatctgactaatgaaacaaccatatacatagaatgaaaacattgaaacaatcacccgaaaaaagaccagctaaatccacttcaggttagccggatcatcgacggtagatgctgcccaagccacggaggagacgtggctaatgatggcgtgcagctgccgaagatgatgatttggctgatgatgccctacaaaccaccaccaccacccactcctacagccactcaggacatagccattgccgccgttgttgcatagactcagctaagtctacattgccgccactgcagctgcctgccaccgtcacccctattagccaccgccttgtcctgccgatatcttgccttatgtttctgcctgtcactaccttgcctccacctttgcctcctcacagatcaaaggggatagagaggagagaaatggtgaagagagagataaaggaggggaatagatgagaccgagagagaaaggagggatgtggggcgcagggcgcccgatattttccttcccaccaggcacccgagccaaatgctaccatatataactttcaatctagttagtaatagttagtaatgaaagagaattaccatttctaatatatacaccctctggaaagtcctccgggattgccccttctatccgcaatatatttgttatttgaccaatttcttcaactggtgcaaaattactctgcatggatatatagatccaccacatacgtaagttattagcaatggaaattgaactgattctccaatttagttttagaggaaaattgtttctccaagggaaattaatgtatttctctccaattcattgcttagaccccaaaataagtgctacttgctcttctaacttgtttagcataaatcaatgcttgagaaggaaacaactatgatgtatgataggaggatgcatgattaggagtaggatgggacaaagttttgaatataacatgtacttcctccgtttcatattataagactttctagcattgcccatatttatatatatgttaatgaatctagacatatatgtgttcctagatttattaacatctatatgaatatgagcaatgctaaaaaatcttataacctgaaacggaggtagtagtacttagaagaatactcttttcagacaaatttttaatcctaaaaagcattcatttttacaggacggaagaaaatttatattataggaagttcaaagcaataaattgctgctgcattttgtgtaacgtatatgcaatcatgcttgcctgccctacctcggtgggacgtaaagattgatgactgaatgtgaagatagagtccacaaacgcatccagcaatttcttggaagcactgcttcctgcagcagatgcctccctaagtttggttttcaatacttgctgaagctccttgaaacgaggtggctgtatgtatcaaatgaacgtattaaaatggaatcatatgatcatctcattgtacatatgcaatgcaacagtaaaatatacatttttttttggcccaaacagtaaaatatacaatctcaatctcgttgttgcatgcttatagcagtagagctagctagctctggaataattgatcagttcagttgttatatgcagagagacagaaaggagactagagaggctaactacggagggaggtgtggtttagtactgtgcgtacgatgtgcgcagaggaatcatgagtcgccaaaggcttagtcctggtgatcttggctggccttcctccggtgctgcacaggcgtggttgaagagagaagccatacatatgcatggatgctatggtcgccattgttgcaagcttgttgctcctaacaactcctccttttataaggctattccaagagatagatatagtactcgccttctgtcccagtatgacgttgttgactttcacgtaatgtttaaccattcattttatttaaaaagttatataaatattatttattttattatgacttattttatcaccaaaaaaactaaaatcctagcctgtacttttacatatttatactacatttataataaaacgaatagtcaaatgctatgcgaaaagtgaacgatgtgatctattttagctgggttttcgcaacagaacaaggacaatcctccaacataaggattctgacatattcacgtgtaaaaatatctagatatttatccaccctaagcttgggtatgttattattgcatatttattaattagagatgcatactactactccctccgttgtttataaccgatagtttggatagttccaaaatataagtattcgtggattgtttgggcgtttagcagagataagaaaaaagaactttgatatccttcattaaataagactttattaggttagattggtaattctatatattaaaaaataaaaagagaggtgattgattacacgggtataaagtaatacgaatagcacttaaattacttagatttcggtacaaatttcaattgttagaaccatttatattgtataaccgaccaagcaagcatattatattcaaaatagtggtactatagtacttcctctgttagtagaattacgtgaacaatgctataaagttttataatataaaacgttccatctccactctactcacatgaactacaataggcctagctaacaggtaccactggaccaagcagattgattggctcaacgaaattgccacgtgaatttttgtaccgtctggacgatgctttcaccaactttcactggccatctctctcactcaagagtcacggtcggcacatgctagaggccgagatcctggctaggagtctgtttcaggagttttttccaaacagtttaattaacttttcattcagattttgagaagctataattatagaattcagaaaattaattagaaaatataattaagttgagaaacttagtttctcagaagctgactaccaaccggctgtttcttaaaactttaaactacccaaacataccgtacgaccgaccaaggtttgaaatttcagtaatttcgaccccatcggcaaacacaaatctccccaaaagttccatttttttatcaaatatttctaaatctgttcaaattcagtcaaaatacgttacaaattcaaatcacttcggtctgaaaaatccagaaatcacgacatttccaaatttcggtaaccaccgaaatttcggtggggaccaaaattgaaaccttgagagtgacccggcctgacttgcgcacggggtaacatcgtcggatcgaacgacacgccaccacacaggatggataagctagcgtgcggcggcctcaaatatcatccgcgtcaacgtcgtcctcttcctcttcctcttcctctcggtgcctcaaatttcttccgcgactctcattagtcctcggatgccggccggtgtcgatcgatcggcaagctatagatagacagatgtggcacggtcgatcgacaagcaagcgggcgtcgctgtcgggctcgtgtcttttgtcacctggtaatattgtaccgatcgacgatcgagcttgctgccgaagtcgatgggcatttgaggggacgctctcttgtctccttgctctctctctctctcattccatgtacagggtaaacgatgaattggatggacactaatagttgccttatcgtacagcttccactgatgcagcttgatcctctgacctttctcctcacttaattaatgggtctgtctcctaaaataagtaataacaatttgtagagttaggtacagacattaaggaaatagttggaattaaatataggagaatatcgtgattttctattaaagaagacacggcaaaggaggtccccgttgttattgcatgctttatttaatatataaagaaaaatgtaattacaatagaaatattaaaaaacactgatccaatacatggctacatctttatctctctctctctctctgctagcttgaaaaggagtagaagatctccttttaagagacacctccaagacgacatggaaactggcttgctttcaaaaataaaaccatttctcactttccaaacttttcaagtcaccattaaaattttctcgataaagcatctttctcggtagcgaagatagacaccaaacattatattctccaaattgtctgatgttttccagaaaatcctaacaacggcccagcaaatcttgaaaaggggcactcaaaatttagatgcaacatggtctccacaattccatgtccacataaaacacacccgcggtcacaatcaggaggtgcatattttttatgatctagcatgtatcttttattcagtggatcctttaatgaaagccagccaaaagcttttatgttagacatacatttactcttcaagattcaacagcaaaaccatccacaacttatggatgtgcacaactcatgttctcactcgcaaaaaaggactagttcacagctacacatcttcaaagagaagattaattatgtacatgaacactacacgcattcagaagagaagaacaaagaaacatacaagagctcctggccgccgcgcacacgccgcggcgctgttcgtctccgccgtcgcgcggactgggcccggcgttcctcccttgagccgaggacgagtacgccgactccgacggtgacccggccgcctctcacccgtcggcggcagccgcctcccacccgctgccgacgccgtcgacggagaggggaaggggaggtggggaagagaggggaggtcgctgccgccgctcgccaccccaatactacataaacgatttttgtgtacgagacccttggtaggttgcaaacggaccataacttacagcatctggaaaaatcgagcggcattttcgcatatggctccttaagacgcctgtatggaaaaatttacatacgggcatcttaaggagccgtatgcgaaaatcgatttttccacaacaaaggtttctctttttaatctttgactaaaacttgtaactagtgtttttccctcatactaacttcaaatgtgttgattctttcctaaatgtttctaaaatcatgctctattatgttattgtgttcctactgctattagtttggccaacttttcatgtgactttgttttatcaattaaaaatttgaatttcaaaaaatggcaacttcaaataatattttgatgcagtaaatattttcagctgaaaaagtcatgaacataaaagttgtagaactcaattttttaaaaaaaagttgtagaactcatcaagatatacaacttttcttttagtcattttttcatccgataaagtgatagtaacattgttcacacaatttacatatctctcttacagtttataaaaccatatgagagatatgtgaaattcgtgaacaacattacttatctttttgttgatgaagaaatgataaaagtaaaagttatagatcttagtgagttatacaactttttcagttgaaatcatttagtttttgaaaattttgtttgaagttgtcatattttgatgtttaaattcaaactgttcaaacaaaatcatgtagaaaaatgattagaacaaaagttgtagatctttatgcgtttcacaaatttgttgttgacaatttttccagttgaaatcatttactaccataaaattatttgaatttcttatattttaaaatttaaattttatgtagttaaatcaaactcagatagagaaatgacgaaaataaaattggtagatctcaacaagttccacaactttgtttttgacaacgttttcacatgagtttatttagtatcacaaaattcgatttgaaattctcatattttcgcatgtggccccttaagaggtccgtatgcaaaaatagatttttgcatgcggacttcttaagtggttccatgcaaaaataccaccccttcacatatttttttcatctccctccactcttttttccctcccaccacttcaatttttttcaacccatctcctctctctctcccctcacctctcctactattatttactttcctctctctctctttttctctccctttctctcctctcccctctctctctctcttctctcctctccctctcagagcgggcacaggcggcctggagtaggggtggtgatggcgtcggtgggcggtggatccggcagcgctgccctagggagcggctgcagctgcggcggcgacagcgagcggcggatccggcggagcggagtattttctcacgtgggtcactaaagaggcccgtatatgaaaataggtttattttcagatgcaggctttttaagaggcccacatgtgaaaattcatttgcatgttaaggttacagttcgcgcctgcaacctacagggtcttcgtcccgaaaaatcttttctatagtagtgtcctccctccattgtttatagcaaatagtttggatagttctaaaatataagcatttgtaatttgtttaactgtttagctgagataaggttaaggataaaagattttgatgtctttcattaaacaagagattgttagtacaaatttcaattgttagatgtattcatattttagaactgagagagtgtatgtttgaattatataatagagccggccgcttccatctccacttaattcacataaactacattaggcctaataggtaccctgcagattgattgcctcaataaattgccagtgaagttacgaaaagtgggtccagataggacaataattgaccctgcagattgacaggctagtgaattattgtcctgtctggacccacttttcgtcacttcactggcgattttttatttcaaatattaataaaacagtatttttaattaccatacaatatttattttgtgaaattgtgcgttttatcatgctaatataattcacgtgacatttgattaatgtcacttcagtttgaattaatgacgtactccctccggttccataattcctgacattttggacaaggttgatgtcaaacttttgcaactttaattatcaataactttagaactattaagtttaaaggaactagaacaacatatatagattcgtctttcaaaataatgtaagaaaagtaaacatgcatttatttattgtatatattattttaggaaaacaaaatgaaatacatattttgaagaccgtgtcattatccaaaacgtcaagaattatggaaccggagggagtagcaaattctggtcaagttggcaagaatctacctatgtagtatagcattactccctccatcccaagatgtagcaatctaggatgggtgactatgaatctggacataagtcttaggacagaggttgctacattttcggacagatgcagtattaaactaggtgaaaccctacgtggtactgtgggagtttactatatgataacaataagtaattataatgtgtaaaataacttaaacaacataagtttatataaacataagtttatataaattgatgtaatttaaatttaaatagtatatacaatgatgactcaaatataaaagtaagatggtgtggccttatgagagaataaaagaaggaagataatttagactatacatataagggctaaaaaagttgagatgatatggcttaatgagagaagaaaaggatagagataatttgaaccacggattaatcgcataagcacaattcatctgatacgacttaacgagagaaaagaaaaatataatgacctaagtgaggatgaactatacataggtatatagtgtattataaaaaaatgatggagagatatattgaaatattatgtaaattatgtgggatgatttaacattattacattttaaatctttaaaatttaataaattattaaattatagataatatagcatgtttgcatgatacttaaatgtaatacttgttagtagatgatgatgtggtatttttacactttagaaattagtgtactttaactttatatatagtatatagtaagagaggattggttgttgtccacaccagtttaattggtgtggtaacctcgtgcaacaatgctaaactttatggcgtgacgacttcgtcgtgcatgcatgcatgtatttgtagacaatgtatatgtttactagatgaataccccattgtgttgctgcggagaattaagttgcataatatatacaaataaaatataatttgattatcaaaacgaaaacaatttgatataattttgagcctgaaaataaatgagattgcatgttttatgagagaagaaagaatagacaatttagaccatagatcttttatccaaaggctagaaataattgaggtggtgtggtttaataagagaagagagaaatatcatgaactacatttagtggggatgaactatataagtatatataagtatatatatatatatgattaccttggttattctaatttgcaaagaagaaccttgctttcacataattaacaacaatttgtcataatataattatttagataactttcaatatatgtactgtttttggtaaaaatatactgatatgtctttatatatagttgagttcgatataatgctgaatgttattggtgctcgtctatgttgacaccccgttcatgttgaataccacgttgattatattgcgtggatttttttttggtataggtgctcgtctatgttgacactccattcgtgttggcgtgacattagttaaataccatgttaattatattgcgtggattttttagagaagaatattttttacccgatcggatatatgcaatcttttaaattgggacttagcttctcaaacaatctaatctgaaattcgctcctataaagatgtgaagtcagtactactcaagtcactacaattaataggctatatgtccttttgctatattgcgtggatatgaggttccgttttgaaaatagaattttatatggtctgtcaataatatattattttagaaatgttgagaaaacaaagcgaaattcttcacaggctttttttgtcactgatcgatccagtagctgtcggtgggcggtggctacggctggtggccagttactatgatcctgattgaccatgagcaaatcgtgcaacacgcgtagggtaacgagagacgctagctccgcagcctcatcatcccccctctccatcgtgcgccacggatgtgtgctgctctgctcgggatcttcatctaccgtgtgcgggcgtagctaggtggtagtttcctgatatactcgaaactactcgctccgtttcacaatgtaaaattttctagcattacctacatatatatagatgttaataaatctaaacacatacacatatctaagattcattaacatctaaatggatacagacaatgctagaaagttttatagtgtgaaacggaggaagtaccaccgattttggcccaaggacccctacctcctaaattctgtctcaagagtaagcacaagaaatgaaaagaagccagcccaagaaagagaaagagaaaacatagcagaagccctaggctgatcggctgggacgcgaccctccactccttgcacgcccgtgagagagccgcaccaccactattctctggctctcgcctctctccactcctcacctcgccgcgccgccgttttcctgtatcgatttgcagagggtagaggagggcagacgggcgacgtggcataggcaaggaacttgctccccgcccagcgcccagctggcttccccctcatggtgccatggcgcccccaccggccccctgaggccctacttgatatctctctctaccaagtcctatcatcctatgctgtctggttgtttgttgttcgatcttggagcgtgcaatggaggaaaattttgatcttggaagagtgaaacaaaacaatgtagtttagctctgagtaatctgcgttcttgggttggtacaactggagaaggttcaaattttctcaacatatagaagatcatgtcttgattaattaccgatattcttcatcgctaacaggcctagtagtccggcctgattgagatataggatgtaatctcaatcgggcctaagggagagcccgacactgatgaatgtcatcggtgatgggctataggtatatacacctctattatgtctatataagtacatctacaacgatgttaatttaggcccgattgagatggcttcattttaacggcccatgttgcctaggcatatgagcggatttgtactagtggctcattttgcttcacttgttctgtgtggagatcagattctatcaacctaatcagctgtttgagagcaacagagctgagcgggagcaccatcagcatgaccgaaaaccagctactcaccttgattaggccaaacctggttcatctaatttgtcacattggaaaatatatggatcgtctgaaataaatgttactcatgtttctttatttgtaccatattctcaacgtattactacttgtatatatcattttaggtgtttgaaaattttgatgtgtaatatgaacttgtgaagtaggactacctatcgaaaaatttctaactacaccagccactctggctcattccggttctggcagcatgctaacctagctagcttagggcaccagcaatgtacaaggagagagagagagggggggggggacattggccatcacggacgggaatggagccaacgacgggggttgcggcagcatgtgcggtcatatgtggcagcatcgacggtgatcgttggttgatctcgcggcggcaacagtgatagcagttgcgaacgcgcgcacgggcgaattcgacggcggtcctggctggatctctggcggtgtcggcgacggtcgaggttggatgcagcgtcagcgatggtggtcgcgggcagatcccgcgacggtgcgaacgagcggatccagcggcggtcgtgggcagatcttcgacggtcgcgggtggatctccggttgcggagatggcagtcgcagggggatttctagtgatatccatgcaggtgcacccatgctctctcactctcccacggcggactacttgctgcttctcctcccttacgggggcaaccaaaagatttggagagagacaaagttggagcagagaagattgaattttttattctttatgagtggtccttttgtataatgcttacttaagtaaagaatagctataaggatcatctccacatacaacgtataagtagatatcataagcataatgccctttccgattttcatattgtggatgccctaactattgagttcggtgtgcgtcgtcctcaggcgtacgtgcgtgccgctgtcgggctcgtgccgcgtcacccggtaatgtgtgacactgatgagttagccgccgaagacgtacgactcgatcgatcgacactgagcggacactctcttgtccccttgtctccttgttctctcctgcacgcggaaacaatgatgaattggatggactataatagtagccgtacaatgttttaattatagtactttgtctaatgcagcttgatacttcgtggtggtactatatatccgttttaaaatatggcaatacagtatcagatggaacatatctcactaatataaataatatggcaatacagtatcagatggaacatatctcactaatataaattttggacagaccctttgtacagattaataatactaggatgcatctcatccgatgctatattgctatattttggaccgatgtagttcaatcaaagcatgcatctaaactattttacgattagaaaaatatctgaattacccactgaactatcacgacattatgaattgtcctctaaatcccaaaatcagacttttaaaccccgaactatttataccagacaaaataacccccgcgaatcaatccgatgcagttttgtcctacattacgtacgtacgcgtggcaatccagttagcatttttctttttaaaaataagtggggtggagcagttagactctcacctctctctttactctcttccccgaccattaacgacattgacgacggcgccgtcgtcgccactccctcttcctttcttcctcgctatcgaccacggtaggtgacggcattagcaggggagaggtgcttgcctgtttccgccgtgtcggtgatatgggcccgggggtacctatgctgaggggaagggatcctttcccgtcagccacgtggccgcgtggcccaggccccacatcggggggttggacgcacggacggtgaatagcccaggagcgtccgcgctcccccagggggctcggggtatctcgccatatccctcggccccgaggggctgccttacctcgaggccctcgctcggcgccacgtggtgaccgcgagggggatcgagcaggcgggaacgcggggactgccaggcgcatttatgggcagcgccccaaccgcccaccggaagacgtgcgtcaagcagccttgaccggtctgcgaccggcgtgcgatcggtgacagacggatgtgacaggcggcagcgcacccacgccctaccctgtatcaggcgacgtgggggcaggtataccccgtcccatcgacagcaggggatcgacgtgcaggtcggtgcaccccacgcgcgtgaacccacgaagtctccaaaaatgtatgagggaatgataggggatgtcccccgtgtcaggcgaaggacttcgctagggaccacctgaggacgagcgcacacttcacttccggccaaaggattgggaagctgttcaacccagaccgatgtgggcccctctccaaggtagggaccgtagcggcggtgtatgtggtatctccttgaactataaatggaggaccttgcccagcgagcaaaggacgactcttaagaactctagctctaggaagagactagaaaaaccctagttgttttccctgagatttggattccttgtaacttctcgaagatcaacccatatataggagtagggtattacgcttcatagcaacccaaacctggataatctctcgtccccgtctggattaccatccactttgcgagcttagccccgagcgaatccgattcgctaagtagagatagcgctcctgatcatcacgcctaatcctctggccgaactcacaaagggggggtctcacgtcctcccgctagagatggtcactcctcgacagctggcgcgcaaggtaggggaaatcccgcgcgtttgtgaaggagccgtttttcttccgccccaagtttccttccatcctcaacgaccatggtcgaggtagtggaggaagaagtggtggtgtacactcccactccgtccggaagtgaggacggtagcgggagtcgtaatccccgccaccaccgccgggactctccgacccctcctcgcgaagccccagacggcggaaggaccccaaccggttaggaggttcggccctttccctgccggctgatgggggaagggcgcgccgcgccggggtacaccgccgcctcacctacgacgacggcggcacgccccaaggcgcgctccaggccgtggaggctctcctacggcaccctcccgtcgttctagagccgaagaccccggtccagcggtggctggatgatgtggccaacttggtcgtagccgcacagcggcagctggccactaacggctggcccttaactgctggtacctcacgtacctctactgccctctcctcatcggcgaggaggagggcttgtcggtcagccatgatctcacggcgatcgacaaccccgacgtcgtcgaggccctcgaaaagccgagggcgttacgatagtctttacggggaacaggacgcccgaatcaacatcaagcgtcacagggatgagcgccgcgctccctgcgcgggggaaggcgcctccttatcaggagtgtcgcgccaccccgcgcgaggcggccggccccccacgcccccgtccggtggggctgggtgcaaggcctttgtggcgagtctccgaaacgtccggtggcccccgaagttccgccccaacctcaccgaggagggaggaggagggaggcaaagtagacttcgtgggccgagggcgtgggccgagggagagaggacagcccgaaaggaaggaggaaaggagggagggggaaacaagccaaggagagagagggagggatttgggccggtaggggcccaaaggaaggaggggaaatttaattggtttttcatttaatttaattgattaattgaattttgtgactttaaaaatttacttcttgagctccgaaaattcacgggaaatttcagagaatatattagggcacagagaatattacaaaaatatttccggccatgatttttaaggaaatttttttaattcccttaataattcacttgattaaattactttaacttttatttaacttctagaaaatgtactattaattgatttgtaatgccgaacgaaaatcggggtgttataaggacttccctaaaaaggaaaacaactgcggcaccgttctaggaaaggaaaggaaacggtcccgcgaacaaaaacggacacggttgatcatgcaaaatgaaaccgcggactgagaaggcagtgaattgggcacaattcatgaccaaaggcaaaaggaagaattattattaatgtgatcttgacatttttaaacttagcaacattacctccggtgctctatgaattccgctttaagtccggttagtcatttttagagcaaatagaatttgaaaaaaaatttcctctggcaattccgattattaaatatattgttaattagggttttctcctggttaaccaaagtaatttctatagactatttattagtgaattggaacctaaggaaagggaaaactctgggtgtgacattaacctgggaactagcttcacatgagtatgtgtttagagcatttgcgatgttgtagaactctagcttattttttcatgtctcttgagatgtgtaacctggtcgccaccttcgtgtggtttgacggttgactagcacgttgagtcctagtagtcctagtaatatctcctatgctctgtacttgaggcttcgggtttcataacgtgttagctttttgatttgatagggcatcgatgaagttggatggttaccattttatttagattttatcgagaccccatccaactaaatatttcacgatgtcatttgaaataagcttacataatatttaactcggggtgttatctatatttttttaaaaaaaatataatcatttcgttgaacaaaatgaggggatgttcattcgggtgattaaaagagtttgccattgttccaagtgctatcagccatcagtatcaggaaactcaggtggtcacgtacgacacaagggtttagaatcaacattcttgccccatgcatcaccagtgaagttgcttctgccatgccaagaccagttgactgataccttagtaacaacctaagtctgtgtggcctttaatcagtttaagaagcaaaaccaatttcaggcaagctagcatctgtcttgtgatagctaggtatgctcggcaatttacatccttaagctgtaactgtggtggtcttcgttttgtagttaattaagatttaagaacatacatcatgtagccttcacatgaagatttaagttgctgatcgaatcctacaaggcacatagagttaatttccaaatcctttttcctggcactgaaccggaagagctgctcctagctagcctcctagggctcatggaaaaaaagcgtgaaatttgcagttttgcactcgaacgacgtaagcattcaccacgctctgcacattattcctggcatttttcgtttctttatctaaggagtgtatctgtactttgcagagagtagtaatccaagaggctgtctcgttttatgtttaccactgcgttaaattgcattcgtttgaaatgctaatatgctaattaattaaaaacaaaagaacaacaaaaatatatagcgaaaaggagccgtaaggatgatagtgccgtcacgaattattgacttaaaataatcacagttgttgtatcttcgccggaccggctgaaagccggccagaatgtattaagacgcgggagcttacaattcttgtaccgtacatgtcacctcggcagtaaatatattatacaattcttatttatttcttgatatatgaatgttccatgaaaaccgtaggatactctttatgataatgttatctttaccaatttagtaaattgtgaaatctgtgcgcatcaaatatacttagggctcctttaaatcataggattgaaaaaatgtaggaacaaaaaaaaactcaggaatagtataggaaatcataggtaaaactaatggttgaaaaacatgggaaaattataggaacgatcgtttgattgatacaaaggaaaaacataggaatgttaagtattaagttaatagccatcaaaatttgaatggttttatgagggtaaacattgtctttcaatagtgttttgcctcgatcctactcataggaaaagaaaaatgagctcaaggtggatgttaattttcctatggaattcccttaaaatcatggtcataggaaattttcccatgcatttcctatattcaattcctacaaatcaaagggatgaacagtaccaaatcccataggattattgatcctatgtttttcctccattttttcctatgaatcgatggaggccttaatgtgctgaggccgtgggcgggtagcgcgctggctttgcttgcctgaatagcattgcgacgacgagcatgtgggcatgggtgcgaagcagcggcggcgagcgtggcggcgcgcagggcgtaggatgatcagatgacgctcggcccatgacatcgcgctgggatgacacgcgcgcagcgtgtgacgggcgcgcatggagcgcagctgcgctgccgtgtcgcgctttgcattggcgcgacgccgacgaagcgacgagctgcggagacgcgcgcgcgcgcggggcggcaggacagcgcgccgcgcggcgcggctccttgggaagacgtcgcgcgaggaaccaatcacagagcaggaatcatatcacaagtaaaaaaattattttcgcagagaatccttttactgcacatatgctacggtccataaggaaatctgccattgcagtaagtcaggagggacctgcatcacgaaaccaccggtggaacttacttttagaggcggtagtcgtaatccagacacctttgaaatttgtctgttttcacagtgcactaagattgttactgatattaggaagggtgtaatcctaatttattgcgtacaaagctacaaaacacttacagatgtagtaataaaggacacaagattaatcacagtatttgtaatatcataagccatatcgaattgtcagaaaatgtgcctataggtatggattatcgccaaaagtttggcagtaatttatatgcttatacaagagtcatgtcttcttgtatgtagttcttgggatgaatgtgccatgaaagccatagggtactctttgtggcaatgttatcttagcaattggtccattttcaaatctctgagcatcaatgacatgtgcctgtaaagttaaagaatcacagtttaatcattaataatatatacccgctgatgggttataagttattcttttaattttcttatcaagctttccggtttgtgagttggtgtcgtcggttgtcaaatctgacacctatgaaggattgccaatcggcatttactaggggttttgtactggtgagtagggagtaaaaatgattatatatgggaataacatgcattgtaatgtaatgtcaagaatataaagaatgttgtaattaacatgctagttcgaatatcaaaagtaattttgaattttattttatctaattttctagacagaacagtcacgatagtttagcacatataatagaagaaagatgattctagagagctcgcctgtgaagtgtttatttcctcgtcatgtacaaaggaaattatccatccatcatcttcatttgctccattgacctttggaacaaaagttgctcccgagcaaaactgatttttaccaagatgatgatactccacatttattagatctccaccaaactatctcaagagttgcaaaccatgatgttataagatatttcaaaaaagaaagcagcaagacaaagacattgttttcttatatatatatatatatatactaccttgttgttatcttgaagatgtagttttgcgaaacctccaaattttggtcgcactacataaaacgaaagtaaagttagcacatgatgaatagttgaatatatccttcttggtcagtttttttaatatacccttagatatggtagatccgacatgatatgcaatatttaggttatgcggcagaaatgttattgtacattttcattatattttccttgttgaaattttttatcctaatcagcaaataaactgtttaacttaattttgtcagttcaacttagtgctgaatatatttaagacaaatgcaatctttgctgagaaaatacctgttccacagccaccttccaggctcccttggacatcaatcacttgtgcatatgcatacttgtgatgcaggccagcatatttgttattgatcactgggaattccagagcaacatctgtcccagttaagtatttacctgtgacagccctgcttttcatgtttaatctccactcatataagcgaggaaaagatttctcactgggtccttgattagctggctcttcattagccgtgtgctcaagtgttatgccagtaattatggaacccggcactcgaaatcctctgatgacaacctaataataaaaaattaaacaacgccaaattatattttgaaagtgtttgcacatttactctacatggatttgatcttgaccaaatcattcaaacacttcagcaatttgattgtttcttcactgagtgtgacaaaaaggctcttgatttttaatgtgtattatgataaaaaaaaacataccacaaccacttgtttactgacaaaatggcctctatgatctaatcatccaattcaaataactgctaatctcttggagcatacattttagtgtagcagttcaattgtgcaacacagcttcatgtcgatagaaaaagcactatacaacaaccacttgatacgctacctcatgatcttcctcaaagcaattgatgagatgcaatgtgcaaaatggttctacatcgaaccatattactgaatctgcatctccatgacggggcatgactccaattcttgcataactttctgtttcaaaatcaatcaacctatagaatgttatataattaatatgttagaaacatggaagattgttgtctcaacaatagtatgtctaacataggtactcacggagctcctcttagaatcctagtaaggtccactgtaagaggcatatccatgataatattgtacctacatatggaagaacggattaatcatacttttgatgcaaatgtagttatcttattttgcatttccaaattgtttctacattgtattgtattgtattatgttgtattatattgtattgtattgtattgtattgtattgtattgcattgtattgtattgtatttgcagccactgtcaccaccgcctcatcaacctgctgactgctgtccatccaatgccactactgctgcgctgagttgctacttctttccaattcctctatatgttactgtgagccaatccaccaagcagagaagcacaggggaagaagaaaatgaagagaagaggagtagaggtagatagtttggagagttgtgttcaatataaggttttcggttgaaattaggctagatgtatcaattttaaatacaattcaagtttaatagtgggcgcttcaaatttaaccttttgattggtaagatgaaacaaaacattgtaatctgggattgatctatcaagaaataagttttatgttctaaataaaagttgtaggtatcagtcatatttttctaatggcacttgtttcatttattttagatcggttatttgtaagtaattgctaaaattttgctaacatggtaagaaaactggtgcagcaatccttttatttcattttgataattataaacacataactaggtcatttgcataacatgaaagttgcaggtactcttctatagatgctccagatgtacttaatgttttcttttgtttaatggtataaaagcaattgctagaatagcgagcaagcaagggtttaggtagttcataaataaatttctatgttttggggttttaaaaattatatcaagaaattagtgtgttgtttatttactagcattgcagttttttttttaatttagatgcatgttatttcgttctttttgtttggaggattctgataccaagttaccactaaggttaaggcaagtgcacggtaactatttgtatatgatgcgtgaactagtttaatttaattgtttcacttttattatgttgtaattattcatgtgattacgtgtaatcttgaatttggtttcatcttatcaatcatgttatatattcatgtttcatgattctgctctttttttggtttaatatcaagtgccacgcatagccacggaactgtaatttggttctttattcatgacacctgagttacattgaacctaatactcaggttaaccagtaaatgctaaaatgatattcgcgtaaaataaaaatagtttccgactcgctcttttttataaattattccgtacacattttctagttccatataatcttgctgagtattttatactcatctttgtgctttatttggtttttaggtatcacgtgacaccagcatgcaaggacgggaatagcacccaacatcgatacacttatgcacatatgaaaattaaacttagtttgtaagattagattaacttggtttcattatatttggatagtttacttcatgtttatgttattatggttgttcctgatacttctaggatgttgttgatggtaccatattcattgatgctggtgtgtttaaatattcttataattgctatcgtgcgtgtctataaatataaatagaactttgccatggtttttaatcaattttagattttagactaaaaaagtttttatgtgtggtgttgatatctaacactccagatgaatagacatagggcataaggcagttaattaatcaaattctcttagttacttaagaaatcaaatgacccattcattcctatgatgtttcacaagtgcatttgaaccatttaagatataggtctatctaaatggaagtcatgcactctgaaggacgggactacagagtgcatgtgcactaattagtgttaaccacatatcatcctcacaaatgctaaagttaatatgtactctcttgctataaagttttggcgtaaaccgccacatcggatccaggggtgtaaagttttggcgtgtcacatcagatatacggacacacatttgaagtattaaacgtagtctaataacaaaacaaattagagaatccgtccgtaaaccgtgagacgaatttattaagcctaattaatccatcatcattagcaaatgtttactttagtaccacattgtcaaatcatggcgtaattaggattaaaagattcgtctcgcaatttacacgcaatctgtgtaattagttttttttgtttatatttaatactccattcatgtgtctaaacatttgatgtgacagagtgtaaaattttgtcaggggatttaaacaggacctctatgttccatattgatcatcataaatgttaaagtcaatttacatgcataaatgcagtaatactacatgtgaagtgaaggggccaaggttatatgatgatcaatttggaatttttgagttttggttatatgatgatcaatatggaatggatggaatatatctttcctacgcaggaatatacattcttgtaataaggaaacgattcctaacacctaaactaaaacaaaattttctcttaagttacttttgtaatatatgcaaattatttttatactttattgaatttacttctagatgtctaaaaagtaatttaatggagtctaaaagtaactagatatgttatataattaatttgtaatttttcatcaaaatataatcatgtgatatcttttataaagatttaattgcaacgaacacaacagtgtaatcggatcttagaaaaaattgaagcttatgtggtaggaatatatatatattttacttgcttgatgaagtagaacagtgcactagttaagctagatttcccggaacaacatatatgcagacaacatatcatagctcgtaacgggatgctcgttaggtcaaaaatgtgcgtgcgtactaatttgattacacacactcttaaataagatagctttcaactaattctagttcatttattaacatatatcaagctgccatgttttgtttgtgcgaacgaaattattaccaagttactggtcactggcaaatgagttgttacttcctcgtttcaaattataaggcgcattttgttttgttaggatgagactttcactaacaactagccacccagtcacgcttcgcgtgactctgagcgctgtataggagttgacgaccgatcttgataattacggaataatttctatgagactattctctctgttctcaaatataaggatttctatattgtttaacaaagattatgtttgatcatataaaactttatatccctttaccgaggaatgataggagtttagaaaaaagttgagagtaggataaaaaaaattgaatggaaagtgagattgaaggtaagttaatctataaatccttatatttttgaataaattataaatatttgtgatgcttatatttgcagatagagagtagctacctttatgcttttttgaagggattaaggagagggcaataaaattaaatgcgagggttgtgttttatttttatttttgatagaaagtgtgaaggttatggttgattgagataaagaagtatatgaagaaattaaaaagataatggttgtagttaattgagatgaaggaatatgtaaagtaggataaattttatatactgtcgctgcgggtgaatgagacgagctgctggtgttctccatctgaaactatctgtatatgcaccggtgtgcaccgatggatgcacaggagctattcatctggaactttcctgatgtgtgattggtatacacaaatggatccaacggtccaattttattcctcctctcatcctaaggctattattcttcacatgacgtggcttattggttttagaaagcttgttgctttcacatatgtagattactatattatgatatcatttaaatgatacaaaagcataataataattaaatacttttgaatacaaatctaataataaatataattgtatcattaaaattatatcgtaatagaataattgttggtcaaagcctatcgtaagaaacaaaatatgtcttttattttaaaacggcgagattaatactttagtattagcaattattacttaacattaattaaatatgggctagtagcttttggagaagttttatctgtcatggtatactattttttcagagaagggtaatttttacccggcctttatttccaaccggatatatgcagccttttaaatttggaacttatcccctcaaacaagccaatataaaattcactcttacaaagatttgaactcaggaccttagggtgttactcagggcactgcaatcacttggctacatcatggtatatgatggtcaatatgcttttttatatgtttggtgaactattgtaatatagaactagtgccaaattttgatatagataaaacaagaaaacatgtttttttgtttgaaaaacagttggtagtggcattgaacttacattttagtgaccccaatttcatggcaatatgtacatctttctagcttgagatcaaccttccgttcaagtttctttccatcctctacagaatgtgtttggcgtgatcaaatgtacttagtacttttttttggtaaaaggatatgcagaaaaagaattgagattacagagctaccaaacctgagacaactccaatagttaggaagggcttcacaatgttaaacccatatatgactaactctcctgaccctggggctacctgcgcccatagaaaaattggatgcaataaggtaacatgaaatagaattaatgtacaaatcaaataattataattaagcatcccaacgtttcccatggtcactcatattcttagcacaagcatacattttatgctagatgttggcctaacatattaaatactccaagaactgctgaatttagcattaataaaatggtaaaaggtgacaaaactataagccagttctttaccatgtttgtcaaggtaggtcaatctgtgaatggcacttttcaagaaaaaacaagtgctgcactattgaccttttttccactagttgataagcttaaattatctctctaccttttttttcaaatttctttctctcctgctcttaagatagtaatgtgcttgtaaatttcatcaaaatggaagacaaacagatgttgagacttatagccaaaagcaacgcaaaacaaaactgaaaagagatagtagaaggcaagtcttctgtagaaaatgctggtgaatatggaacaattaaccaagaataaaacaaactgatacataatcttcatgtattcagattcacatgtttaagaggcagagaggcatatgcagagggaccaaccttggggtgtgctgtgaatggcatgttccactgaccatcgacgacccagctacacagtgtgccaagattgtccaagtcaatctcgtagggaatgtcattctctgccactgagaaaaccctctcggcgtgctcaaacacaccggtattactcatgtttctaaacaccttgccaaacctcagctacagcaagatatgcaattaatgatcagtgtcacttgaacactacgtaactacggtgccttagcatatgacactagaacagaagaaaatgctattatcaaatctttatgacccagagggtactatggttcactagagatgtgtggtagtggatcaagggcgaaaatcaaagaggacaaaattgaaattgtgaagttgcaaatgtttgtcaacatagaaaatactccgtgtttgtttttataagacctgtaattttttcaatcttcctgcaaaattgaagtcttgcaccatgagtttgttgaatatgttcaatgtttggacatggatattacatggcctctctcctgcatttatcagaagaatctcactaaccatgtcacttcagctatctataagaagtatgagaagcatggaagttttaactcatactccctgtggcatccctattttcaaaacagaaatcaacatttgaaaatatttttcttatgatgtcaactccgtccatacttgtttgtaatatattatgaaagaagccaatggtaaaactataatattgtataccgtgtagcaaactaatatgtattacttcctccgttctaaaatatgggatattcttgttttccataaagtcaacaattaaaattttgactaattattgagctaacaattaatatatctgtattgtgtcatgcatatagtgccattagatttgtatttgaatgtattttcatccgatgttaattttgttactattaataatatattataaacaaaattagtagttgaagaataagaataaggctggagaccgtgtaaaaggctgttacacataatattttcaaatagagggagtttctctttattgtaaactctatattcattctagctacttaaagtaataattatattttgatagagacaagagtagtaaaaagttccttgccgacaaaaacagagggtgcaagttatttacaaaccatgttcaaaatgctggctgcgattatggcaagagggtcacccttgattgctgagaggaagcatggtctctgacgatccctttcagtattaaaagtgtcagattgcacgtagcggttgttgtatgagactgaccaagtgtttccttctctgctcttggtgaagtagagggcatgcagcatgccttctccctcgacccagatgtcttcagactggccgaagattgagttcaccttgtgcaaggctccaaagagagggttggaacctgcattatattggttgagttttaatctattcagaactagagcaaattaagatcaaactttgcgaacctaataatagcattgtgaaaagtaatactgtgaactagcatctgagcacataactgacgtagcacaaaagtcaagagttaagggcttaaactacaatagttttcgctagcttgctagttgctaatgaaagattgaaagaaaattaccatttctgatataaacaccctcaggaaaatcatctgagatcgtcccttctatcctccatatctctgttcttccaccgatttcatcaactggtgcgaaattgctctgctcatggatagatccatcatataaattagcacttgcaattcagccatttttccgatagtccaaactacaccccttaactattggatttgtctaataatataagaaacatccattaactacaaaatcagatattttataacccctaggccttcaactattaaaacaagtcaaaattcaaccataaatgtaatgatattatacacccagttttagtagcggttttcatgattttcacaacaaaatatatattttttgacttatattaaaccactttctacctatctgtctaacttggtttttttatcgtactatttggatttcaaatcatgaatattaccattaaaatcaggttgtattctatttcatccggttatggtaatggaaagctgtaaaatatctatttttttagttgatgggtggttttctaagaaacagggagttcaaaagcatgtgatgaaaattaattggaatctgaagtgttctcccctctactatacctctaaattaaaaaaaaaaggttcaaaacaatttaatattatgatttcttttttcaggcggtgctcttcagcagccatcagcgaaaattggtttccatcgatgggaatataacaaacatgcttgtaaaaatagccctatatttataagtagaccccttaagtgacagccggcgataatcgattttcattggcggtaccactactgcagatttgattttttttctatacaaaacccacaataggttgtaggcagcccataagtgctcccgcatgcaaaaaccactctcgtgggggcgattgatgggcagcatgggataatccagatactgtgattatacgacaattccacaacacccccattctagacgaccatgcaagggtgcaggtagctaaggtccacgctgaacatgtcacgttcgagctagacatccctaaaccagaggggatcgaacttttgggagatgcaatgaaccagtttgtcttgtggcatcatcgagacatcatccttgccggacaaccaccatctgccctagctccatcccaaccaatgacagttgccgctcttgcaccgacctccccgctaggatcaccttccccacaagcttccttgcctctagtaaggtcaccacaccatccaccatccctaccagtttcgattcctccggtaacgtcaccacatcattcacgttctccacctacaccttctgctcaagtcccttgccctcccccttcgccacctaccgaacaaccatctcccattcaccaattaatctcctcctacaccacaatttgctctcgcccaacaagtcccacctcaccaagtaaatcaatctggccccatttctactacccttgaacatcgcaggctcatacgaaaattggtttccatgtacgaccacaaggaaatgtcaagagataaagagaggttcctgttttcaatcttcagtgggagaggttgggcaaagaagaagaaagaagatgttgctgagctgtaaaattcctagaagtcagtagtatgggccaaggatgagttgcaatcttggctatctgtagatgtgccccaagaatataaatatgacaagtcattcttaccatggtacattatgaataatctaccacgacagatgagggtgatgcatgaatggtacctcaaggtatctagaaaggccctaagcttcattagtgtcaaggtcccacgagacgatttcatgagtaaaaccaatgagatctttatcatcaatttccgggacctacacgccctcttcaagctcgataagatggacatcaatctcgttgttgcattttgcgtgtaagtgtttttacactagtttgttgtaagtgaaatgtgtgaaagaaacttccttttcaatcaagctgcattccataggtcacagttctacgacacagaaagagcgaggcaactcgttggctatatcgagccaacaaggatttgcaggccacacaacaaactgtacagcttcttgctaatagcccggaactaacagataagacaccggaggaacacaagcatatatcaagaaattgcacaaggaagaagattgaagtagcttgctacttgggaaccgcaattctcatgcactgagacaaaaacatcataatggtcccttacgctcttatataagcagcatctcttccatttgattattttttttcttgtaatacaagataactagcaaatgtcatctctaattcatctatcttgtttgcaggaccactatattttattcccggtatatccgagggaccacttggtcgtcgcgcttgatctggcacactatccaagaaagcctatatggagttcctcactatttcgaatttcaacgtagtaacataccacctcagtacctaattgccgttccgaaatttgaaagtaacacaaataaatgttttatcggcacagagcacgtaaattttatgtcaaacatcacaggccagtaaaggatgtgcagaggaaaaagcttcatgtgaagacggactggccggtatgtaatggcgtgtgccatgcacacaaattgttgtaatcattactatttttaaactgactggtgttattatcatgtttgttgtgtttcaagcaaccctaggcactaacctatgtggatattaagtgtgcaagatgcttagggtcaacaggagatgcacaacaaacaacaataacgtaagtccggagattgttctctacatagattatttagtcacatttcatttcctgactttcattgtcttcgttttttttcacagatccctcaaataatccttatgtagcaaaccggttcaacaaacaaacaatttcgaacatatgcgctgacctatgccacttcatatgtcgtgactgctgcaatgcattagggaatcctatcttaccataaaattataacccactaaatcctaaatcttaacatacaaagatatcacaacattatacaataatcttactataaagttataacccactaaatttaaaaacttaacatgtaaagatggcacatcatcatgcaataacaagatacaacatcatcatccactaacaattattatatttaaacatcatgcaagcatgctatattatctataattctatcattaattttattttagagttttaaaatgcaagcatgttaaagcatcatcccatatatttcacataatattttaatatatctcttcatcatttttgtaatatcatatatacctatatagttcatccttacttagttaattaatgttatttctctcttctctcattaagtaatatcacctcagttgtttttagccttagttgattaatctacagtccaaactatctccctcatttttttctctcataaagccacatcactttacttttacatttaaatcatcattctgtatactccttccgtcccaaaatataaacatttttgggtctcgacacggtctccgagatactactttgattaacaatatctatggaagtaaaatgttttaaataaaaagagttgcatattatgatagttcatttaatgataaatatagtaacatcaaatttatatgattaatctttttagtttttttgctattaatagtcaatatttaaaaagtttgacttggcactattctaaaaatgtttatattttgggacagagggagtattatttaaatttaaaatatcataaaccccatcaacttatgtaagtttatactatctagtcatcttacgcattattttgactcattgttattatagtaaattcccgtagcaatacccgggattcacctaatttctacgattatcagagcgaactgggcaaagaagacaaattcaagcccctgaaagagagtaggagaaagaacgtatacttataataattatacacacatatatatgtacctcggtgggacgcaaagattggtgactgaatgtgaaggtggagtccacaaacgcatccagcaatagactggaagccatggttactgccgcagatgcctccccaagtttggtggtaagctgctgctgaaactccttgaaatgtggctgcaagtatatatatcgacaacgcaattaaaataggatcaacattagaggaggggaggtcgttcttacattggatgtgatacatttggtgaaatgatcagtcgcattaggccttgtgattgatggtcttggtgttccagtagtgctgctccttctgcacaaccatggttggagagtgccgccatacatggatggagatgctgcggccaccatattgatcgtacgtacgttgtgcgcttccttgctatctaatttgtgtgacagctacaactattgtttcatccactctatttgtcagaggaattcggcaagagacgctcacttttatagtaacctagtagctaagtactaccgtcgaggcatgaggcatccatgcatgggcgcatgtgccgtatttaagacagctttgccccagtaatcaattgtatggtatttttaggacttataaatttgaccacgcggtctatgatattatcacatgtatttattagataaattttatgcatgcattctttcattttaaaacagtatttgaaagtttttttttttgagaagtatttgaaaaatattaatggttgaaatttcatgagtccattaactaagctttgtgtatgtcagatatatatatagttcgatcggatatacagtgtgattttgcaatgcgaacatgcatggtccattgactcatgatcgagttaatcaaagcagccacacagtaatgttgacttcgatcttggaagccacagtagtgtttttggtgtagaatctggcattagttcacccttcagcaaccaaatttgacgggggatctatggaatgattgtatataagacaacgcgcagggaggcggcgcctacgtacgtatggcgacgaccagggcacacgtacgcttatataatgtcacgcccggaaattcactagtaatttccgaacttattagtgcataaaatcctcgtccagaaatcagccgaggtatacaaactgacaatttaatatacaaatccatcataataataacgttacacacttacaaaagaaaagaaaacagcagcggaataacggtctagcgatagcttcagctccactcccacaggcagctcaactggggtataagtcaaacgtcttctccttctggatcctttttcttcaactgaggttgattgattattgcaagaatgagtataagccaaacgtcttctccttctggatcctttttcttcaactgaggttgattgattattgcaagaatgagcatatgacatactcaacaagctacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctacacaggcccaaccatcctgaacaaccatacccggctgtacagatctaactccaaaccaggagctaagcaaattattaccaggtataacatccataataattgtgagaggtgtgagactaatcacgaaaaacattgctcaacccgcccataaccgcgggtacggctattcgaatagttttactctggccagaggtgtaccactgtacccacaagacacagcctcaacatcatgtctaccatgcgtcgcgatactggaaagtacccgaatagaggctgtaacaataccctctgcacaacacaactcaccacagtgcaccattcctggatcataattacccccttataaaacagggcatggactccccagcgacccccgtgggcttatctccgccacttctcagtctggtgctccgcaatgaactatgctatacaaaaggtaaagccgttgcccacgctggcttgtggttggcacggttaatgtttcacaacagtagctcgcgaaccggtccttcattgccatgagcacgaccttcaaaaccatgtgcttacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatctaacatctagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaggctaacacgcaaaaccaagaaaaagactaataaaaaccaaataaacagtaaaaaacaagcataaacagtacatataaagtaaacaaacatgtagatcatgattttgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggatgcgactttggaggacatgtacacgtagaggacgacgagacgaacccaacggtactcaccctcgaaccaaacgacgaacaacgacggccggcgacgaggtctagcggcggcgcggcttcggtcgacggcggcgacggggctccggtgaccggcgacagcgaggagggagcggccgagcttgcccacacctcggcgcaccttacggcggtgacggcgaccggcggcaacggcggaggcgacggcgcgacacggccgaagttcggccggcggcggcggcgaacttggcggcggcggcggagaggctacggggcacgggagaccacgggagtggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttggggtaaagatagaggaggataagaggaatatttcccctcaactaaattggaaaaaggagcaacggggaggcgagatttggaaggaggaggcggcggcactgtgcacggcacggctggctcgggctctgcctgagttggaagatgaacagtagtgcagggaaggaaagtagacttcttgccgggcttttcttttctcagcctgattagaagagggagcaaaaccggactttggctgagagaagaagagaggatgcaggctcgggttgggccggcggaagagagaggaaggaaaggaatgggccgattcagcctaagacaagggaggagaattttattacttttccaattaaaataatcacttaaatgatctttgaattgttaaaaatacttccaatgctcaaataatttcaagaaaaatcctgaaaatactgggacactcaaagtacttaacaaaattataattagaccatttaatggttaatttaatatgtgggtaattactgaaatgctctttgtatgattaaaaattaggaattgagctccgaaaaatccgagaatattccagagagtataattaaccatggagaatttaataaaaattaaatccatccatgctttaggaaattttatctcccacatttaatttcacttgtaaattaatgaacatttaatataaattctaataataatttattaaataatttataaatcctgaaacaaaaatcaggatgtgacatataatgtaggatcgaatcacaacaactaagccaaccagaagggggtgaatggttgatatgcctaaaaaccaaaacttttagtggaaataaaagttaccctcaaattcgacggatcgcggtctgaccgaagtagttccaccggtctaaccgcctggaacacgccggtctgaccgagatcgaactccggtcgaaccgctgagatcgtctgccgctccctgtcgctgccgcccggtgtgaccgccttgtgcccgccggtcttaccgccatgatgccgccggtctgaccgccggtgcgccactggttagaccaccgaaacccggtgaaacataaatcgaagaactcttaaagtggatgacaattttattgattctctctgtgtttacaaagtgcaccaatagcactcattacaaaaatttcgactaaactcgaaaccctaactcaactatcaactcaattgctctcaaaagcgataccgggaagcctcacgctccccctctatttatacccgaggtaggcagcctaaagccacgaaccaaactcatgctagaagtcctaatcaccctaggaaaccctctagtacaagaaacaaactttacataaccaatcataccaaatttggactccttccaaattcgactccgcatcccatacgcacacaatacctccatcgtatgccatatggaatcttcaccaaccatgtgcattgaactctaaccttagtatcccgcatgatctctgaccaccacggacgtcgtcttatccccaagccgactcccggtccatcaccgcaaatactctcccagcatctcgagtcacctacacatagaacaaacaaagaaaccaaaccatattccgagaccaagctatccccaacatgactcattagtagcaaacggcagtattacatacgcatagtatccatctagaagtcataacaatgaaaaaatcacagatatctaaataaacaacccgaaaccgaaaccgacacagcgtcggccggtcagaccatgggctgcgccggtctgaccgcgtgatacacgccggtctgaccggcaacccatgcccggtttgaccggacccaaatccagcagtacctgtagatcacctatgaaatagaatcatctccaaaaccacttcgcaaataaattccaaatcacaaaaccaataatctccaataccaattgttcatcacagaataataatcaaaaacacttttgattttacaatctcccccttgataaacacattggcaaacttatcaaaaatgttttggtgtttggaaaaataaaaacaaaagtggtaaaaagcacacttcatacaaacgtacacatcgtgctcaaaaatccaaaagaaaacttccctcacttttgaaaagaaagaaatttctaatcgaaccaaaaacaacatgctcttctcaactcatttgcttctccaaaaattttcaccttgcttctcccccttttgacaatgatttcatcaagcataggaattatgttcattaatgtttaagagcttagcatacatatagcatatcaagtcatgtgttgcaataaagagaagatgaacccatctataatataacaagcatgcattaaccatgaaccaaagattttacaattaagcttgaatcaactatcaaaattcatgatttcatatgatttataatgcaacatcttaacaagcacataggttgaaaaataaacactaaacacatataccaattgcattaatcacactttctcagatgagcttttgcacaaaacaaccaagagaatttttttaacgttttctttttcttgagcctttttgcccatatttttctcttttattcggggtacgtccctgtcgtcaagactgtttccagggatttggtacccattattttgctcacatcgaatacgtccttatcgtcaagactgtttccaaggattcggtattcatttttttcatattttttattctctttgcacaacgagcaattaattcaataaagcatataagtagagcatttatagatcaaaccatatgctagcatcaacattgcatattagcttaattcaagtatagaattaaagtgtcatgcatcatctcccttaaaaacaaaatctaagtctcataaaaagactagaatacatacaagctatgctagagacaaataaaccttcaaagtattgctagcatgcacaagaaaataccatatgtatagatcaaagctctcttttctcaatttttctcattgtcatattgttgcttgataaaaccatgtgatacaaaactcccactcaaatcatgccaaaaggatgaattattcccaattcaccacgaagaaaagcaaaacgattagaatccaaaggtttagtgaaaatatcagcaagttgcaactttgtgtccaaaaactagaattcaacatctcccttgtcaacatgatccctcaaaaagtgaatacgaatatcaatgtgctttgtgcgtgaatgttgaacataattcttagcaatatttatagtactagtattatcacaaaagagaggtactttctcaaaagtaagaccataatctttcaaagtagattaaagccaaagaatatgggaacaacaactagcagcagcaacacattcagattcagcagttgattgagcaacactagattgtttcctagaagaccatgcaatcaatgatgtaccaagaaaatgacatgttccactagtacttttcctatcaattctacaaccgccaaaatcagcatcggaatatccacttaagcatatagaagatgaagtagaataccaaattccaaactcgagtgtatgattcaaatacctcattattcgtttgaccgcttgacgatgtgaagcatgaggagaagcttgaaagcgtgcagacaaacacacagcaaactgtatgtctagcctagaagcagttagatacaacaaaaagattcaatcatacttctatactccttttgatcaatagcttcaccatcttcatcaggatccaacacaactgtagaaccaattggtgttgaaattggcctgcaactctccatcttgaaccgtctcaaaagatcctttgtgtacttcgtttgatgcacaaatataccttgagatgtttgcttaatttgcaatcccaaaaaatacgataactcacccatcatgctcatctcaaattccctgcgcatagtctcagcaaacaccacaaccaaagcgtgagttgaacaaccaaagatgatatcatccacataaatctgaacgaacagttgattatcaccatgcttaagaacaaaaagcgttttgtcaatcattcccattgtaaaaccttacgcaagcaaaaagttcttaagcctatcataccatgctctaggtgcttgtttcaaactatacaaagctttagacaatttaaaaacatggttgggaaaatcaggattttcaaaacctgatgattgtttgacataaactt

SEQ ID NO: 60446 - DNA, 6938 bp, Oryza sativa
cctgcagcccattcgagaaatacacgtaatcaaacgatttgtttaacctgacgattttctccttgacccatgaggacatgagtcacgtcgcaccattaagctccaaaaaatatgagacaaaattgctgacaggatcacaggattgggttcagtctcgatttgccgatcgaacccttggaagctgtgggctaatcacaggtgcatgtggcacacagtaaattgcactaaaacagagggctaacttgtcacgtatcgcaacttgcaacgtacagtacccttttgtcggaaaaagttaacctaaatttagatgcgatgtaaactaatacaataatctaaatatatatttttttaaattcattgtactctactgtgtcataacaaattctagtttatttgtttttcctttttgcgcaggaagtaagttctcagagcaagtttaacagatgaactcactatcacttatcagtctatcttagaggggcgaatgcctttttctcgtgaaagggagatgcctaatcgtatcggttactgtgtgatagtctgacaaccatatggcgtcccatgagaacaaggataaatcagctataaacttatcttaaaaaagagaaaaaatgcgttagctctcgtatagtaagagttaactctatacgtgttttaagataaacacattgaatgtataagtaagagaaatagtgaagagaagaaaatttaaaggtaacttaatctattatatatatatatatagtaaatttgtttggtgctccatggtgcccgggcaccattgttgaaattgagtatatacctaattcaaatgcaattaaaactttttcaattacttaggtattaacattaactactttactaacaagtttaaagcaagtttgaactgaatttgaacttgtttttgttagatgttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatatatatatacagtgactggaaagtatcaacggccaggcgataattacgataagttgatggctgcaagcagttggcctgctgccggattgctttcgatcaatgtcgctagacgctgcacctgattaagggtattcccaacccaattactatgatagtgtccaaagtattaaataagttgtcacctagaacaaaaaaaatgatgtggcaagtgaataaatgaagaaagagaaggaaaccatgtcttatgtaagacatggtttctacacaacattcaagatatcatgcgagataatagtgttgtttgcattgaaagagtagtctctagtactagtttcttgatgatgtggagtttatgaaaaccatgtctagtgttatgggttgggactgctctaatgacgtgtatagacgaaatctccgaaagcaaatgtatcatgacagttataaatatgagagttttcttgcaaaatcatgtaaagttataaatcctgcgaaattttcctcaactattaacaactgccatacgttgcaacaaacttatcatcttcgtttcaaaataaacttacagtacttaataaaaatgtgacacaatctagtacaacgaatctgagcatctctatccccatacaatgttagctataactacaagaggaggaccaagacaacggagagagatcccatatcaaaacttcaactcaatatccagttgaattagccagagaaaagctttcccaaatcttgtaactttgcaaataagagatccaaagatgaacacgacaggagtagaatgttacatttccgagcgatcgatctaaacctatatgaaccacatgtttcattatttttcttccaaccacggactcacatctgtacacatgctccctggctgaatccagaaaggggttggacatttctatgctattggaagtttggaactcaggctccggttgctcgatctcatcgtcgtgggcaatcaacgatgtttctctgtcagacatatagaagagaaagctctcatttttgcatgcacatttctcaagcgaccagacatcatgtttttttaaaaaatataaaaaatattttaaaatacatcaatttatattaaaatttaaaatagtaaaatacttcactaatcgtatgttacactgtaaacttagccaggtatcgtaagcgcgtggtaattggagttgagacctgagacgtggcatctggcacgcgaatgagtcacgtaaattggccttgtttagttggggaaaatttttaggtttggttatcacatcggatatacagacacacatttgaagtattaaatgttgtctaataacaaaacaaattacagattccgctagaaaaccgcgagatgaatttattaagcctaattattccatcattagcaaatgtttactgtagcatcacattgtcaaatcatgacgcaattagacttaaaagattcgtcttgcaatttacacgtaatttgtatattttttcctacatttaatcctctatgcatttgttcaaacgctcgatgttacagcgtgaatttttttattttggaaacttaaacagggccatacgagaaggaaaaaaaaaatccgcgacccatcggagcaaaaaccacaccggcaccggcaccgcgcgaacggccgcggctcgcgccacgccgacgctctcccgccacaaccgcgggattccccccccccccccccccaccgaacttacctaagcgtcgcctctcgtcttttttcccgtgcaacgttgcaagtgaaatcatcaatcgtgcgtgcgctgcgcccgaccatggagctcgcggtcagagcagccgccgcggcctcctgctcctccggcgcctcgctccagctcccgcgggcccgagccccgctccgcctccttggccaccgccgcctccccgctcgccgggtggctgtcgaggccgccgcgatcgccgtcgagccggtgagttttaagtcatttgatgttgccgcccctttgcctgacaggtgttcggcgttatgcggacctggcagcaggtcagctactaggtggtctggagctagtggaaatctcgcagcgattcttttttttttcttgcgcactgaggcgatttcttgcctctgctgtaaatggttagctgtttctatctcttctttgctataagtgcataggaggccatatatctgcaaagaagcttcgtagaatactgacaagatacattatctgtggatgatcagctgagaagttacatggacttatggacctataagttttttgagacttgagactagtgaccacttgggtaaattgggtttcgggtacatgctgatgatgactagcagtaacggggcacctacatataccatggtggttttgacttctgcttattcaaggtgcccacgtatgctggggcagagatgggcttgtcaataatcacattgcgtctgaatgtctgatgtttctcattagaccctgccctgctgtttgtgtgttatatcttggacttttggagttccaacctgacaataacgatagcctttttcgttctgtgtgaaactaaagaatttggctgtagcttctttgaagcaaaggctggaatgaattccattattaaaaaaaaaactgaagaattgattgtctctgtgttttacacttaataggaaaacaaagtaccgcagagtaacaattcagaagccgaggtgtttgcatgccctgtttgctatgagccattgataaggaaaggcccatcgggcataaacttgtacgtacaatttcatttctacattatgttttgcatgttttgttagattggcatttatgatatgttccttttatgcatgctccaggccatcaatttataggtctgggttcaaatgttcaaagtgcaacaagtcattcaccagcaaagatatcttcttggatctcactgtcacttctggaacaaaagaatatagtgaattgaagccagctagaactgagctgttcaggagcccactcgtctcatttctttatgaaagagggtggcgtcaaaatttcaatcgaagtggattccctggacttgacgaagaggttcatttctaggacattcccttcgttgtttgatatctcggcgttactaaataacaaagtctagccaacgtgacctgtggtgtaatatatttctgtttcaataagtaaagaagcaatgttaattcaccaagtgtttactatagaacataatcatttcttatgtatgtttttctgatctgttgttggtttcatcagtttcaaatggctcaagattatttccaatcagttgctggtggtgtacttcttgatgtaagctgtggcagtggcttgttcacaagaaaatttgcaaaatctggatcgtactcagctgtgattgctttggacttctccgagaatatgctttgccagtgttatgaatttattcagcaagatgatactcttgtaaacacgtgagctctcttcttcatgtctctgaatttcgttaatatcctttctgcttttcgtgtgagtacaaaaaattacagcatatgtcacacaaatgaaacaagacataaccttaaccacttctaacataaatatattatcaattaagcattttgcagagcatcactttgtctgtttgaagttactagtttatgtagtttaatttaatctatgcatcaattaccaggcaacacaaaaattacgtgattaacatccaaatgaactgcaattgacacagaattctattttctccatctggtgctttttaagacaaatactccaatctttatttagttcatgccaggtgcacaactaactgttttcctcttatgcttacacagaaatcttgctcttgtaagggcagatatttcgagactcccttttgcttcatcttcaattgatgccattcatgctggagctgctatccactgctggccctccccttcgaatgcggttagtatctgtccaatttgctctcatgattaaggtgactaatttggtctgtatagcagtattggagtctccagatttatgataatgaattgttctgtaaaactgtcatcactttaaactgctttcacctgaatctctgttcttctgctcctgtttaattatcaggtggctgaaataagtcgagtcctgaggcctggtggtgtctttgtagcaacaaccttcttatcttctcccaggaacaatcccttctctgttgaagcgttgcggccactgagacaggtaactttttctacttattttctgcttatctaaccctatgagcttatgcagtcatactcacattgctgctttatatactgcagattgttggaccagttaacaccagctacaattacttcaccgaaggagagctcgaagacttgtgcaaatcctgcggtcttgttaattacagcagcaaggtccagaggtcgttcatcatgttttctgggcagaagccgtagcctaaaattacatcaaaacctttgtagccaaagtatagctgtcaattctacaaaagtctttgtaaaatgccattcaccgatacctgcatagattagacccagcagaagtttttgcttggaattcctctccctgttatgaagatatagttgtcacatgtatactgtgcttcagtacagtgatgtaccacagccagggtgtatttcacacctggaagaaaaaaaaaacgttctagtactattttcccaacttgtatagggcctcttttggaatggaggattttttcaggaattgaactataattcctgtggaattcctataagattcctacgttcgaaagggccttaaatgatttatttaggcccataaactttcaatctagggtttataagtttgcaaaatttatattagtactacctccgtcccaaaataagtgcagacatgagtttccgcgcccaactttgatcgtctgtcttatttgaaatttttttataattaacaattttgttgttataagatgataaaatatgaatagtactttactcgtgacttatgtttttattttttttttcaaatttttttcaaataagacgaatggtcaaagttgggcgctgaaaattatggctacacttattttgggacagagggagtagttcactacaagtccaatctgccaaaaggttacatcaacatgttatgtgtgaatagcgaccagagttgagttgtgggactggggacaatcagaagacgggggcgtctaagtgtctactccctccgttcctacaatataaaggattttgagtttttgcttgtaacgtttgaccattcgtcttattctatttttttttcaaatataaaaaacgaaaagttgtgcttaaagtactgtggataataaagtaagtcacaaataaaataaataataatttcaaaattttttgaataaaacgagtggtcaaacgttacaagcaaaaaaaactttaaatcccttatattatgggacggagggagtaactattagccatgtttagatttggtgtttaactattagtcactcatatataaataacagctctcatgtgtctttgacataggggtccagtgacaagtgacagatagttaattgtcacaaagtggtaaatatttaaatctctcccagaaaagggctggagagaggtgatccgtccgcccatgggctgctataaaaagagtgacggcccatctagtgggaagattgggccctccaatctaacgtcggttcccaccgcgtaaacggcccagatctcacgccagcccggcccgcctgcgcccgcacc

SEQ ID NO: 60447 - DNA, 7501 bp, Oryza sativa
cggcagtggcattctctttttttttaatttgtgatgattcactgagatgtatttgactgagaagttacaaatttgtgattcattgtttggatctgtgatgtatttgagtaatttcttaggatattgtgatgtatttatttgtgtgtataagtaactttgatttgtgatgtagatttgagatgttacttcgatttgtggattgggggtttgatttggaatatgtatcccacgtgatttgggagaaaataaaaaagaaaaaaaaagaaaaaggggatcatctcactgccgtaaccctctctttagtcccggttggtgttactaacagggactaaagatctatttttagtcccgggtatttgaactgggactaaagatagcgatctttagtcccggattggtagtcccagtttgaaaaccgggactacatggggttgcgaaccgtgactaaaaagcatttctccaccagtgcttcctcctactctgaaaattcaaatatatattctcgactattctagaaacaaaagttaataagaggctgtgcctctgtggtggtactatgctgctgtgaaacatgtggaaattagtcaaacaatagtcttattatgtgtgacttctagtattcttatgcgtttggattagggcataaactgcagaggagccacagtgaagttgcattaggcccatctctacaccattagatgaaactccgtgaaagtccaatggtccagatcaggttctacagtaaaatacgctacagtacaccatctgacctgtcatactgagggttactgtttctacggtaattaggtggtaccccgcgctttgctgcggattcatagatgagtatatgttaaatattgtcgaaatgatgaaagttgaaatgttgagaaaatagtgcgaggaagatgatttgacacatacttgttgatctctatgatataatattatatatgacgtgtcatgtttgcatgggaattaaaataagctggaatagtaattgctagtgagtgaagatgtgtcatgcgtgcatggaattttaaatgggctagaatagtactagtgggtgatgatgtggcatgcttgcatgttgagctttagcttctaataattgttagtgggtaccaattatatagaaagtatagatctactgcagactagtatggctaaagactcaagacactgttgtaatagtgtctttctgctgttacaacaaagactagggctgtcaacgagcgagctcggctcctaagcacaagctcgagtcaagcctattgcaccttcgagcttttaggcaagctcggctcgagctcgttcgagctcgagctaagctaccgagctcagtaataagtagtgtaagatatattttagtgataatccattgataagtataattattttctaattaattaataaaagagtaaaaaatgattaaaataaatatattgtgctaacacatgctaatttattgtgtaaatagatactaattaatatatatatatatatatatatatatatatatatatatatatatatatatatatatatatatatatatccattagtttattaaatcaataaggtaaacaaacaatataaactatacgctatgtataagctcggtaaactcagtagaagctcaagctcggctcgataaagctcgcaagtttttgctcaagctcgggtttggctcgtttggagctcgaatcgagcctagaattagccaagctcgagctacttgcaagcttcgaccttttttgacagccctaacagagactattattatacaagttctccctcgtaatttactccattcaaattcatattactaacatatgtctaatttatactctctctccgtcctaaaatataagcatttgtaggatagtattaagtcaaacatttttaacttttaataattaataaaaaagattaatcatgtaaaatcgatgttactagatttatcattaaacgaattatcataatatgtaactctttttatttaaaacatcttatttttatagatattatatattgatcaaaatagtatctctaagactatatcgaagtctaaaatacttatattttagtacagaggagtttcgtatattttcagacggagagtaccagatgcgttcaggaagtcttgacattgcattgcatgtcgatagcatcgcatgtcgatagcagcttataaataggcaaccacggacaagacgagcttgcagctatctactgtagcaaccactgtaacgtgcaacacttcagttcagcagcaaagcaaataaaaacaacacaaagcttctctgttctttctctcctcacgatcgaacaccatggcggcggagctcgttcacctcctccgctatctgttctcggtacccatgctgttcttcatcgtccccctcctcttcctcgtctgttcgccgcggcgccgccgtggccgcggcagctgcaggctcccgccgtcgccgtgggcgctcccggtggtcggtcacctccaccacctggcgggcgcgctccagcaccgcgccatgcgcgacatcgcgcggcgccacggcccgctcgtgctgctccggctcggcaggctccccgtcgtcgtcgcctcctccgcggacgccgcgcgcgaggtcatgaggacgagcgacgtcgccttcgcggcgcgccccgtcaaccggatgatccgggtggtcttcccggagggatccgagggggtcatcttcgcgccctacggcgagacgtggaggcagctccgcaagatctgcaccgccgagcttctcagcgccaggcgcgtccattccttccggtccgtccgcgaggaggaggctggccggatgctccgggcggtggcgtcggcggcggcgcagacgacggtgaacctcagcgagctgatgtcggcctacgccgccgactcgtcggcgcgcgccatgatcgggcggcggctcaaggacagggacacgttcttggcgatggtggagcgcgggatcaagctgttcggcgagcagagcttgccgaacctgtacccgtcatcgcgcctcgccgtgctcctcagcacaatgcctcgccggatgaaacggcaccgcgagagaatgacggcctacctggacgccatcatcgaggagcaccaagagagcagagcgtcccgggaagacgacgaggacttgctcgacgtgcttctcaggatccagagagaaggtgacctggaggtatccagagaaagcatcagatcaacgatcggagtaagtaccctgaatccataaataaagcgtttaagaaaatttcaagtgttgcaaacatatataaatttcaagtgttgcaaatagacacaaataatggaatttcgcgacttcatgtgttttttttaacagtgatgtcaattaattaaactagggtattgctctgcagtttgcacgaatctagataattcacgtagagttagatataatatatagctctgaaattttatttctatatatactagaaaaaatacccgtgcgttgtaacgggtgaagtctattttaatcttattattgttatatggtttagttaagataaaattcgttatgagagtttgcttggatatatatatatatatatatatatatatatatatatatatagaaaatcatgagctgcaggtaggagcaggggaggatccaacatgggtgcagggggacttgagtcccccaacacccaccagacccatggatacccccctgagttcctcctaaaattttttcgtcgtggttgataagataggaggtgctaaaggtctcttaataacattttagcatagtttaatactgagattatgtgtttatatcggtgtacacggtatgttgagtcccccaactttttgttcctggatccacccctggttaggagtccgatcgtctcaggttagcatgtgagtttttttaaacagatttcttatatgattccttctgtattatcaaaagtgaatgatcttaaaaatgactcaaatgcggatatgtattttcaaaagcaaacaaagttaaaaacagactcatacacggatggcgtaccatacaactcttacattctatttctataggcttaaatttcatatacaacccttaacttatatttctatagatgtaattatattttgtatacaactatatcagtcaaactataccattataattaatctgaaaccaacaaaatcgggtagttaagatcattttttttattaatgaggaagtttctagcatttacaacagacgtgatgcctcacttcaaaactgttttaataatataatagattgaaaaaattgttgccattgcattttccatgaatatatgcttacaagtaatgaaattttggctttgtatcgtgtaggacatgttcattgggggcagtgagccaccggccataacactgcaatggattatggctgaactcatcagaaacccagaagtgatgcaaaaggtacaagatgaggttcgacaattgcttgttggacagcacagagtcacagaggaaagcctaagcaaactgggttacatgaacttagtcatcaaggagacgctacggttgcaccctccaggaccacgactactattgcgagtgtgccgaaccacttgccaagtgttaggatttgacgttcctaaaggaacaatggtgctggtaaatatgtgggctataaacagggaccctaaatattggagccaagcagaagagtttattccagagagatttgagaatgctggtattaatttcaaaggaacaaactttgagtatatgccatttggagcagggcgacgcatgtgtcctgggatggcgtttggtctagcaacgttagagctcgcacttgcgagtctcttgtaccattttgactggaagctacccgacggggtagagattgacatgaaggagcaaagtggggtcacaacacggcgagtacacgaccttatgcttgttcctatcatccgagtgccattaccagtgtagacgcacgtagctgctatctacgagttattgaaggggaaaatatatagtgcaaacctaaaaactagcataggatccaaaaatagacgtctaagatttgtctacatcacacggagtaaaattttcactccaaattttaaccatgagtaaaagttttactcatggtgatgtatatggataaatcccaaacatccattttttctattgtacggtaattttcaggtttgcactgtatatagagtttgcgctacatatttggatattccccctagtgaagcaccccaacatctttgggcactactgttcatataataagagtttgaacccaaacaattaattatttttggaaccagttcaattggctgtgcaacttacatgtgtaggccccattatgtatttgaatatatagttctatttgctattcatccttatcatttgtttatatatagttttattatcgtctcttttccatacggttctaatggtttgggactcttttcgagtgcacttatatttttcatacggttgtaatgtttcgaaaaactatctaatacatacaacaaatcaatctacatatgcaattcataattatacttccttctaattaatgtggtagtttctatcgccttgtgtgtaatttgcggagcccaaatagctagctgatacatgcaggggatcatgtagttcggttgagctgctaaccacagatcttagatctgtctaaacgttccgttcgaacttgcgatgaatgaacattaagtacgagcatacaaaacgataaatgcattagctcatgattaattgagctttttatttaaaacctaaaaatagatttatctgatattttaaaaaaaaatttatatagaaagtttttgtatgaaatatattgttttatcagtttaaaaagagtgataaaaaatcaagataaaatttgtatcttaacgcgtaaaaaaaagacataagtccgctaaactttgtcgcgaagtttgaaggaactctgaactctggagtcccctaaactttggttagtgaatggaatggcagaaatggagggattgctagtggatggtagatggagcatcaagaaattacttgaagcgttcaggtttgcatattttaatggtagaatgtaattgatcatgcatacatccacagtcaaatggactgagaacccaaacaacggttttcattattattattattattattattattattattattattattattattattattatcattattattattattattattacaaatggaagtataactttcggtctatgcatcaaccaagaatacacacagccatatttcggtaggatttcaacttggtaaataaagtcaccacatcgatggtagatttgcaaatttcaatcagtcaagagcggatctagcgtgggacggtgggggctcgagactcctactggcaataaaaccatgagagctcccataaaaccctcactaatttttttttatcatagggtctgttcactttgccaccatcactttcagccctaccatttcttttgttactaaaatttggtaaggtaacaaactaaacaaactcttgccatcatcactttactaaaatttggcatttcctaaaacttcttctcatacaaacactagtttagtaagaacacatccatcatatatagtcaaaatttgagaacgccaaagtgtgccaaaaatttaacattgtctagcttattcaaatccctagctcactattttttcttggatctgtcactagtcacatctaaatctgcagcctgcaaaattctgcaataaaaacggtcacgtttttaagtgttctgctatgcagaacaattctccgagaatactgggtgaaagcgtatatgcaccaattacggatgcaagctggaagatactccaaaaacagatctgggcgtcttccatagtttcagaactgaaacatgaattcgatcagacatgtcatgcccagtctctgaattctgatgcctcaaatcactcactacatccccgagactaaaatctgccgcagtgctgccccgttggcccaatcctgtgcaggcccaaaaactttgggctgtaaatcttggtctccatggaccaacgagaccaccgtgcggtgcgcccatgcgaaaattaaggagccatatagaactactacgtcggcagcgataactgcacgtttgtggcagatccagcggcggccctcctccacgcggatctagcggcggctgcgctcccccgcaccgatccgacggcggccgccctcccccacaaggatccggccctccaccgtcctccctggcgcggatccggtgacagagggtgacattggtggtagggtggcgaggcgaagctcgttgactgctatagcgacgacagactacggcttgtgagcacgacgacagcattggtggcggcgacaaagagctagggattgggctagcggcgggctatggtttctgccggtggcaggctagggctcagggatgaatcgaggagctaggggtttcaaatttgattttt

SEQ ID NO: 60448 - DNA, 3678 bp, Oryza sativa
tgtccccgccgccatcgcgctttgagattcgtgcgactgacgttggaggcccgtacgtggcgcggatcgaggggaatcgcccccccccccggtccctggctggactccacctctccgcgacgcgctcctctcctggcgaattttttgtttatttatatttgggagtaattggctgcgctcagctccggtccagcgcccggcgaattccaccgttagcgtcgctagggtttcggtggcctgcgcgcccggcggtgggggggggggggtctggcggtctagggtttgcggccgcggcttgcgccgtcgcggcgcggaggcgtcctcgtcgttgttgttggtggggcggtggcggaagccatgggcgacggcgagcgccgcgaggacgagaacccgaccaccagtgccgcaggtaagctcgattccacggagcttgttgccttttggtttggtttctgtggtcccgcgacgcgagcttcgatccccgggtgggactgtctagggttgtgaattgctgcgacgaggaggcagggttttgatgcgattcggtccgcgcgcttgtgtacttttgtgttttttctgtggccaggcttacacattacgctgtaaattcggtgcctggtaatgaaggttggatttgatgagctgcagatttgctgtctggtgtcctatatatatatgattagatgatcatttttttttgaaagtttaggaggggtttggacaaaagctgtttctttcagcaagctccccgtgctgtcttatcaattgtcatgaactttctaagccctgaaggaataccagcatgctagtatcttttactatataaatagttatgtattctttccgttttgaattgtgactggatagccaaccaatctgggtaaaacgagatgcccaagatcatgcaactattgccacaactgattactatatatatatattcattttagagagcagaattccatgtccagttgtactccagtttcctcatctaaatatggaattcataatacatatagtaatgatgaattaaaaaagatcctttagctggataagggcatactttagccaagtgaattttcaatgcagcatgcatggtgctcattcctgtgtctactagggaagtgaagctgtagaatgaaacaacggactgtctaagattctcaattgccaaaagatcacatgaaccctctgagaatcgtttatggctgcaaagcaacattcttctgtttatacatgttgcattacaagagtttagcatcattctgcgagccttttttatcagtctttctaagttccgaatttgactttgttgatgagatgtcaattctttaaaatctgaattcataataacaccatctgtttttgtggacaataattttaggatgtgagttgcagtgtggggatggacaaaattgcttttaagttttaattgttttgtccttttcttctacaatctggattattgatttgccataataattgatgagtgttgattagacttgatcaattagtactgagttaattgatccaaccagttatgctgttgctatttttgttatcctttgcagatgacgatgatgatgaggattatgatgaacctggtggagggaatcacttcttgggcttcatgttcggcaatgttgatgattctggtgacttggatgctgactatctcgacgaggtagttgaacaatttttgaaatggtggaatatcctttttttgttacatgtttttttaataaaaaaatatcatgctgcctctagcagatatactgcagaatatgcatgttagttagcatttctgtgtggataccctgtgatttctcctagatgatatagtccagtaaagaacttgttaggtgggaggcaattttttatttgccactgaatgattcacacaattcctttacactgagatgtggacagagtgtgcaaattaaaggattgggtaaatttacagcagtgtaggaggaatatatgcaaaataaaaagtttgctcaatgtaatattgatgtactccctccgtcccaaattataaggcctatatttttttacacggtctacaatgacatactctgaccattaatttatttcatattatgttatcaaacaactataaaataagtatcacaataaagtattttaaaatacaaatataatgatataacatgcatcatacttagcatagatatagctagtgtaattattagtcaaaatttattgagtttgattttccttgatacaaggacgccctataatttgggacgtagggattattgttttggcagtatggatgtagtcctttcatctcaccactcaccatcataagttaatttcttggcactacagcagcatggacctacctctaatggcggtccattcactacattttatttaacatgagtcctttatttttttccctgaacatttaacttttatatatttttctaattagagttaccaatttcttgataggatccaacataagtactgagcatcttataccccacaaactaataatgtgtcagtattgattttgttaccacacgtccacaccattggatagagttagtattgtatacaatgaaataagttatagccgcatttctgttgtatcacttctattttccttgatttaccaggatgcaaaggagcacctttttgcactggcggacaagcttggcccatctttgaaagacattgatgtatgctatcttataatcattgttaagttaatttgacttatattttccttgtcaaacaagttaatactgtcgttttcttatatagctgatcaagccttctgcagcaccaactgatccttctgagcaaggtaaatcgcaagttcgtaactctataatgcatatttttattgtttcttcgcctaaccctgtttataacaattcattattttctgccctttctggcagctccagtttctgttctataccaaatcatataaaataattgatgcctgatccttttactgtcctgtagactatgatgcaaaagcagaagatgctgttgattatgaagatattgatgaagaatatgatggacctgaagttgaagcagctacagaggaggaccatttgctatccaaaaaagattacttctcttcaaatgcagtttatgcttcggtcaatagtaaagtttcagtgtttgatgaggagaactacgatgaggatgaagaaccaccaaatgataatgatttgcctagtgataatattgtgcaaaactgcacttcaggtaataatggagtgcatccctaactgtactttaccttcattgttctggtattagaacttgttccacttcttctctctcctttcactgacacttctctccctttatctatttaattgtagcttcagctgagcaactggatatggcaccgtcaaatgacaaccttgctgttgaaaagatgtctagttcgttatcagaaccagaagaaagttttgaaagtgaagcttttcaggtatttttgctgttttttctttttgtagaactgtttccatccctcttgaacaaaactggatagccgcatggcatgtatagttggaattattgtcaaaccagaatttagttcatggttaattgtttttgagtatctctcctgtcacataaaaaaatcagtttaggtttgggaaatgtttgatgagacaggagttttct

SEQ ID NO: 60449 - DNA, 71099 bp, Oryza sativa
  unsure (1)..(71099): unsure at all n locations
tgaaacaaattacaagaccaagggtatttgtttctaatgcccccaaaacatgaggttttgtgaaatttgctctataacaaaagttgttggtgtagttttgggtttctctagcaaatcttggattctagcggggtggctttttataagtttcaatagcctatagttattatttgatggttttgcatgttctattttgagaatctttgattcaaaggaactactttccgtagaagttggaacttcttattgtaatttaattatttctaccatgacattcttgtataataaatgtcactagtgtggttcgggtttctctagcgaatcttaggatttgagcagaatgattttctatatgtttttcaatagtctggtgttatttttttacagttgtgcacattttgtagtgaatctatcattcgggcagcattactttccatagaagtaggaggatgtggttgatatttaatggttttgggatgagtttgttgtataataaacgttgctactgtggttttagatttctattggaatcatggattcgagtagaatgactttccataggttgcagtaggttatcaatgtttgtttttgaacttttctttagtgaatatcaactccaagtggaatgactttagttaatgcacaattcgtttttcgcttttccttcaaacggttgcctctctgtggtggcctggtgggggtccaccaacaactaaacttaaacaaatcttattctattttgatcctcccttatttcaatgttattaatcaattgctatatgcatggaagtcaataaaaatgtatgtgcataccacatatgcagattgaggacatgatagactataacctaaccgtgtcataactcaatttgtcaccagtgtggattgccaacggggtggcattgtttagctaggaattgtgtgtatggaatttgagcgcatggagtactaaaatatggattgccacaattgcaacaactaatcaaacactaactcagtagatttgggcaatgggtggcgccatgccgccatacaaccaaacaaaccaataaataaacggtcttcttgctaaattaaaaaaaaatacatagatgtcactttggcatcgtgtgaacgagtcaataaataaacggtctccttgctaaattaagcaaaagatgtttattttatagtccaaaaaatgcttagatgtccatttaggtgagttcgcagtttcacacagaagagctcaaataaacgacttttttcacttcttaagcctgcacatattacttaatgcaaattaaatcagatgctattagtcacaggtataatgggagacgccttgcatagtcaaccactcatgttcttactccttaatagttgctttcattatcagttggaattttctttgtcaaaaggggaaaaaggacttgtaaataactagctcgtgcaagtgcaactcatttttgaacatgttggcatgaataattgtttgtgcttgcttggtatgacttgggaccttggtattcagaaaagaaatacaaagaagatacacaaaattacaatttgatgaaacgaaacagaagcatgtttgcaagacctaggagatctcattctgcattcctgttcactttgaggtagggcagtgcgcccgtcacgttgttgtagtcgctcttgttaacttggatctgcgagaaagataacaatgttctcttagagggcggtagacaatgacaagttttagacttccagtgaagttgtccttgatttatgatgacacttttaggacttcagaagctactaaaatagactacacccccagcaaatcattgttattttcttattgtaataatgtttcttttcagccgcttaattaccaaacattggtgatacaagtagaacagatgttgggcctacaagaaagcttcctatctcaaatttagtgtagggtgtgctttactttaaggatccgagaggtaagaaatgggaagactgaacttcaggggggaaagaccaaacctctataaaataatatggagactcagttacagaagaagtgtacaaaaatagtggacttcatttcgacaaaacactccaatgcaaaatgtgtatgatgcatttgcacattattattagaacagaaaaatgtaaaggacacataccaatcatggattgatatcaaggggagattgggatagatgagcaattaaattatcaattgctggtatgtacttttgcgtgtgcacactaattataacactcaacctactgagcttctaatattacaacaaagtttatggctgttaattatgttgtcagatccccaataatcaaatggataagacattcgacaatcttttaacttcccaaaaaatactcaaagagcatggcatattattattcagcaatttaaaaatatgctaatattaagtaggacttagcacaatagcacatagacataaagaagtggcttctaaaaatattttttgttgtaagaactaatagtggaccatgaactctgaaaaaaaatgagtgaaattactaattagttatcgcgaacagcagagctgaacacatcaaagtttagaaagaagctacaaatgccactcatttgattcccatacaatctagaatgcacagatatgtgacccacaatcagattcagccacataggtactaggagacagctatgcatattgccccgaaattcacaaatagaacatcccaaattcggcgcattccatagcaccatgagctgaaccacactcactcagtcactctcacagtctcacttagcaatttagcattccacagctcacattgcaatccaatccaaaattaagcataggaacaccagcaaattccatggctagataagctggacaactagtagaccagaatttgagctgcactgtatctggattgcagggtggtggggggagaagagaagaagaagaagcataccatcttggatagcctcttcctgcgcttggtgttcttcttgctgagaaggtgctgcttcccggcgcgccgccgcacgatcttccccctccccgtcacccggaaccgcttcgccgacgcctgaaaaaaaattcccacagaaatcaatcagccccagcagcagcaatccacaccagaacagcaccaaccaagccgcgccgtaccttgtgggtcttcatcttgtaccccttccccgccgcgacgacggcggaggcggacgacggcctgcgacggagcggcgacgccgccgccgccgacgcgggggagaccgcgacggccgccagcggcgcgccgaagaacgacttggcggggaacgcgagggcgccggggtggagcttcctgggggcgcccccctgctgctgcagcagaggcgggagcgcgacgcgcgcgagggagagggacatggccatggctcgagggcactttgctcacgcttcggcttgcggtggattggatgggcgagcgcgagccgcgagcggatggagaggatagcgtcgccactgcccactggggggtagcgcgggaggtgggccgtgtaggctgtgggccgcgcgcgctacgggagaaaaaggaataagttcatctggtgtctcttaacttgtcaaccaatgcgtcgtttaattgtcaaaaccggtggtttggttttagcttgcgtggtttatttgactggtttttcatataacgtggtatttacgtggcaatttgatctgaaaaaaaaaacctataaaacccacatgtcagcttcacacacacaataataaaaaagaatagtggggcccacataaacccctggtctcaatcccttcctcttcttcctcctctctccccatctcccatgtcttcatctctctcccctctcatccctcctcttgccggcggagaaacggacggcttgaagacgcagcctcctccactctcgccccccatgggcctactacaggcatccgccacccctctcctcgtcgcccgccacgcctgcctccaccgcctccggatgttcctgccgtcgccgccgcttccccctcgcctcgacctccggtggccgttctccagcaccgccttttgcccccgcgccttcctcagaaacggttgccgctcttgccttcgccgggcccccgtcctcctcagtgacacgcggccacctccccgtctccgttgcttcctccaacacacgcgccacgtgactgcaagggtatcgcccatgagctgcacgtcggcagcagcttagagccattccctagccatgtagctgcatccatggcgctgacagtctggtcccgcatgtggctcctcttgctcagatgcacctgcgaccagcggcagaggaagcaggcacggtggctgtcggcggtaagcccatggggacgggagtggaggaggtcgcgcctccacgccgtccgcatctccgtcggtgagaggagggaggagaggggagagaggtgaagataggtgagatgggggagagaggaggtcaggaggaagaagaggaggggattgagaataacatgcagggcccacatgggtcccaccattttttattattgtgtatgtgaagctaacatatggttcccacgggttttactattttttcggatcaaattgccacgtaagggccacgtcaatgccgcgttagatgaagaccgagtcaaattagccacgtaggcaccacgtcagctaaaaccgccgtccaaacctccttatgacctatattgcaccggttttgataattaagggacctattatatctgattttctggttgaaagacgaaaatcggattcgtcgataagttaagggacctcagatgaacttattccgggagaaaacgagaaagaaacaagtccacatatcgcctctcagttttcgtggagtttaattgacatccctaaaccgtaataccaaaaatcttcaccccttatacagacgaaaccggccaagccaagttccatgacagtacggatggttggttttgggctgacgtcatatcttagtcagcaaaaagaaaattaaaaaacatgtggtccacatgtaagtggacctcctcctctcctcaactatcccctctcttccccatctctccacctctcccctctctttcccaggagctcaatggaggagagagtggcagcgactggcaagcccgtccgcgggagacagcgcggcggtgggaggtcggtgatgagagggctcttgtggaccatggcagcaaaaggagaagaggagggagatgagggagtcggcgagctctagctcaccgacagtccatgggaaggtggcggtgagcagtcgaagaggatagagggcaatggtagtctgcgatgacggaggagaggacccgatgccccggtaactccgcctcgggtgctcctgtacgtggtcctgtgacactggggatgggctcttccctaccgctaggagtggggcttaccgtcgctgcctgattatgtcgagagtgagaggaggagccgctaggttgaggaagggatgccacggtggtggcgatggaaatcaagctcgagcggtggtgtcgttgccatgtcctagttccagccccaagccactcacgctgcccgactcgctaggtaactcctatcatgcctcctgcggcaggaagcgctccacatcgagtcagcaacggtagctcagcccgattcctttttgtcgcttctcgcctacccgacagctcgacggaggcggcgagctgatgaggttgaaggtgaaaggggaagagccaacctggatgacgagctcctcctcctattcggaagctgaggaagtccctgctctatacggatgtttctacttcggtttggcctctgtcaccaccatggcagacccatcgccgcactagacctcctcgccttgagctgcttcctcatcaccgctcctggttagcccccacttctcaatcaccgctctctagcaacgtgctcgatgcatcaagctccaagaaccaaagggagatggagagaaaatggagatgagggagggagaaaatgggaggagagcgaggattatatgtgggggctcacttttattttttttcacgtatacgcctagtcagcatgagtggaccgagtcaacttgttatgtcaatgaaaccaaccatctatactgacggatgatcttaattaatccggttttgcaagttggggttgaagatttctagtattgcagtctaaggatgccgtttaaactcgacgtgaaggtgatggatggcaagcaaacttattccaaacgagaaccaaaattgctaaaaaaaaaactgtcgcaagttttataggaaaaaactttcaagtgtaactatagtatagttatagtgtaactataatgtaaattcactatagttacattgtactccctccgtcccataaaacaaatctaggactagatgtgacatattttagtacgatgaatctggacagatatatatccagattcatagtactaggatatgtcacatccggtattaggttggttttttatgggacggatggagtaatttgtaactacaatataactgtaactacattgtaatctctatataagttagatataaagttgcgtatattattttaatacttatatacaagttaatattatagttacagtggaattatattacaattgtagtatagttagatttgaaagtttttcctaaataacttgcggcggttttttagacgcgcgttttcgcggcccaatgggctgactgcccggctaactcccgtggaccatggcctggtttccaacgcgtgagttgtagtgcagcacaggcaggcggcgtgggatagctgcctgcctgcgtcgtcatcactgctggctgatgcgcagtgcggctagcatagctggttcggttacatgcacgccatgcatgcgtgcattaatcagcagcagaaaagcttgcgtcccccaactcatcgatccccactccacacatctcccttccatcgatcgatagatcagctaatccctcgcataaatcctcgatccggccggccggcggcttaattcctaggttttcctcctcttcagttcttcctcatctagtccgtccgtccgttgtcttcttccaagatcccagacgatgcaagcctcatcggcggcggcggcggcggcgtgctcggctatcaagccggcggcgcatcagcacaccgtgcaagtccaggaaggtaaccggccgccgccagctgacacacaactcttttatactgtcttttgttagtcttgttctttgattacttcggtttgatttgaggattttctttaacttgggtgctgcagataagaggggatcggaattcagggctcggtttggaacgaggaaactgtcctggggaggtatacagagattcgtgttttcgttctatatttagtatgttttttcaataaaaatcaacattccaggcatccgggttgggttgttcgtagatcaaatccagctagcctagatgcaccacaaatagaagaagatgggggataaagcataaaaccttaaaacatttgaactgcatgcgcatgataattgcaggatcaaacatgtattcaagtttttcactatgaagaaaaagattgtacatttgggttcctagttctccggaagagtttcaggatcttgcgatccttttaattgtatagggcggatctagcatgaaggcggtagagtctcgagcctccactacttacgtgaggaccatgggagcccctgcgaagcccccactaaaattattgggtttgttggaaccatgacaccctatatttgcaaaatttgagatatgccacccgtatctcaatgacatgtaagacccacatgagtcaatgacatgtgggtcagggtggcatatcacaaattttgtaaaatttgtgtggcatggttcaaattgtcccaaaatttgcaaatatagggcattactgattaatatgtcctcaatttttcagccactaagttttagaagaattcgaaggtgcatatttctgaaatgaagtttatcctaattaacaaattcatagttgtgtccttttcagtaactgtattttttttcctcttcttttaggagaaataaaataccttgttgataaaatggatgaataatttagagatgttagtgtgcactttcccccatgaaacataagttgttaaaatataattttgtccaaagtgactaatgtactaaacacttgtcctcaattacacattacaggtaaattgtcggtggaaaattctgctctacaccagtgtcaaaggcaagcactctcgtaaatctggggttaatattttcgatagcccactatgacaacttcacaagtaaaactaagtgcaattttaaatgctaccagtctcacaagaagcataaggaggcaaaaaagacaacattctccagtcctccaagtgagatgctatgccattgctggtgatcagcacgaatccatcgccactgagtttgaagaaatttgcaaagaagttccccagaaactgggagctttttatcggttttgccgaccccacacaatttttggcactgtgagtttcattcaattttgtatggcagtttcggatgcatgttgtctagctactgcttattgttcttggattgtttgtcagataataggaatcacttcagtttctctcctgccaatgaggagcctagatgattttactatgaaagcattatggggatttcttgaggtatcatacataaattttgtaatgaatgctgtgctcaagagatgttttaaattaaattcctgatgaaccctgtgctcaacagatgcttaaagttatcttcttaatggtctatagatatacaacagccatttatttttccttatgtgcaggctttatcctcttctttatgtatgaatatctatgttgtaggcctgaatcaactatatgacatccagattgataaggtgattttttacttgctgtttgaaaacattttcttctatcatgtgatatgtagtatcattgtgattaaatcatacttctttttggaggtcaataagcccagccttccgttggcgtcaggagaattttcagtggcaactggagcagtgttagtactcacgtccttgatcatggtatattaggttcaacgccaggaataaagaatcaattattctagtttgaataaaacaggttttatgtcaatacaccttcctcacattttgtttccttttgctagagcattgccattggaatcagatccaaatcagctcctttgttatgtgctttgtttatcagtttctttcttggaagtgcatactctgttgatgtaagtagtttttaccgagctttgtaagtacaaatggtgttccatgatcccatctaacatataaatacttgtattttcaatccatcatactctttttttcaggctccgttactccggtggaaaaggaacgcgtttctcgctgcatcttgtatactatttgtaagagctgtcttagttcagctagctttctttgcacatatgcaggtagtacaaaacattgtttacatctcaagttcaaattccttatttccctttggttagtattgaattcttcttgtaacagcaacatgttctgaagaggcccttggcaccaacaaagtcggtggttttcgcaacattattcatgtgttgcttttcttcagttatagctttattcaaggtaaatgcccaattatgttgactatatgttcacgtgagatcacaatggcttttcttcagtcatagccttatttcatccatctcttcaaatatcatcactgggaccttttctgaattttcaggatattccagatattgatggtgacagacattttggcgtcgaatccctgagcgtacgtttgggtccagaaagagtaagaacatatccaattctaccactggaaaacaaaataatggttctacatgtcattccagatttaaaaatggtgtaaaatcctatttttatctgatttaggtgtattggctctgcataaacatactattaacagcatatggggctgccattttggctggagcatcatctacaaatctatgtcaaatgattatcaccgtgagtgaattcttcacttctgaaaagaagaagaaaaattgttcatttcaaaaaaaaatttccccagtttgaaagttgagaagtccttttgctgttgcattgataatccaggttttcggccatggcctgcttgcctttgcactttggcagagagcacagcactgtgacgttgaaaacaaggcgtggatcacatcattttacatgttcatttggaaggtgattaatgatagtgttctagtttatacgatgaattttgttaaccaattaaacattggtaatgttaatcatttgcattgtttgtattccttgcagttgttctacgctgagtatttccttataccatttgtgcagtgagcactatatacacaagggcaagaaatttttgaccatgcacatgagcaattatatgaaacttgctactgtgatggcagtctgtatccaatgctttggagtgtgctgcaatatatgcaaatgtggataaaggcaattaggagcatacagtttagagcatatactgtacctatgtagctgctgacctttgagtaactgttgtttggagaagccatctcgtatcattgggttttttttctttgttgggctatctggctggtgagctgcatgtcaaagaggaagaaatactgacggtgggtgatttgaaatgcttcccagtattcatgtgtcaaaagatatcacaatggcaaattgtcaagcctgagggaggtggctcaagagatactactccatcccaaaatatagggtgtgtttagttcacgctaaaattgaaagtttgattgaaattagaatgatgtgatgaaaaagttagaagtttatgtgtgtaggaaagttttgatgtgatgaaaaagttggaagtttgaagaaaaagttgggaattaaaccaggccatacttttgtagttttttaacaaatattaaggaaagtggtaatgggggaattttgaacatttcattgctacaaacttaaaatttaagtgttagaaatagctatattttggagaggatggagtagtacttattagtggatatgtgcaaattggaattagcatctcgaattgatcataagttggatgactttttcaactattcggtgtaaaaaatttgaagggaaaagttttgttggttttaactcggaaacagtaagtgacttgaaaaacaaaactactagaaagatgtaaccaatcaagttctttcatttgaatctaaggccgtgtttagttccaaaacaattcttcaaacttccaattttttcatcacatcaaaattttcctacacacaaactttcaactttttcatcacatcattccaattttaactaaacttctaattttagtgtgaactaaacacagcctaagaaataagggtgcgctagttccagtgggcaacttctcccgccacatcgtttttcacgcgcacgtttcccaagctgttaaatggtgtgtttttttaaaaaaaatttataaataaaagttgcttaaaaaattcatattgatccattttttgaaaaaaatagctaatacttaattaatcacgtgctaatggcctgctccgttttccatgccggagggattattccccgtccctcactctcgatcggggcctaagagcaactccaacagagtggctaaatggctctccaagctaaattatagctaagatagaaaaaaaaaatctccaacagactctccaattgactagccaagccatccggctggctaaaaatcctatggaactggccaaatgtggccagccacacccgctagctaactgtgggccccacgcactatccctcccacatgtctcgctctcctcttccttcgctctcgcctcccgcacagcccatcgccactgcctccgtccccggccacaaccgccgccgtcgcctccgtccgtgtccacatccggcaccgccgcctccgtccccggccacaaccggcaccgccgcgtccactgccgcctccgtccccagccacaaccggcgtcgccgcctccgtccccgaccaagtccggcgccgctgcatccacccccgcctccgtcccagccacaaccggcgtcaccgcttccgtccccggccacatgcggcaccgccgtccgccgccgcctccgtccccagccacaaccggcgtcgccgcctctgtccctgaccaagtccggcgctgccgcatccaccgcggcctccgtccccaaccacaaccggcgtcgctccctccgtcgcgtccctccgccggcgctgcccctccgccgcgtcgtcgtccactgccgaggccgccgtgtcgtcatccccctcccctctcctctcctctcgcctcgcctccccacccatggtggccacgctcctccgccgtgcgctccacctccaccgcgtgctcccctgtcccctccccttcctgcgccggtgccctcctactccccgtcagcgtcctcccccgcctggccgcccaccgatcgattgatatgtgcctccgttgctctgcctcctccagggccgccgcgctctcgccatccacccagccaccgccgccgccgccgacgagctcgcctgctccgccctccgctgctggcccgcttggcctaccaaatacacgcccaggcatgccgacgcggcctgcctgcaacctgttcgacgaaatggcgcacaaggatgccgcctcctacacagccatgagtaatagaggctgacgtgcgggtcccagtgtcataggctcataatggggagtgtagatggagaggttgttggagtgaggaataagtttggcttgccaaatcaattggagagctagctatatagatgtttggagagtccaatttagagagactgttggagatgctctaagtaagttggtgtgaaatggaatggagaaggcccaaggttctgaagttggttctgatttctgagaatcaggcttatgccattctggttgggattacccacaaaacaagtatacagtcccttctgttgtccgggcatacgtccctctcaatagagtggaccaacaacatacacaccggttttagggcatgtttggagcagcttctagcagccgcagcttctcacataatctccagcttctctaaacagtttagattgtcacctagattcttagaatctgtagttgtataatacagaaaatgtactagaatccaaaagctggaaaacccagcttcttcaaattctcaaaagctgactaccaacgagcatattctcaaaatcttaaactcccttaagcagcgccttagactggcaggaaggcttttgcctcatctcaaatttcaacttggccaaccttggaaacaaaaaaacatggcgtaaaatgcaactaccttgattatatatactccctccgtcccaaaataagtatagttttgcactattcacgtttaacgtttgaccgttcgtcttgtttgaaatttttttatgattagtatttttattgctattaaataataaaacatgaataatactttatgtgtgactaaatatttttaaattttttataaatttttcaaataaaacggacggtcaaatgttgggcatggatatccatggctacacttattttgggacagaggtagtagtatcttgtcaagtggcaatattttttagataaagaaatagttcggaattagtactatcacagtcacaataagtcataatgacatcgtgtcaaaaaaaaagtcacagtaatgacatttgcccggcatgcaccaatcctcctatacatgtaaatatttttctttccttagtcattcgtttttcactttcgccgttgtacaggagtaaatatcacgtacgggaagctggtgcatttattagtggccatccaatcaatcagccaagtttttttcaaaaattacaactgacggtatcttatgtcatttccaacccaataattaagatgatgtccatagcattagctgccacctagaatgaaaaataatgtggcaagtgaataaatgaggaaagagaatgaaatcatgtcttgcataagacatggtttttacacaacatccaagacatcatctgagataggtggtattaaatttaagtatgaaataatggtgtttgtattggaagagaattgtctaatactagttttttttttgatgatatgaaatttatggaaactatttatagtatctttgattagaaatggccatagatttgccgatcactgttctttagagtatgcacgtacgtacacaaaagcacatgcgtggtcatgatgcatggctcccacaattttcaaacattgtcttgtacaataatattccgagattgtgaagtggtcgttgattgtgtacacgacgatctctcggtggccataaaaattttaaattaatccagatgtttttattattgctttctatattcaatcttagcttttaaaccactcagtataaaagttactccatccttcacataatataagaagttttaagattgaacacggttactaataaagtaggtagaagtaagtggtggagggttgtgatactggagatatgtgagaaaagtgaatggtggagggttatgattggttgtgaagagaatgttggtgaagaagttatattttgggataaatcctgagggctaaaaattgttatatttaggacggagggagtactattttgtcctaaaaagacaaatcctaactatgaacctagatatacttgtctaagttcgtagttagagatataggacaaagagatatatatgctaggaatacttttagttgcattgtttttattctttttaatggtagagaccctaaacacggccccaaacaattcttttagggtagaggttaaaacttcaaatccaacaagatccctattagacataagggaggcacccaaatcactcacccaaaatccctaataagtcttaggggccaactccagccccggccccatccacaattggaaggaacggtgtaatatcccaccaagcgagagtttgatggtggtgatgatagtaatggtgaagtttgagctctcggatgctttttttttattttgatggaatacgttggattctataagttatttgttatttaggatatgccatttccacggttaaaaaatttggcatttggagcctctatgtgttagtaattctcactctgctgtttaatgtgtcttctaccagtaggagtgtaggacagtaggatcactacggtttaattttagttgtggtgttttagggcatgttcgatagagctccaactcctaaattttatctgaagtggagttgtggagctatctaaacccaattccatttctttagtttattttgtgagagctacacctagctccgctcctattttaggtggagctagagctggagctatgctgaacaggctctcggtataagcagttcaccgcggttcagtgatacggttgtattctttttgtttagttttcgatcggacttcatgtttagtccagaatcttggtgaatgctttgatctgttaaatagtataatcttgattatgcactacattaaacattaaattttgaatttgaatttaaattgtgaatttaaatactgttgaattatatgaattagaaatatttatttttgaattgttgtgggctaaactaatcataaatatagagtgtatattgaaataaatgagaaaataaataggggctaataaatggagactactgccactgttgggaacccatctttgtcaccggttgggaacctactgttgtcccggttggtatctttagtcccgggtgaaataaccgggactaaagatccggttggtaactccaaccgggactaaagaggaaaacaacggcaatctcggttgccaccttttcttttcttttttcattgttttttgctagatgatttttccttcaattttctcccaaatcggatgggatgcatatcccaatcaaaccccaaatcctcaaatcaaagcataacatctcaaatcatatattcacatcataaatcctaaaaatatagcacaaatcaaatatatctcagattgaatccatacactgaatcataaattctcaaaaaaagaaattatacatctcaaacgagtccacggccgccgccgcctgcagccagtagtgtgcacaagttgaggacattgtttggaccgaagaaatgagagcagccctatttaaattataggagttttaaaatagaaattatcgctgaagatactctaatactgtacaaacatgatcaatttttttttaaaaaaaatacagctccacacgcctaatttcagggcaaacggcaagtcctgaaccataataacagtcgcttcgaccggcaactatccggagttagctgtgcggggagaataccctccacgtacatacgcgagagtcgcgtcgagaccgctctgcagtgctggacaccacacactagcactgtcacgacaacacggcatgcacagtggggtacatcaccaagctatagtacttagtactactagtagtagaaagtatcaaaaagctaaaaatcgagaactggagaagaagccgctcaaatcgtatgtaccacacgtactgtatgataggccacccgtttttaaatattcggtccgttttcaagtatttatcattgttcgtatttagattttatcacttgccattttgttcaagaaattataaatacttgaaagacatggtatcatcgaagtgttgcattctaaacatgagttttaagctttccttaatcgtagtttaattagtttaaaacattggtggttaagcttaaaatcgtggtgcccaaccgtgacatgtatttgggaatagtgggagtaattgtcagggaagccttttattttcaaacattgactactcgtcttttttaaaaatatatatatgcttaaaagatgacaaattactgcatcaaatagtattgtaagcatgaaactttggtgaattatattcatgaatcaaaaaaaacgcgaatattaggaaaatatctaatatcaaataattagaaggagtgaggcttcgaatccaggtcgtctagcccaccaccttttggagctagacggaagacccctgggcgtttctcatagtcatgaatcctatatcacatctatctgtcccacggcataaaggattttggcaatacaaatagatagccaaaataccttatatttcataacgaagttaataattgctagtttgtctaacagtattgtgttactatctttgtctcaacatattatcattcaaattttgtttcaaaatatgacaacttccccatctactcgttgacattcgcaactatatcttatttaatttctttacctacttattcattaaaaccaatcacaaccatacatcatttaatttcacctctccttttaactaatgtaaaaaagtatgtaaattttttgaagtgcttatatagttatattttaggatgggcggaatggtttatagctataaactccacaaaaaatacataggagtagcaacaaacacacacgtttaatcagccgaaatcccacatgaaaacagagcgtcttatcttatctgcatccaactgtactccagcatgatccacaacaccactcacctcatgattttcgttgtattcgttccagtcccaaaaccagcgagatggatgcacaagcaaccggtcactggttggtctctaccgtaccgaagtcgacaggaacagaagcagttattatatccaagagaaagagaaaaataaaatcttgacacgaacaaaaacccgactcgccgcacgtctccggaaaacgatttttttttcgaaacaaagaaaaaatggggaaacaaatccagtggcatttttcttttttttttttcgccgccaccggcagccgcttttatagcacacacccgtcaccacacggaaaccccagccaaggctactgccaccttaccttgcgtactacgcctcacttttaccaaactgacccctgcacctccactcaccgacagatgggacccactaaaggatagaaacgtcctttcctatccggcacagtgcgcgaaagggcggaaagggttcactgggccccactgcgtccaaggtttggcgtcccgccaccacccacgcacgcggggtacccggtcactgacgtatggggcccggctggtgggccccacgtgtaagtgggggtgggatgggagaggaaggaagggtctcgcggcgcgtcgtgtgccatgtacaggtggtggtgagtagtactagtggtgggaatggattattttattggccatatgtgggcttttattccgcgcgtttaaaaacccggacgccacgccgtgggctcggttcgcctccacgcccccctcatttcctcctcgctcctcccccaccattcccacatctctccctcgccttcctcctctctctctctccacatctccctctcgcttccacgcctcctccgctttggcggcttcttctctagggttcgtctcgactcgactcgtcgaagggaagctgctcccatgaccgcggccgacgctgaggcgtgcgcggtggccgcggcggcggacatcatctgctcgctccgcggggccgacctcgccgggtggacgccgccgtgggggacggctgccgcgaaggggaaggaggtggtggtggaggaggaggaggaggagctggcgtggccgacggtggcacgggggaagcggtcgcggtcgtcgcggcgccgctcgccgtcggggtcggggtcggcggcgaccaaggggaggtgggccaggggtagcccggcgtctcccctcgactacagcggcggctccggctccggctccggctccgccgcgtcgacgagcggcggcgaggacggggccttctgctctccaccgccaccaccgccgccggtggtgacggcggcggcggcgactacgcccacggccgcgcccaccccttctccggccaaggtacgtactcccagccgcgcgcgcgtgcatccctatctctctctcctgtttgttccttcccccgcacagctcgcgctcgcggttgggctgcttcgctttccgttcctcgtctgggttttttttgacgaaactacccctccgtgtcagcaacgagaggaggatgatggatggatgacttctcgatgaaacatcgcttttcctctctctcccactagtcccaccggcttttcgttcgcgtgaccttttttcttaatcccaccttcgcagcttcgctgcctacccattctttcacctccaaccttttcacccaggtcatttcggtaaaaactccatggctattagtacttcacccacctcgcagatctcctcgtcctcttcttctccgaacaatttcgggatctccacctccgtgctactactgctactctcgagctctgcgttgtaccagtagcactatgactctacgggtgcttgtacagttcacactttgaattcggggaattttttttcttttggggtggatttgtactaccatgtcatagcgtgtctgtttggtgcggttgactcctaccttgcggaggggggcagccgcggcaattcacaagggtaggtgggttccggttcggctcccactcccaagtctccaaccacgagccgcggcttaccgcttttgcccaatctgcccattcgcctcgagcctaacttccgggggcaatccggtcatttcgcccgcccttatcctggacctgacctcctctatcgcgttcgttgccgtgggaagtgaggagtcaaaccgacgcggcgctctccgttggaagagaaagagagaggggtggggtggcgccgccacgtggcggctgcccattggccgcctcgcgcgcgccgtgtgggcgcggcgcgggacacgcatgcatgcgtgggtgtgcgaatgcgaatgcgaaacacgtcgtggccacttggctggcgccacgtgggcgcgtggcgtttcaggttcttttctctctctttgctcgcggacgtgtcctggtgggatgggccccacctcacactgtggtgggatttccgatcctagcgggaaaaggaggcaaacggatactcaattttaagtgagtaaactgaatttcatatgggcttatttctttattctttttccctgcgagggaaggaacctcgtgcggggcccacctgtcatcgtcatgtacaggtgaggtgagagcccatgcttccattactggacaataggtgcagaaattaggagcacacgcaccgttggttaattaatcgtggataagatggcaagatgagcagtttgtttgtttgtgcgtgcgtgttgttgatctctcctatcatgtcgaaatgtgcttcatgcgggtagggcaacaatgaggggcagttttgtgggatcttggtaggagttagttaggtgatgttttcccccattagagccaagcttaagctaagctagactctctcatctaattcccttcctaccacctggaaaacaatattcttttgggtggaacatgcgttgcctgttgctttctttttctacggtcgcctccttaatgcagcagcagcagcagcgttggttggactgtagttggttggctctagtggcccgtgttgtgttgtttgatcctaccagcagcgcgttactagctacttccagtacagtattcgctgggtgtgtgatgatgagtgctagtagtagtagtataactgtataactaatggcgtgcgtgctcttctctcgcttacaggtgggccctgccggacggcgccagctgatcctaccgaccccgcctccccggcccgccggacagcgaccacggaagaagatggtaagctactgcagtcactcactcagtgtcacacatatgacccggcacttagcacaggaaaagcgcattttgtttagtgacgagtggtacaagaaagcagtcaggttttgttttgtttcacctttgcatttttctgcagtaaaagcacggtagatagatagagcagcagctttgggtctgggctttgatgaatgaagttactacgagtactcccaagttacagcttactactagcagtacacccccatcatttgcgcgattgcacaggtccggcacaggtccggcaaaagaaagtctttggcctacacagtagtctcagagcagtagagtcagtgactcagccagtcgcgtgcaggagatggtaggctgttcaaatggccggagtttttctttttaaaaaaatgttttctagttgcggagtcggtcacccagtctagaataaagcggcagctggtgcggccactgccaccggaaagagagcgtggtgagggaggcaaaagtggtatcctaaggacaaaggctgcctgcccgaaaagatccacgctcatcatcaccagatggtcctgtgacgaaacgagatcgaattttgatggcagtagtagaaaaagaaggatcgcgtttgtttcttggcttttattacggcttgatttggcctaaacttggttttcttgtcggtatggtgtgcagaggctgccggagattcagcagctggtgcggtcgctgacggtggagaacgatggccttcgcgaggttgattagttcttctttcccctttacgtgattttcacttctcacttggattatgctgttaatttagctcgaattcttatccgtttcttgtttatattctcgtccgaaaacaggagatggtggcgttgcagagagcttgcacggcgttgtccaaggaaaactgcaagctagaggtcagtggcatatgctgctatctaaccaaatcttctcctctttctcttttgtgcacatgtggcgtgcaatcgcttccaggttggggcgctgagtgcgcaatcatcataaaacccaaataaaaattctgcatgtttgatcagttggtatagcttaaagcataagtgatagaactttccaacttgctaaaagtagagttcccctgagcctcccaatggagaactagtggtcccctggcattgtgaatgcatgctgtccttcgatattttctctctcttccttggtgtgtgctttacttcgtcgtcctaggctcttcctggcttcctaggagaagagtgctatgtgtgtggcttggtttggtttggtggcgatcttcactccacatccctctcaaccaccgtttgtcctttgaaaacggatgacaaccggtgctgatgataagcctttcgcaggtttagatgtcgatttccatgctttctttttttgaccatacacgaactgcccggggttagctttgccgcatgagcacgtatttgttttgcgcggtgaaaggtgcggtgtcactgcatgtgtggccggagtgccggacaggatcactggcacacttgcagtatctctcttctcttgagctgcttagaagatagtggtagtaccacggtagtggcaagtagccaaggaccagtgaaagaaatatagtacgggatataaatgacacatcctatactggacagatcagactagatttttttattttggggcgagagaagtaaatactagggctattgttagtccgcaggacgcgtgtcgtgttgtgaaagggtgtcattctgaggagagtgacaccttagccaaatggtcacacggtatgggacctggaggtggcgatagacgttcgttatcttatctgaaactgaaccgtggatcgtccggacttggccatgcgtctcagcgtctgtcgtgttaatttagggtaagttggatttttctagtcttataggaagctctttgtcagttaggctgggtggagcctgcatgtggccgctgcttgcttctggagctgtctcaacacatgcgctgcttagctcctcctatctcgatgtatggaagctccggttagcttctactaatacaatattgtttgtaccttctactagtactgcatctcaagagtcatggttagtgacaagttcgtgtactatatatagttagtaacttataacaatagtttgccactgtgaggtggtagccgagctgtcaattttacggtaaaggtataggagtgtcagtgaggattttagttgattgccttcttgactttcgcattcgggatgaagtgcaagcaagtgggaggagctcgaattcttatcctgtttatccatctcaataatctcaagttctcaaccacctcttcacccatcaagctgcttgcacgtttggaagggctaggaaagtgacgtcccccaaaaaaaccctttggcattggcaaggtagagttggtgatagatgcagttcagctactgcactttgtctgcgcaattgatgcagttacaaggtgttctactgactgttcatgcatgcttcgttttcaaccagccgtacatgtctggaatctttcccccaataaagaacgccatgttgccaggccatgaccttaatctatgcacaccaacccggatcctggacatggtaatcccgtggccttctttaatgcccttagttcttgcgtgccacactgccactgcactggttctgtgctccacaatcacattaaaaatacagacagtgtactaaccagccagaatggttgggcaaagctctccccatttcatttggtccggttaacctgtactgcaccgttgttgtgcagtgtcatctctagagcctcgtggtggctgagtggtccatgcatgttttctctctctcccgtgtgtctttcgtctcctctggcataaagcacatctagctaggtccagccatggtaatggccaacattttggatcttcttagtcctgtttcaggttgtttatgcttggtcatggactcatggtggttgttcattgtccattttctcttatgcctcccatttcacctccacagagatgtctcttttaccaaaatataagaactacgctaggtagattgtgactacaacccaaatttcctttccaagtctactctgttgggctcatggattcataagagatttgccttctgcagtcatctgaaattatgtttcataaaaccttttttttctgaaatgtataataacaatcttttcctctattttgcagacaaggttagagaaatcaagcaaacgaaacggaacgaaatccgaggggcagcaagcaaggccgcagcctgatgagcccgcagccaagcaggaatctcaaaacggcttcgtgctgcctgacctcaacctcccagtggaggacatggctgctgatggatcagctccttgatgcatgaacggctccagattattaccgcggcgtcgctaaccagacaaaagaattttaattgtatatagaggaagctgggctacaaggggctctgatcgctcgctcactcaagatgaagctaaaggagataattaaggaccataccttatgcttgtttgataagttgttcagatttactagagtttagcaccagtgtcatatgatcctccaatcttactaatgccattttaggagcagaaaggaggatcggtttaccttgctttgtctgatagagttatagtagtttttatttaccctggccttgtgtgtcgatgaggcagagggaagattttactttagtagtacaagctccggacagtgtagcttggttgttcatctaagcactgtaagttagggaagaactatctcaatgttcttttgtttattctgttcaatgttggtgtgaatctttggctgtttgtagagtcctactgtcttgttcacggctgattacaaaacgggttgcatctgtcacattagctgcacagctcagctcatggtactctcggaaatgtccctagcactactccattcatcctaaagtaagtgcactcgaaatgtccctagcactcctgagacactactccattcatcctaaaggaagtgcagggagtgagtagataagtgtttgtctctcctaaactagaggagtgtattttgggacgaagtagataagtgtttgcccagatatatggctaaaaataattatattttagactgaaatatattattattattttatatgagcacggtttcaccattggtgtattggtgataagtgcataactacactccaaattttaatccacaatatttttagttaggccgagtttagttctaaatttttttttcaaacttccaacttttctatcacatcaaaacttttctacacacacaaacttttaacttttctgtcacatcgttccaatttcaaccaaaatttcaattttagcgtgaactaaacacactcttagttaaagttatactttcttttccaagaaaaaaagagcatggtcaggtgcaaatcattgtgaacgttgaattcaactgttcactgattccaactgcagatgtgaacgtgtcgcttgatctaatatagtaggagggggaaaaaagaggaaaacttgtatttgcgctaaaaggaaagaaaaaaaatgatgttgattaaggcaaatctccgatgtagcctccatatccatatcctggctactgacggtcaagtgaactgtgagcttactgcatcactctcaaaaagacaaaaagaaaaacgagccaaggcccatatccactcaaccgggtgaaggccaaaaatggaaatgaacaagtttactgtacatccctcatttgccgtcgagtttgcaattcatccctgcaacgcaataccaaatagaatgtgtccctcaacttctaaaaccagtgcaaatacgatccgaagatggttttgatgatggtttcagctgacgtgacaactacgtggtgttgacgtggcacttaaagtcagaaaaaaaatccgtgaggcaacatgtaagcaccccttctctttcccctttcttctctcttctggtcttccctttcttctcatcgcacgaacgcccacttggaccctatccgtcgttcgtgcggtgagaagaaaggtaaaaccaggagggagaagaaagggaaagagaaggggtggttagtagggctgtcaacgagccgagcttgagcgagctcgcttgcctaggctcgagctcaatacaagctagagccgagcctataaaatgttcgagcttttaaacaggctcggttcgagctagatcaagctcgagctcgactaccgagcttgatttttaattagaacaatgtatattttaaagaatattcttttaaaaataattaatttatggtttatcatattagtagaagaggaaaaggaataaaataaatatatgatgccaatacaaggcatacaaataacatatttcatctaccaatttattaaatagcaataaaaaatcatatattactagggcttattagaagctcgagctcggctcgacaaagctcgcgagctttgggacaggctcaggctcggctcgtttggagctcgagccgagctcaaatcgagcataggacgagtcgagctcgagcagctcgcgagcctcgagctttttttaacagccctagtagttagatgtggtcccacgatatttttcttactttaagtgtcacatcagctgaaaccaccgtccaaatggccttaagatcttgtttgcacattggttttaagagttaagaaacacattatatctggtattgcgatgcagggactgatttcagattcggcgataaattgagagatctaaagtgaacttatattccaaacgaaaaagggaacaacttaaggccgtcatagcacaccaggcctatgaagaaggcatgcatgttatgtgggccatgtaagcgacgggatacagattcatggtccggcccatttacaccccgcctaggctgattggcatttcagtccaagtatactaatcccctcccaacccctctctcccgttttccgcgtacacgcttttttaattgttaaacggtactctctccgaccccctaatataagagattttgacattttgtttgcactgtttgatcactcgtcttattcaaaaaaattgtgcaaatataaaaaataaaaagttgtgcttaaagtactttagacaataaaataagtcaaaaaaataaataataattctaaaatttttcgaataagacgaatggttaaacagtgcaagcaaaatgtcccttatattaagggatggagggagtaagttttttttgcaaaaaaaattctatatgaaagttgcttaaaacaatcaaactaatcctttttaaaaaaaatagctaatacttaattaagcacgtgttaatggaccgctccgttttctgtgcagactgttccaagttcccaaccgggaatagcgaacacagcctaaagcctaaatggtattaacatggaagctttaggcgttcgtgaaatttgtttaaaaaaagtacatgcccgaaatactgataaagatggtttttctttaaaaatatgcttggaattgtacccatgataatccatactcccttcgttccactccatgcatgctgcaaatcattctagttgtcataacttaaacttctttagctacgactgagtttagagaaaaaatacagtgacatctacaataacaaataaatacactatcaagttagaaatttgtaaggtgtgtttaataaaaaaattcttcattaaactcgatcgaagttagaaatttataacttatgaaaaaaactaaaatgacttccaatgtgaaatggaggggtagattctaatttagtaacaatgtgccgctcctttcacagtgtgaaattcacactagatataataaaaataatggcttcgttgtctcgtaactaattattagatttgttttttccaataatagtgtcacgttcttacgatatcataagtgaagatcacaaagtgtaggtgtcctatagtaaattttatttgctaagattgtaatctactgatagtgtacccttaggctcatttgaaacaaagtaattttgtgattggattcgaagaacttttttatggtcctttgaacaaaggaatgtctctctcaaatttatttgaaaattcttaggtttcataaatcaatacaatcttttagagggaaaatcctttatgtaatctctttttttcttatattcatatatattccctcgctccatctagatcctattattttcatgtatttttatatccataggatttcaagtgacaaggcacccgaatcatatgttttctctgcatgtttgcaaatcaaaagtcttccgctaccaactgttacggtataccccctccgtcccattttaagtgcaaccataaatttctatgcccaactttgatcgtctatcttatttaaaaaaaaataaacttagcatttttgttgttatgagatgataaaatatgaatagtattttatacgtgacttaagttttaaatttttttaaaaaaaatttaaataagacaggcggtcgaaactgtgcacgaaaaattatggctgcacattaacgtgacggagggagtactagttcttatcggtatatttgcaaatccacccctatatacgacatatacttaattataaaatccggccaaatggctcatcattaaggacatcaccaatgtatatggcaaaagtggtctatatagatgggacccatataaataaactttaactatagcaatcctcacaatgtatatggatacaatgtaatattaggagaagagagagaagtagagatagataatattatttatgtcatatgggtagtccatatgcatatggataccttttgctattttctttatatggactagttgcataatgttactaagtggctgaataaaatagtttattccctatagaccacttctgtagtacattgtggatgtcctaagcatcatggcatggcgatctccacagaaatcggcggtgacgcgtccatgtcctattggacaggcagggcgtttattgtgcgagaggtggggcccactcgcgtggtccatctttcgttcctcgtcgctgtccctgctttttccttccggtcacggaaaatatcacatttccattcccactgccatccactgtgctttttaccctcaagtagatagcggcaaagattcagaccaacttgttaaaagaaacaaaagtggacaagtccactgtatgaaaagtttgttagttcttattccctccgttttataatagataatgccgttgactttttctcacatatttgaccattcattttattcaaaaattttatgcaaatgtataagatataaatcacatttaaagtactataagtaataaaacaactcataacaaaataaattataattacgtaaattttttgaataagacgaatggtcaaacatgtgataaaaagtcaacagcgtcatctattaaaaacggagatagtattattgtctattagtacttgttagccacatctaaaatttaaattgtgattttggttttaaagctgattttgagttttctcgtcttaccatatttttcagccttaggttttgtcccgaaaaattgtttgttggtttattagtcacatcgaaaaaaaacttagagctattgttttcatcatctgattgttggtttattagtcacatccaaatattaaattttgaatttaattttacagttgattttgaattttattatcatggtatatttcctagcctcaacttttatggcataaataatactgtacatgtataagggttatattcataattttagttgctttgtttatcttcttttcagtcttatcaactgtggctcaacagatcatatatcaacatatcttgccccagtgtttacacatgtttaataatcttgaaatcataagctgttatttttcaaagaagaaaacacaagctgttggagcttgggttaatttgtgcaggtgttcaggcacatctctgatctatatactgaagagctgtgtttgtgagatgtggacgccactattaagtttgagaaggaaataaaataagtctgatgataccgtagtgccctaacgcccagcaaccatgaatcatcaatcggttggttaactggaaatttcagcgcttaattgggaatcatcatcgtcgtactatacagttcattctctgtattatttattgagaaaatgatgcgtccttcgctgatgtgagagattttactatagaaaccaccttcacgttcaaagtcactgcagagggtacgatagtttataatttttatatgaataagtgcaattccaatatttatttattttctcaaaataacaccgttgcaaagtccttacagcgccgaaataaattttggagaaatcacgtacaccgtgcacgcgaatttattttgaaaccgtcttagttttaccataaaatctcttaggagtactacataaaatgcataccagcgaagtaagcatagttaaactgattagatttttaggttggaatatgtctaatcagattgtgctcgtattaactattaattattctttcagtggtagaggataacaaaacattcatggtaacttcatcaataccaggatatcccagtccagctattcaaatgtactctctccgtccaaaaaaaagcgaatataggactgaatgtgatacattctagtacggacataaataaatccaaatttgtagtactaggtcgtatctaatactagttgattttttacgagaatggtgagtacttataggagagtaggatgtaatatgtgacttcgtgaaggtgggtgcccgcgctgtgagcgtctaatgcacaccttcactccgtggggtaatagttccaatcccgttcaagcatgagctactagaacatatccccgtaaatacgtgtgagtgtggtgtgtgcacgcctgatcctatactcgaaataaaggattttttcaatttctaggcacaactaagtagtactagtaacgctaataaaacgaactacaactcatatgtcgcttgactttttttttttgtcaaacttttttatatttgatcaaatatatagaaaaaatatagtagcattttcaacacaaaacaaatatattatcaaactatattcaatgttaatttaacaaaactaaatttacattttagatattgttaaatccttcaacaaatttaagcaaacttaatgaagtttataacttagaaaaaaaaatcaaacaacttatattaagaaaccgatcgagtaatttacacggagtctagattcctcccccaaaatttgatttttgatttttttttctttatttttctgatagagggaggagtacggtgcaatttactcctgcgatttgcaaatgagtcacgtgcacgcgcaaaactgaaatgggctcctcctattcccatcgctcctctacggtcccctcccactcccgaagaagatcctctgacttacttccctctaactctgagtcaccgatatatgggcccattaaatagagggcccatatgttagtgacacaagttagaggagcctcccgactcactccctccctccctcccaactgctacaacaacaagtcctcgtcctcgtcctcgtcttcgtcttcctcctccacctcgcgcgctgcagcagcagcagcggtgcgcgtgatggcgttccactaccaggaccacgcgctggcgatggacgccgcggctgcggcggcggagacgggcggccaccaccaccctgggttcgtcggggcgggaggagttgtggggggaggaggaggaggagggtgggagcgggagaaggccgccatcgcggcgcacccgctgtacgagcggctgctggaggcgcacgtcgcgtgcctccgcgtcgccacccccgtcgaccagctgccccgcatcgacgcgcagattgcggcgcgccccccgccgctggccgccgccacggccgcagcggcggccgcggcggccggaggggcgccgtccggcggcgaggagctcgacctcttcatggtgagggctaaattattattagtagtagtagtagtagtagcgccaatcaaatccccccctctctttctccagggcgttttactcttatttttgccaagctatgaggtttgcgtggtgtgtctctgtatcgcttttgcgatcaaattctcctcgcgtgagagtttcttgtacgattggtatgtgaaatattattctggatgagcgatatcgaaaattggggctggaaagggaaatgaaattggctttttttttttgaaaccgaagccaggataagctggtgttatattaaggaggagagagtatttacaagaaattggctagtggaattaggagtgaaatttggaaggaaaaaaataattctcgaaaactcaagcttcatttcattaagaagcagcagaagtatgtacagtacaagtgtacaacagagcggtccacaaagaaggaaccctgtagaaaaaacatcaccaaaattttgacttttggaagggttggattgattttgtcggagtagcaatggttccgaccatcgtttttgaaatatagtcctttgaattgaatatgctaaaattcatcacttatttctcattccttggtgtttgtttgcatccctagttggctagttgttgaagaagctctaagttatacttccattatctagtccttgtttgatttagattattgagtgtattattgctgtggattatgtccttcgtcatagggatacattaaatatttcaataaataaacttaacaaataggttaaaacaagtggtctaagtaagtaatatactagaagaaagattttttgagaaaatacttcttttgaagcatggagcaaataatccgttttcagtaatccggtgaataagctaaagggaacatggtatcaattaatattgtttcttgcatacaatttctgttagctaagtttatgatcagttgcctcttttttaaaaagtcattttgtttatcaggtactcttctttgcttggaaatgacaatcttcctaaggcaattttttttacttaataaaaaaatgtttttttttcttgcagacccattatgtattgctcctttgttcgttcaaggaacaactacagcaacatgtgcgtgttcatgcaatggaagcagtaatggcttgctgggaacttgaacaaactttacagagccttacaggtagcacaaaaaaatctagttgatattattcaacatgagaatagtggactcctgattttaggaagagaaacttaaagttattatttctctctgtttaattcatgctgatgtgcaccattgtgctacctttcgtccatttttttccttctccgatataaacttgacctcaaagtttactcctttgtaggtacaaaaaagtacaaactaattccaccttttcaaccatcataatcacatagcatttaactagcttccttcactctaccaaatatagtttacattcttcaatcggaattgagatatacctgtggttgaacctgcagaaaataatgagtgttctgtttgggagaactttagtgatggacataggactactctcctaatggcaaaagggaatacagaagtaaaatttgaccaataatctggtgttttgccaatcctcagttgtgactcttactgcaggggcatctcctcgtgaaggttctggagcaactatgtctgatgacgaagacaatcaggttgatagtgagagcaacatgtttgatggaaatgatggatcagatggtatgggctttggccccttaatgctgacggagggcgagagatcattagttgagcgtgtacggcaagagctgaaacatgagcttaaacaggtaagattatggcctgaatttttagtcgtttgtatgttgttgtataaactttaaacgaaatttcaaatttccaggggtacagagaaaagcttgtggacattagggaagagatactccgaaagcgaagagctggaaaactcccaggagatacagcgtctactttgaaagcatggtggcaggctcactctaaatggccatacccaactgtatgtcagctcacagataccattatcaggccttcctgcatttccttttctaccactgatgctcatgtttcttaacctttataggaggaggacaaggctcgcttggtgcaggaaacagggttgcaactaaaacagatcaataattggtttatcaaccaacgtaaacggaactggcacagcaatcctgcttcatcctcatcagacaaaagcaagagaaaaaggtatcgtgtcgtggacttctaacagaaattccttttacatatttttggtttccattttcctgtctctgtctgtttatgcctagaaaaagaagcaatgcaggtgatggcaaggccgagcaatcttggtagaacgtggttggagaagaagtatatatatgtaaataatgcatccattgtgaagaatgccagtatatttattgctcccaagatggcgattcggacagaagcttcctggggctaatttatacgaaagaaattatgtcatgttataattttagtcatgtgaagctatagtgcgtatatatagtgacttaccagagagtagtttttatgtttgctgttggctagtgtgcatttgtagttgggacgtgctggctgtctctctacagctcggtacaaccatgtatttataacgtgttgtgaagcatatgttgtaaaatcgtggaatgggagtgttctgcgatccccatatgttgttgtaatgttgtatattgatgaccatgctgcaacggcagcatgtttgtaactcgttatatcctcaggctcttgtgttgttacaaattacagaactatattgtctttaacgagcatctcctgttgaattaataatagccagacagtcagatttttgttggatatttggataggaactttcttaaattgagattcctcgtccttttcatttctgtgatgatcctgaggtcgaaccggttgatgattgctgttcagaagattttttttttcattttgcaagtgtgaactgcaactgtgagcgtggaatggcgagtagccatcaccgagggcgacttgtatttaaattgggttcagagaagttttcaaccaaaatctttgtagtaatatcgaattttcggtgatgttatcgattgaggttatctgtagtctgaaagtcccatgttcactttgaaaattagggtctttgaaaggcaagtatatgccatgataaacttccaatatggttggtggtaatcttcaatggcagttttatgtttaacatgtactgttgaggcacactcgagactcctgaactgcgctcagagaagtccagaacacaagcaacagagagagcgtttgggttggttttgatgtgaatcggtagagagccgtgtgttattttggacaatagttattgcaggactttccagtctcatcgaaaggccgttctcgcatggaaaatgacaaggaaaatatttcggccttttacatgttctgtgattatataaggaacatggcactgcacgaactaaacagaataatgccaatcacttgaaaattacaaacttcacagaatttcccttcattttggtgcataactttcttagtagcaaagaaattgacataaaattgttcagcaggcttctggcacacaaaacaagataaaacagagtgttgttctcttgtaaacgaagatttatttcaagaccatatcaaagtaacagacatgaggatgccttcagcagcaaaacaactgcatctttcgatccaaaaggcagttagatatcaaggggttgcctcaagaacatctccatttgcttcgccctagtcttgatcgacatatcaaacaccttctgcccaaattgaataactagccctcccatgatgctgtagtcaatctgcaggcaacaaataattgagtgcatgtcctttgaatatcacttgacagactataggcaactgatgaaccaaggaattaccttctgttcaatcaagatagttttgttcttcccaagaatatcttgcaaggtctccttaagttccttctcctctttttcggggagtggctaacagcagaaaaccagaaagtcagcaagagaaaccagctaactacagtacaaggaactataatagaagctgcagtacgtacaaatccataaatatcttgaccaattgatgtaagctagcataaagaattctagaagctgattcttcaacattttgtagagtgattacgatagcaacagttgctcagtattgtatgttgtatctccatgaggtatatcctcattggaaaaaagaaggggttatttttcatgtgacaatttatttaacgagaaggaaaagaggagtgaaaagtgtctcgaatttctagtgtggcttatatttgggaaagcgttgaaaggttaaaatacatatatttgaaatcagagggtataatataacaaccagacactgtcaggaaaaaagaaaggagatcaaaggcttcagacatcaacttacaataactgtcctgacaaggaccttcacctcccccttatgtgccatggtcaaatcaacaaatctctcagcaatgcgatcaatgtgcttcagtctgccattgtcggcgagcacagcttcacaggaaggaaaaaaaaccttaggtgctaaccaaaagagtacatatggaaaaagaactccgtgtcatctattaatgatactgagtacatgaattaaaaacaaggttctaggaaagcgttgatcagatagttagccctttcaaaataaaaaactgtaattattgtagcagatcaaactaaaactacaaatattgttggctcacattgaaattataataactgaaggtagcaaaccgttgatatacaaaatggcattggaataaaaatttctgaaaataatcagatgcatttggggtttgggcttgtcctcaagctacctctataacgagttggtttactatcaactgcaacaaagttatcataaacaaatacaataaacttcattagacataacatgtgtggaccagaagtatacccaagaaattctttgtgacatctgaaaaaccagcttcagcgaaaatttcagttattgccttcaccctggtctctttgggcactgacaagtccttaatgaattgagaaaacaatggactcttcttggatgcctctacaacatcgcgaatctcagtttcaactttgtccagcaagttagctttggccgctgtaaggaacagagcactagcatagttgccggtgccaccatacagagcttctggaacctattgtggcaaaacaaacacaacaaataagattaacatgagtatctcagggcaaaataagaactactcaaactgccaaaagtaacccataaactgaaatggaaaagcactaatcgaaaacaggcagaaatcatgttgagataataaaaaacaagaacaatgcatatacaaaatcatctaccagttgaatataccgcgagcaaattttccttcgatgaaacacagtctctaccagtattgcatcatcacatttcctaacagggagaggattcatagccataacaccacaacggcacaaaaataaaagacacgaatcattttccacaggcagcagtacaaacaaattgcacattttctcatgtcacagaaccaggctaaccagagaagctttcaccaatgacgtgtataactattaacattcccccctgttccctagcagtatcaaaactacatcggcatcacacgaaaaaatgtgagcaatccaacgagatgcccgttccaggttaccttgatatccttcccggtcggctttgccacctgcgacgcgaagccccttgagccctcctgcatcatcacaaccaatcacatcaatctcaacaacaacaaccaaccaacgcgatccaggcaggcgccgcatagccaacaaaaaaaataaaaaaaatcccccacaaaaaaaacaccgaaaatcccagcgagaaatggatgacctagatcgagcgtgggattcatgcgccacgcatctaaatcgaagggggggggcggggggctcccctaaactggaatgaaatcgaagggtgcgaagagggggaggggaagacctgggagaggtgggcgcggaggagggggaggccggatctgaggtgccgcgccgccattcctgcccctcggttcgtcccctctgcggcagcggtggaaggcggaggcgaaaccctcggtgcggcggaggaggaggaggaggagatcgaggtgaggagaggaggggaaagaaaattatggaggcgatgcggaagaggagagacggagctagctaggggtcgcaacttgcaaccactacggaagagagtggttcttgggccgtttaggcccagtgtcgcaattgagagaaactgttatgggcctcatttgggtgggccagaatccccgtttggtcgttgtacccatcgatcgcccccaagaatcttgggctggtttcagctctcacctgtccatttacggccagtttggttatggaattattttcgaggatcaccaacagtatacctatctcaatcccaaaactgattttgaagaattttagtctaaaaaccagctataacagatcccctactttcctacctgagttttggtgttcccttctcccgattactcgctccgtttatatgcgggcgcgaaactcgctcacaatctcgcactcccacctctctcctcccgttgccgcgcgtgggagatagcgatctttctacgcgtgaaaggaaaaaaaaaacggaatttactgttggtagtttaacagaatggcccacttttaagctttggggattgaatttaaagctatctgttggagggaggagttttttcacttactattttcagtttaggaaacctataaacaattttttggagaaatattataggtaatctgttggtgatatgtctattatttgcttggataatgtgggagttttagaagggattggaaaggagagtttaagggtgaactcccaccttttcaataactgtgtagggtagttaattgggagataattatactttctaagtatgacaagataaatatgagtcgtgcatcatcacttaaaatttaattcttatccatactccccattatttccacctctactactaaacaaaggactgggagtaaaaatgaaactcccatgatcaatctcttttagagctttagtagacctaactcgtatagttaaatttaatcgttggagttctgtcaaatagatccaaacaattttagatccacctaaaaagggagtggagcttactagagtgctctcataaaatgaactagagagatggagttaggtttagtctgctccacaactgtagatctaactcctaaagttaaatttagcagttggagcaatggtaaacacacctgaaatggtttctgaactccacctcaaaagaaaacagagcaggctgcagtgatatgagaaaacaaactagaagtgtggagcgatggttcgagctgctcaacaactacactatagactcttcttagagttatatttagtaattggattcctaccaaacaagctcatggttcacaccttcatttaaaatttcgtaatctaaaattgagaactctcctaaactagtttttttatcgataaatttgtcatcttgcttagaggcttgtttgttttggccccccaaaataaaataaaattgcaaatatcaggttagccactgttattacaaatttaggaatggattattatgtgaaattttgtaaactttgacatgagtgcttttatttatacttatatattatttatgtggtgtaccggtaaacggcaaatatatggctaatatgatgtacatttgtgtgtttataatgataagtgtgtatgtgtacatacgagcgtatgtttttatgctacggttcaggggggaaaaagaagtggaatggcatgtactatgaatttccatacagcatatgcacctccatttttcctaaccatgcgtagggaaagcgctagttttatgtgcataatgtacaccgagaaaaacaaaagggggtcaaatcaattgcagaaagatgaaagaacacatgcttcggcgctgatccgatcgatcgattgatcgatcggtctgggggattgggatggatcatggatatatgcatgaacaagggaccccgatgggtgtttgcggcggtttagctggacaggatcccggcttgccgggaagatcgataaaatacaagagggagaggattgcaactagtgcaacaaccaacgtagatcaattggacgactgcttcgttgcgagtcgcgagactggatctcggcctctccattcgttcccgatcctactgatctactcactgctagtactactactatggcgtcgttgagattggagggtaaagtgtacaacccacgtcgccgtggagatcggtgagcaaagtgtggagacctatttggtttgttgtgttctggaggggtcacatgttttaccctacagcgtatatgtctatgctaaaatttaggaatagatctttaaaacttgaatttaaaatcgattttaaggttttaatcatagttctttttcaatattgatattgaaaccattaagaacaaatatataaaaatcattttatcgttaatagatcgtttgtggtattatcggcaattagcccactgatcgatgacagccggagattcttttcggctaactgttgtgcgtgatggcgcacgcgtcgtgcacatacgcgttccatgcccgattcggggagcgaaatcgaccgccgcttcagtcacgacgggcgcgccgcgtccaccgaatttgccatcacgtgtcgccgtcagtcaccacatggccaatccgtcatctataccctctgtacgtgccgcgccaacagagagatgaagtccacagcgcaaacagtatccagatgatccactagacgacaaccatggcagattcaggtaacgaataaatcgcaaccatgaatccagaaacaaccatggcggattctaggtaacgagagattgttgccacgaatccaaaaccagctctttcttctaatatttctaatattttgacgtgcaatcttttcacgtgttcgcgaaaggaaatatccaaaaccagctcatttcaagcatagaagcagcggcaaaactctggcaagagagcaataaatctctgcaacaatagtcttataactatcttcagcaaaactgcaacacatcatacatgatgacttgtgactgttacaagagtacttaacaaatcggtatatctcacaaaccacaaaaaagaaaaacagacatcttattacaagcaaggacctcactctgtgttccaagacttgcaaagaccaaccaagcttaattacccttcaacatcagtttacattccgaccgaccgaccgattgactcccaaataactcaattattacccaggaaaagggggagaaaaagaaaaaaggaaaacatattgggctccctataactgactctagactaataacttattaaacgcacctctaagcaaaaggtataaatgaaagaatatggatctgagaccgtccattgcgatgcttctggacacacggctggtaactttttttgattacaagatatgaaacaatgaagaggtatgaacagatagatcctagggacataaatgaaggcatatttatatcagtgctgaattcctaaatacgcgatctggcagtagagaacttgtccaccgatgccccagaagtttgttgccggccattctgttacaatatcccatcccaggttgttcacctcagggttgcaccttatgggatgcagccatggagcgtaacctaccagcaatctccgtaaaggttggccgttcggatggttctgtcgaccaacattgctccattagtgatctccactctggatcacaagagtcaggtactgctggtcgtagagtgttgctcacaatgccacctgccaagagtagaaaattttacaccaagcttggcaatcaaatcatctttgtccatctatattgcacgtataattcctacgacagtatcagataaggatcatgtaaaatctgaaatgggaaatcaagaccaacctataataacaccataatgcagatctgcgtatggttcttctcctgttaagagttcccagagaacaatcccaaaggagaacacatcaacctgaggcaccaaggcaacgttaatgttagtttaatatggacatgaatgtagcaggtcaaatgataatatgacacaatcaatatgtagaccttttcggagaccaagctgctacttccattcagaagttctggagccatccatggaagagtccccctcacaccaccagagatgagggtctgacattttacttttgaaagtccaagatcaccaacctacatcatcgaagaaaattattacaaaatagctaaatatataggggaaaggacaccagtcacctaattatattttcaaaaggtcactttgttggcacaagtaaaatgaaatttgctggaagtttgcatcagcaatatatcagtccagccacatttgcaaatgcctggtgacatttcaaggtgttaaaagcaaatgctgctaagtgtttcatagaaaattcaacaaagaacgctagtcgatcaactaaaagaatactccctccgtcccaatataagtgcaaacctagtactgatgtgacatatcctagggctaggaatctggatagacaatgatgtgacatatcctaggattacgaatctggacagttgcctatccagattcctagtcatagggtatgtcacatccgtactaggttgcaattatattgggacggagggagtacaaactaagatgacaaacaagcaggctcaagaatttgtacagagaggtctttgctagaaagcagatgtttataatctcaagttatatcaagtagttaaacttttagaaacttcctcttatcagatcgtgtacccatgccaccatttgtgtcttactaacatataataaaacaaatatcagagctgctccatcatcctatcatacatatgtcatgctccatgaagctgcagcggaagatgcccaagcggcagcaggttccaaccaagcagatataatcattcagtactaacagcaattctgtaccaggcaaactagatatctatctggatcagaacagcggacaccatatgctcctaagaagtaaatttacaagaatgtgggataataatgctaaaaattaccatgagtacccagtttaaaaggacaatataggacatactgcctaaattacctaatatcaagtaccacaaatattacagataagggaaatcataataatttagcaacacgatgtagcaatctaataaaaacaaatggagcctgctgcttaccttgcatattggacgctgaggatcccttaaattaacaagcaaattgtcacttttcaggtcaaagtgcactatgtttttgttatgcaaatattccattccgaaagcagtatccatggcaattatcaatctcttacgcttatccagggtcctgcacagataatttgattcaatcaacaccatgcaagaccaccaattttatgtgcattagacattaggatgtaacagatcaaagcagaagataactctgggtgtaaagggacatacttggcattcttcagcaaagctgttctgagtgaaccattaaccatgtattcagtaacagtggcaattgatcccccaggtccatcaagaacaacaccataaaaggccacgacatttgggtggtgtagatcagcaagtttagatgcttcattccaaaagtcattccgctgcagtaatccaggatatatcaatgcaaagacagcatagccaaacataacaatctgaagtgtgagaactaaccatcttgtcttgctctgatggcttcccagcaaaacatctgtcattgattcttttaatagcaacatcagatcccctccatttaccatgatatacggttccaaaagttccagaaccaagttcttggagctcttcaaggtcattattctttataatctgcaacataaacatttgattggtaacagaactaactatcaaagatttgcacgattaaaaagctatagttcacgaaagtaacctgcagacgtccaagatcatcagtagctggaaaacctgaaatccaatctgctggtctgctcttgttaacctgcatgattctcttgcttagcattaaggatgacatgaataaggacacatctgagaaagtaagaaattatatattaacctcattggcgtgtgcttcagcatctactttaccagtgacagcaccaactccatcattcaccacaggaggctgaggctctgatgactttgtattagatgtaggtaaactgtcctcgacacttaccaaatctgggctggtcatatcatcacctggattgatgcgatatgcagaaataagattcacaacttacaagtacatatattgacaaggttttatcaggaaatatggttaagcagacaacctttgatgaatcgaccatgctctgtatgggcgtccttgtgatctgattgttggnnnnnnnnnnnnnnnnnnnncggaatattcagatctggccctttgcaatttaataaagagttgtgagaatgtggatccttcgggctgatgttttccctgcttgctaccctcttaggtctcggtggcaaagcatgtgtatttgtcactactttccaggggtcgtcattgccaaattgctggccttgtaagccagactcttggatttggtccacattgggagcatgatttaccaatgctgctgcaggtacctgagcattagcatttggagctacttcatgtggaacatccttgcgctcacttaatggatttacagcagaatttgcatagacaagatcaacaccataagccgatggaggcactccaccaggcccaaccgtagctacaacataactcgagtagggacccccgatgctcatcatatgtggcatatggctcacattggtgtgctgaacattgtgcaaataagagctggcaatggaaggtgatggtgctggttcagttggaaggactaccttaggttcactgacatcaaaaaaggtgttggtgttgctctgactaacttctcttgctcgagtatctgggaacccctgagagttttctggtatggcattctggggtacaccattctcaggaggcatcactggctttctttgttcagtagaggcagaactggcctcactagggctcaagcggagcgaatccatcatcctgtccacattagccatataagtcggcacagcagcaggtgccactggggacacattatcacggcgcgtcagtccatcctcacgatgccttgcattgccacttaggctaccctcacctgtaagctgattgtttggactattttgcttgacgggatattgtgccattccttggcctgaaggcaattgctgctgctgcggtggcagcggctgctgcataatgtgttgatgagagcttgagatatcagaatgagccgaacctggagaaactactctgtccttctcatttggaatcacagggatctggttaaatccataggttgaaggcaactgctgtggtggaacttgctgctgctgatgaacatacacatgctgatgcaagccagatgggtcaatgagcactgtgttcggaatcccttcaacctgctgcgcatacatcatctccctctcatgcggcacgggatgcatatgggtgtacccataagcccccatcggaactggcaccgccctctccggcatcataatccttgccacgtcttctggccgcaggctcatgtataccggcaccgtctcggggccaggccctccatgcatatcgctaccgtagtcattcaccactggatctgagtgagcatgaggaagtgccttcaagcacatattgcagtcttccagccttcccccatttcctggcatcgcctgattcagaccctgcatggcctccctatgatcgttcatgaacacaggcggcaacggtggtagctgcgacagcggctgccggtacctcgctgcttccggctgtggattcgcctgcggtggagccctcacttcagcagcaatctcctgtggcttcacagggacaggagccggagcagcggcattgctgaacacatcgacaagcggtggcggcgccgccacaccaaacgccgatctcgcggcatcattcgagcaagtagaggtgggggagagcgcggtcggagaaccgccgccgccgccaccacccgaagtcggcgccggcggaggcggcccgccatcggagttctgcgtcgacgagaggctcgcgacgctgtccttgcgcacaataccgttcaccgcctccagataccggagcccggcatcgaatcccccgccctccgcctcctccccgccgccaccgcccgccgcgtcggagatggggaagatgaacaccctcagcttggggctcgcgccggccagcttgtcatactcctcgatcatgttgtcgagatcctccggcgaggacacggagatgagcgcgtcgaggccctcgtcggggagctggtacttcaccgcgaagctcgcccccgtggcgcccccgtacgcctcggcgagcctcccgaacagctccccgagcgccaccccgcgcggcaccgacacgatccgggtgtcgccgccggcgtaccgcagcgtcccgtcgcccgggcgcgggaggatgcggccgccgaggctgcacagcagcttcatcctctcccccgcgccgccgcccgcgtcctcggcggccatcggcggcgggcgcggggccgtccagtccgtcccaccaccaccacctcctccccctcctcctcctcctcctcgggctggatctagcctagggttttggagggggcgaatcgggggagggagaagcccacgcgattgcgggcgagcggatccgagaggggggaggggagcgagctgctcgatgctctcctcctcctcggcggagtcgctgctgctgcttgcgaggttagggaatttttttgcgtagtagtatttgttgttgcggaggtggaggcgaaggggggagaggagtggagggagggagggaagggggaaggggaggggaggagtagactagactgggggacggtgcgtttgtactcaaaaacccttggctcgcttcggttgctcgttttctttgttatattattttattatttttggaaaaaaaatgggttgtcacttatcggcgtcggtttttcttaggttaatttggaggtttctatttggttgtttgggggttttcttagcttgattttttgcttttggatggctggagaagattggtttttcgtttaaaagttgggaaaattttgtgtgtatgggttataggttattgtagaagaaggtatgtgttacggttggtatttgggttaaaacagatatgtgctacaacagagagctttatgtttctggtaaaaaaacagagagctttatgtggtaagacagtaatagtgatctttatctggcaagatgttattgtctatcgtcaatgcctcaatagcgatttaatgttatgcaatatcttagtaatggcgtaataaacatatctacaagatatggtttacgtgtgtactcgaaaagataagcatccaatgcatatcgtatagatagaatcaacggatacggccaagactataagtcaatgtttctacgcactaaaccatgatatgagcgtcaaagatatctgacgtcaacaagattgttgtgagataatagctcttctcgggaatatcgaaagatatagcatcatgatccgtgtattctatactttcggttggtttttacatactaatgatttgaatctattcttcattaatatttaagatcagtgacagacaattatgcattcatgggtaagaaaaatatttttactaccataaagagagacctaaaatgagccacttcgtcgcctcttttgaagtcttgaaattattgtgtttgtcatataagaaaaaaaggtacaccatctattttggtgggatgaaattttaatggcctagcttactgcaaatacatatggacaacaattgtatatttataaatagtcatagagttgtatggtgaatataactcaatttcaaataacttgttgaattgcatgtgaaatttgatctatttatttgggggaaaaaaactgtacccttgagggaagaagtccatcataatcatgaatgcgtctatctaaacctactgtggccagagtatttagcatcgtcatgtaaagataaaattgataacaacttataagtcttccttttaggcaactttgcttgtctcaatgtgtttccaacttgtacatttttattgtttccttttccacaatatatttcagtggagtgcatggacaacccatcaccacttccatgctggtagtattatcagattcttgcattgcttatgcatttgctcaaacacagtcccatgcattcttacacacaaagccactacttactagtttggcaccactacacccaacatttaccaaggttgaaagttaaaaactctagaaaatcagagtggtgttgctaaaaacacaaagagagcaactatacatgattatacatatattattgttttttactggcatacaggtattattttactcagccatagtggtggctgcctgtctataacaaaaaccacagatctactccagtcacacaagaacaaaattgaagagcctcgacctgaccttaggtggcatacatttactggcaccccctcattaaaaggacaactgggcctacaggaatgcaccccagcagaatcttaaagtagttcagttcattaataggatgctttaggttgtaattggagcacctgatccctcctagtaccatgacagaagggggagtgctttgctttagcctttagcatcatcctcctgcagaagtagcatcctaggagagtatgccatcctcttttcatccatagaacacatgattctccaagctttccatagaagtggaactatttcttactaatatttatgcattttgcgactaaaatgaaaaaggaaaacgaacgcgaaatacttataagttcattataaaaatgatcgcgtcttcgctcttataggtatttcttttatgtgctaaaactaagtgtttttttatgtgaaaagaaggcagttccaagcattatggtggattaatcttgctggtcccgacagaagaaagatgaaacctaagaaactgtccaactaggacggcaaagcgagtgttaaacaaaatggaagaagatgggagaaggacgtcgccatgggtggcacagcgtggggcctccggagctcgtgtccccaatcaggggtgttggtgtccgccccaacatctccattgggcaagaggatactccactttatcaagtcctttgccagcttcctcacaggtggtgtaatcatcagcattgatcatctttaaccaccacctagtagccaatactcaaatacagtacctgctatctgtgtggagagatgggtgagtggtagtaggagaaatttgagcaagctgcagttagatgtaggacagagtacagtagctatctactatgtggacagatgaatgagagtagtaggataaatttgaggaataagcggttatctatagtatttgtcatgaatttcctttgattaacgtgtaacgcgcaaaaaaaatcagctgaaaatgacggaggtagtaaaattttagagttcagataaatctaactatggtgatgatttaatatgaaaattctattttgaatctccatgatttcaataaaattgtaccgtaggtttttcaaagaacctgaacaactgaccgggttgctgtactataaatcccatgctggtcattttaaaatatccatagtttataacaagatgattgagttaagctccgatggaatctcctttgtattagagttgtttgcatgcatatctcgattaattagaaatgaatcttgtaacttaacgtaaggtaaggttattctacatacaggggagattgtcaccaggtgattccaagtaatctactccctccgtcctataatataagggattttgagtttttcttgtattgcttgatcactcgtcttatttaaaaaattttagaattattattttttttgacttactttattatccaaattactttaagcataacttttcgttttttatattagcacaaattttttgaataagacgagtggtcaaacaatgcagaccggtcatcttacctgtcgtgaactgtgatctgacatctatttcaaagaggacaataatttccatgttctaggtatgggccaagaaaaaaaacacgcacacttttgattactgaataattaaaccacctcgcaagtgagatattttagctttatgagatactagtttgctgtcgtgcatggaataaagagggatgtgattgtgaaagagtgaagcaaggatttcgtccccacgttgaacccttaatcaagggcaagagggtgtccaaattagttgatgatctgatcccggggaaaagttcatccttaaaccgtgattattttagcatggtttaagactttaagctaattggagacgaatgctgatgaaaagaaaagaaatactatacctaagcgtcttgatgcattcagttttggatgcaccctgtactttttttttttactcgtctccgacgcacacggcaagctgtttctgcgtgttcttcttgtcacatagcctgggatttgctgtgaccaggagggagcatagtcaccaccagccagcctcactgtcacacactgttttgcttaagattccttgtaccctgcactttattggaatccaggtccagttaagtgacagtcaaaatggtaacagtgttgagctgcctgaccacctgccagcaaacacaccttgatcctgtcacacagcaaaacggcttccgaagaggcatcctttgtaggattccaatcgtacataaaacaaattatttgacatttcgaaacagaggattggagctttctacatttcgaaacagaaaattctttagaaatggcttaatgcatgtatatcttagaaaaaaaatcagtagaaaacatatcctatgtagacaaacttatatgtgtatcgtgcatatcagtaacaaatatcaccaaaacttttagacaaaaacttccaataatattttacctacatgtatgtaaagttttaacttaaattcattatattttagtagcacctcaaaattacagttgtaatagtataaatctattagaattttattttttttatctctctatgtataaatttgaaggcgagactttacacatagacgtaacatgattttaagtacatgttcactttttctttactatttcggtaatatttgttagttagtttgaacggtatgcatacgaaagcttatgtgcatgacataagttcctaagttagtaagagctagctctaacctctttaaagtttctctaactctatctctcctctcatacaaatttttatgtttcttctattgtctgtctaaatgattattttcgtgttttaaaatattttatgttacacaagtacttttattaaaatcctatatttttttcatttttctgtgtttttcaccattccattatttaaaagggatctcagtgtgctcttcgattcttcgagaaacgcacatgggtcttccggctagctccacaaggtggtgggctagacgacctggtttcgaagcctcaccccttctaattattgattaggtccttccctgatgtacgtgttttctgtgctcttcgattcttctgttatcccatttaccactttcggtcgtctgaatttacaccctcaactgttttcagtgggtatgtcgtcgtaaaagatcgtgttaatctaggggaaaaaacatctttcacgcataacctactaataaagaagattagtagtagtaaagaagattactggttcactcccaaagcacatggccccaaatccccagcctgtggggaagcaagagggcacagatatcctcaagctcagtcacaggatcacagacagactcacagtgttagcctcctctccgtagcagattggcagatgagcaggacgataggactagcagtagctagtgcaggtggtgtttggttctcggagaaggtgggtgggatgcagggggcgagaccactccctagtttgattcatgggtgggatgatcctagtttttatttggtgcaagcgataaggaagaaaagggttggatgttgcctgaagccatcgtcaacccatcgtcaaagtgcttgacacaccccatacatcgaacaaaataatgatataaccgtgaattcataactggtagtaggttattatatttaggataatatgagtattttagcggtaaaaaattaccttttataagtaatagtattagattattatatttaggataacttattctattttggaacaaatgcttaagagcttacgatgcatgcccattataataacatactatcttcgtcccaaaataagtttatttttcacgcatctcatacatactaatacaaaaccagaatactagaatactgtcacgccctgaagtttccctctttgctttaaaattcataaaataaatcgtccgaagaaatgatttaatttaacctagagatgaatccctaaattaataaatgcaaataataattggaatcggtatgtggaatttttcttgagttctacatgtcgaaatgtgctaacaagatttttaatggaattttcagagctctagaaataattttaaccaattaaaatcgagcacaagcaatatttaaatccctggaaaatcccctttttccttttctcttctttttcttcctttttccttcctttttttcctcttattgggccgtaggcccacttcctcccgcgcccttcctccttgctgggctggcccactccctccctcctctctccgggtcaccgacaggtggggcccacctgtcggccccttcttccacctccagccgacggtggcaatcaccgccgaaaccgccgcgccgccgccgctttccccgctcctcccgcacccactccgtgccccacgcccctccccacattgtcgcgacgccgccctcgccttcccgcccgcgccgcgcgcccacaaggggcggattcgaattttgaatccccccagctctctctccccactcccccacgtcggtgagaaatccggccgcctcccagcctcgtccgtccctcccgagcccatataaaccatccccgcattctcctcctcatttttcctttttccatcggccgctcccgagctctccaccgcgcccgcaccgtgcgcccacccgcagccgccatctccactgctccggccgcctctagcagccgctagggccgccgccgcaccacgccgccactgtcgtcgggttcgcgcggccgaggtccgcctcgtccacccctcatccgtcacaatccgtcgccgaagatcatccgtcacaatccgtcgccgaggtttccgcttgccgtggactccctctctccctctaacctctctcttttcctctcttagggtgtcccggagctcggccgctgttcgccgtcgccctccggtcgctcgccgtcgccgttcgtcgtcgcctcctcccgcgccgtccgaaccccggtgaggcacccctcccccgtttttccccttcctctccctcctagcgccgagccggcgccgccgtcgcgccgccgcgtcgccggtcgccgccgtcggtggccgcttgccgccgcccctccatggccagccggcttggagccaagccgagcccggcagacaccacccccccctttggagccgctgccggtggggtccgcctgccaaccactccctctctctctcccattgagtcactgacccgtgggtcccgtttgtcggcgccgccccacccccccccctcgatgatgtcagcatggacctttattgcgcaataaaatccgttaaggccttttcttttatagtaaaaacacatttaatcttctaaaattcatatctaattcatccgaactccgtttaagtccattcaagtctcagtaaattcataaaaatgcatagaatccattaaaaatggttttgtttcctgtttcagtagtcttatagcatgttttgcttgtgtgctttgtttgtcgcgtagatctcggccgtttcgtcgctctacggtttctcgaagacgttgttgtggtctcatcagtgtgagaacaaggcaagtcatgcattacaattgatcatattgtacccaatttataaatgtcccgcatttctattaaatgttgcattcttttacaatatcatgtgggatgggtcttactactcagccatatattgtttacttcctccggttccatattaattgacgttttggagaaggttgaggtcaaacttttataaatttgaccatcaataactttaaaaatatttagtttgaaggaactagaacaacatatatagatttgtcttttaaagtactataataaaataaaagtaaacatgcatttatttattatatatattataatagaaaaataagatcaaatatgtatttgtagaccgtgtcattgtccaaaacgtcaactaaaatggaaccggagagagtatcatctattttcatcaactccgatgtaataagtgcgcatgtattatgagtgtgtatttggattgtgttttaaaataattcttaaaaataaatttattttaaataaacaagaggagaaaatgattttattattgtgagacggagggaataaccgcgagaaattcaggtgttttatccagttggaagcgagagggggagagaggccacatgggccacatgcccaggaatccagctagccggacacccaggtggcttgcaccctcttgcagtcgcgcggccttctgcttctttacaggttttgccggtactcgcgcgcgccccggaactcgcgtcgcgtcgcgtcgcccaccacttcttccccccgtctcgcctcgcggcgcgtcaccacctcgccaccaccaccgcgtcgcgtcgcgtactactcgcgtggcgcgcctcttattctatgcgtataagagcaagtattagtacagtggactactcatagcaagtttaataatagtatagcccactactaactccaaatcatttatagacaatataatagtcaattcatgcaatatttgcttattatactattaatatctagtcccacctatcatacgcacattacgtattgcagtccgtgctacagatggctacagatatgtaacttgctgctcttctctcttcctttatctttttaaaatatgtttatagttggcttatagcctgctattgtacctgctctaacttcaaatcatctatagccaagttaatagttgattcatataatatataatagttacatataaatatatattacactattaatatatagtcccacctttttatacacataaaacattttgaaatccgtgttgcagctagctacaaatttgtaacctaatttccttcttagggcacccgcaatggttatctataggctctctacaagagatccatgtcaacatattttcttacttggaagatattaaatgaagagagagagcaaaactatctactaacctggagatagtctatagagaaaaacgaggcaatgcattagagagctatagataccgatgtagacatactattgaggtgatttactattaatctagtctattgctgagatgtacatgttttatagagagcaacttactttaccattgcgggtgctcttactcttctctaaggccctcttatcacattcacttgtatttatagctaacttgtagtctgttattgtactcgttctaaggccatgtttagatcccactctaaattttttcaccctgtcacatcgaacatttaaacacctgcatgaagtattaattataggctaaaaaataattgcacgtattgcgactaatttgtgagacggatcttttaaacctaattgctccatcatttgataatatggtgctacagtaaacatttgctaatgacagattaattagacttaataaattcgtctcgcggtttactgacggattatatataattagtttttttattagtgtccgaacaccccatacgatacgctatataatatctaatatgacacgttaaaacttttacacctgatctaaacaccccctaaatcacctcacctatgtaccactgtactatccaccgctcccatgtcggcattccgttctttcagctgcgatttcctctctctttttttgttatcttctccgtgggtttctccgctcttctcacatggatctttgaccggggaaaagtgatggatggatgctgtgcattttgtttggtcacttgtccattcaggttttgtttggatctagtcttagatcgtggagatcatccagtggcagtactagtactttgttactgtatgtattattcaggatggattgcacatttgattagtatttgcatgggcagaaggaatcaggcaacagtttaagaacacaggatgcaatcacatttggcaaaggctttttagctgaagattggatactcctctcaatctgtcgcctcaaacaagcagcaatgtatgcatcgcacgtgaggtcaatgggaggggagattgatgtcacgtggcaagccagaaaagaatgggcatgttcactttgatttcattttcaaccttaccaaattttaggaaagttgctaaaaaaagtgactacatttagtttgctgtcaaattttagtaactatataagaaattttggcaaactatgttaaaattttggtaatgccaaaatttagtaaggttttttttttgcaacaaagtgaacaggcccaaagaaaacgtcttcgtacatttcgcttggtcgacatggcgagcacaggagcgaaacttcagtaaattcattatccatcatagcacaagtatcaataaaaaaaataactaaaataactttttttatcaaattccagtgtagatattacttattttttctacttttaatgtacttgtttcatactgccacaaacttcaatataataattatttaaaaataaatttactttagaacaaatcagagaagaaaaatggtgttattttaggaccaagtatgtccgatgtggttaggcagctgtgacacatacggatgtttctagctgcaaccatgactgtatttaattggaccagtggctcagtactcctcccatacctgccacaccagacatttccgcacctaatttgcttttggttactagggctacatttgctgcaaccttttcttcaatcttgtctctttgcttgccttgcgtacttggctagtagttggtcgtcttctgtttttttatgggagaaaagaggcccatgaatgttcttggatcacgataggccgttctaagtctacaagcctggtagtgaggctggtaggcccaataaattcggcccattgaatggcccaatcctgacatgaaggcgagaatcagtgggctccgtgtgcaggtaatcagattctggaagtgagcctcaccatcaaaggccgtgtgtctgtggcccttttaagctgttgctggtttgcgacgggaaaaagtccacttagactcccttaattgttcaccgaatctaattcatgagccttaactgaaaaaacgggtagaacgactccccgaattatagaaacgagtgtattttcactcctccagaggttttggagggcggtttttactgacgtggtggtgctaacccgatttttattacacatggcgcttatgtggcattagaatttaaaaaatatccgtgggacccatatgtcattcaaacacaaaatatattgtgggacctaccaacatgtggggcccacatgtaatcctttctccttcctttcttcctcctcccttcctcctcccttctctctcttttctctcccccttttttcttcccccttcgaatgagcagcagcagcaggttcagcccaccaccacccaccacattacccgcaatgtctcctgccgcgcccgccccagcgagctcctcgccatcgtcgaccccagcggcgccgccaaagtccacccttctcaagatcctcaccggccgcctccacccctccccgcctcccgacctgctcctcctcaacggcgtccccgccaccaccgccaaccaccgcccccgtcacccggcgcgacgtcctcttcccgctcctcaccatccgcgacacgctctgcttcagctccagcacccgcctctcccccaagcacatcgacgcctgcgtcgacactggagctgacatgggtggaggcggaggagaaagaggcgcactcgcctcgacaccgtgccgcctcggcgtcgtccgccgtgcaccgccgctcggtcgtgccgccccttccgccgccgctgcacgcagtcgtgtgccgtcgtcggcctttctctctcaaatcccgtcgccgtcgcccttcccgtgtccctagcgactgccccgagtcgccgccctagccgctcgtgccttcttcccccctttcaccgcaccgcttcttccgccgcgctaccgtcgccggtgactctcggtcttcacgccgtcgtgtgtgcgtcgcagtggtggagtggctcgaccaaaccaaccgtgcgagccgcgtatcgctccttgcgcgcagccatgtcggcactccggcgagcttcgccgccgccgccggtcgccatcgtgtctcctctccccaatccaagccggtgaatggattgcccatcttctcctctaccctccagtgctagcactttcccccggatcgccgccgtgagccgtccgatccggcgccccctccttctctcctctcgtcttgccaccgtggctgcccacgtggcgttgaccgaccctgcccatgtccagtcagccggtcagccctcctctctctctctctcccgtgcttgtgggctctccacgtaagcggcacgtcgacgacacatgggacgaaaaccgggtcaacaccaccacgtaactgtcacgtcagccaaaaccgcttgcaaaatcacccagtaagttaaattacacctgttttaatagtttaaggaatcatcttatctggttttctggttaagggtacaaattagattcgctcgatatttaagggagtcaattggacttttttcctttgcgacgctgctaggcccgtaaggctatacgacatcaaaagttacagtacgcattgcgctttaggactttctttcttcatcttaaaaatcgaattattgacatatattatatgtttcatgcttcgaaacatatattttcttaaagaaaatttttctactacattactacattaactatcactattgcctctttctcctagtagttgtaagtagtagtgctagttatttttggctattatctaaaaaaaagttatttttggctgccctggcggcctgttttttctttcctgttttgttccagaacatgaacaatgttagttagatcatgttttgtcacttgaaagcttccgatagctggagttatatattacttcctccatttcacaatgtaaaactttgaagcattgcttatattaatatagatattaatgaatctagatatatatagtgtttagattcattaatatctatatgaatatggacaatgctagaaaatcttacattatgaaatgaagggagtatatcagaagcttttcaaatataactagtgtctacatacccacaaatccattggtcatactcgtgacaaaatgcagaatgcaatcttttattgatcggtggagctgaagaagcaaagcaaacaccttgtgacgagttagatgggatcaaattgcacacggaccgcaccgggtacttcgggtacttctatagttaggacttgttctttcctccaataaaagttggacaaaaatttagatatccgtgacacgtttcatgtgaaactttctatataaaaattactctaaaatatcagataaatataatatcagataaatatatgttttaagtttgtaatagataaaactcaattaaccctatgttaatagcatatcgttttatgtaaaatacttaatctccatctgcatgagtttcaaaaaccaccttagtccaatgtagcagcagcagctcgcgcacacgtgcacgcgccaattcgagtggcgagtactgcgcatttgaccgtccaaaagcgtccgctagcttgatccacgcacaacagtcacgttacaaaaggggtggcactcgtagactggacagtgcaagtgtggaccagaccgtgtggtggcaatggcatattggcatctgcaacgggcaagacggcgaggcaaacggctacctccactcaactcgcctcctcgccttccccatcgcatcggatccaccaaatccttctcggtttgacccagcacgcgcatccggtccaagtccaaccaactggctgcgcagcctgcaacgcagcaacgtccatttctctctttttttctcataaatccccttaatttttcccctttctccaaaggcgccaaattttgcagaaaaatccaaaccccggctcaatccccaaatttcgtcgtcatatcccccggcgaaaaagaccaatgcgcacgcgggaatgggagtacactcctactgcgccaccaaactcgcctcgcacacgcgcgggcccacatgtcattcaccgattcacgagtccaaaactaccgcggtaaaaggagggagagattttttttcaagactaaaatcgccccaattctgggatacatcaccaatttttcacaaacatctcgatatgtatcgaattacataggaaaccatgtgtcgaaaccatgggaacatttcctctaagctaatagtgtagtaataatctcacaatttttgatgctgtagtttaatcatgagtacacagtttaatctctctatagtgaagaagagttagggcgtggaggaggagacaggtggggtacagttcatgagatggcgatggccgtcgaccgccgcgccggcgccgccaccggcgagggcgggagccgggaggagaagttcttgtaccggaaggccgcggcggcgtcgtctgcggcgtcgtcgtcgccgtcgccatcgtcgaagttgagcgcgtagctgagcgggtcgtacccgaactcccccgcggccacccgccgcctccacctcagcttctccccgctccgccgctcccccggcgagccgaagcagcagcacaccgtcgtcctcagtctgtgccttagcgacgacggcgacgtcggcggcgatgcctccatcgagctagctctcgccgtagtagtggattgggatcactggtgattttttgagatgaattttccgatgatgagatggtggttttggtttgggtggagagacgaagggtgcggctaaatagggacgggcctctgacggcgtgaactgggaagtgacggcggctagctactactccctccgtctccgtcccaaaataagtgcagttttacactattcacgtttaacatttgaccgttcatcttatttgaaaattttttatgattaatatttttattgctattaaatgataaaacatgaatagtactttatacgtgactaaatattttcaaatttttcataaatgttttaaataagacggatggtcaaatgttggacacagatatctacggctacacttggtttgagacggaggtagtacggagtacgcggtgggggaagcgccgttacgcgtgcagttagacgtgggggccgtttggggattttgcttagcgtaggcgggttgcggatgacgacgtggggcccacggctcagcgggaccagcaacggatcgatgatgattgatgataacggtcggtcgtgcaggcagcctgtcgcggatgacaggtcagggctaatacgatcattatgctgttgcagattagcatgagcacatatgtgatgaactattagggcacccagaattgttatctatagactctctacaatatatctatgtcagcatattttcttaattggaaaagattaaatgaagagggagagcaacgctatctactaatctttagatagtctatagagaaaaacgaggcaatggattagagagctatagatatacatgtaaacataccattgaagtggtttactattaatctagtctattgctgagatatacatgttttatagatagcacattattttactgttgccggtgctcttagcgattctacaaatctgtaaatacaatgaactgattgtgaaaattcaggctacttctaagatgtgaagaagattgtactggcctactgctattaattactctctccatttcaaaagaaattaatctaagatgagccacatttttatataggttgattttgattttttttggaacgaaacaagtaaacttattttttccattggcagtcacaccagtttgcaatcttggtctcctcctgggctacgcaatcgcgtcaaacgtattagactccgtaccaccttaattaagaccccttccccaaataggagtataataataccccaactaatcatcgccatatctccgtgcaaaaccggataagaattccacacagccgaaagagcaaaataagctcacatggcggccgatggcgtgcgttcgtccagctcctccaaagacccacagatacgcatagaacgcgatagccgactgattaagattctcttcagtcaaatgaacaaatgcacagtaactttgtcatatgaacttaaatattatcgggtttatatatcaataataaagtcacgtgacttcgattacagaggatcctcgtcctaagcgacaccccgaaagcggccccctccgcccgggccgcgttaaggcgaaaaaaaagcaagcaaaaaagagattagaaaaacgtttatgaacgcgaggcgaacccgatgctagcccgaagatatcggcgggcggcggcagcacgggcggacgagaaggcgaggggatcaaaggggaaaagcctggatagcctctccacgtctgcttttcgcgacggcgaccgccgccagctcgagtggtagctagtggtcggctcggacgaaaggatcggaatcagctgctgctttgttggctgtttgctcgtcaagtggcctcgctgaggtgcggggtgcagtggatcggagtggatagggcgaaatgtcctgcggttactgtcggttttggttcccgcgatgcagggatgcaggctgtttcgagcgcacgtagcacaccggatttgtatggctgcaacggatggtctttggattaggtagagggaaaaaagcaaaccgagtccctttgtagtgttttgtgtaattaaatttctcgatcgatatgttcatgattgtaacattgttgacgagtaatccaatagagctcgtttatatgcttatatgttaaattttataaattttaattttatagttgattttgtggatttttattatggtttattttacaataatcgctaataacatgtatatactaattttactaaattaattttaacttactaataaacggtggtttatataagcataaatataagggaaacaataaagccgatatttttatttgggtgcagccgtggaggcatctttgataatcggaccgatgaatggccaaatgaacaattgaagatacctctgagaacgaccaaataggttatgatcccgtcagctctccatgaaatgagagctctgactgcagagtcttaacgaaaataataatgctactaattcgcagatggagtaaagcctgacgcctaagggggagtttggatgggttaatccgtcacatcggatgtttaatattaattataagtattaaacgtaaactaatgataaaatctattttataaccctagactaattcgcaaaataaatctattgagcctaattaattcatgattagcctatgtgatgctacagtaaacattctctaattatagattatttagacttaaaacatttgtctcgtggattagctcttatttattatgcaattagttttgtaagtagtttatgtttaatactgtaaattagtgtccaaacattcaatgtgacatagactaaagtttggtccctgaatcaaaacacccctctaagatagtgtcatagtgcactagtgctacatgaccgaattatctactacgaagtacaagcgagagataaggatcagattcacaatcaatcacttttctcctgcgagataagctactataagttgcgccacatctcgatgccaaaacgaacggtggatgatgtcgtagccacgcatgctatatgaatggatagatatataccttcccttcctcccgcaggaaagaactagcatcactggttcactgtctcactcatcaaaagcttaattatgtaacactcaaaagtgcccattcgagaaatacacgtaatcaaacgatttgtttaacctgacgattttctccttgacccatgaggacatgagtcacgtcgcaccattaagctccaaaaaatatgagacaaaattgctgacaggatcacaggattgggttcagtctcgatttgccgatcgaacccttggaagctgtgggctaatcacaggtgcatgtggcacacagtaaattgcactaaaacagagggctaacttgtcacgtatcgcaacttgcaacgtacagtacccttttgtcggaaaaagttaacctaaatttagatgcgatgtaaactaatacaataatctaaatatatatttttttaaattcattgtactctactgtgtcataacaaattctagtttatttgtttttcctttttgcgcaggaagtaagttctcagagcaagtttaacagatgaactcactatcacttatcagtctatcttagaggggcgaatgcctttttctcgtgaaagggagatgcctaatcgtatcggttactgtgtgatagtctgacaaccatatggcgtcccatgagaacaaggataaatcagctataaacttatcttaaaaaagagaaaaaatgcgttagctctcgtatagtaagagttaactctatacgtgttttaagataaacacattgaatgtataagtaagagaaatagtgaagagaagaaaatttaaaggtaacttaatctattatatatatatatatagtaaatttgtttggtgctccatggtgcccgggcaccattgttgaaattgagtatatacctaattcaaatgcaattaaaactttttcaattacttaggtattaacattaactactttactaacaagtttaaagcaagtttgaactgaatttgaacttgtttttgttagatgttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatacagtgactggaaagtatcaacggccaggcgataattacgataagttgatggctgcaagcagttggcctgctgccggattgctttcgatcaatgtcgctagacgctgcacctgattaagggtattcccaacccaattactatgatagtgtccaaagtattaaataagttgtcacctagaacaaaaaaaatgatgtggcaagtgaataaatgaagaaagagaaggaaaccatgtcttatgtaagacatggtttctacacaacattcaagatatcatgcgagataatagtgttgtttgcattgaaagagtagtctctagtactagtttcttgatgatgtggagtttatgaaaaccatgtctagtgttatgggttgggactgctctaatgacgtgtatagacgaaatctccgaaagcaaatgtatcatgacagttataaatatgagagttttcttgcaaaatcatgtaaagttataaatcctgcgaaattttcctcaactattaacaactgccatacgttgcaacaaacttatcatcttcgtttcaaaataaacttacagtacttaataaaaatgtgacacaatctagtacaacgaatctgagcatctctatccccatacaatgttagctataactacaagaggaggaccaagacaacggagagagatcccatatcaaaacttcaactcaatatccagttgaattagccagagaaaagctttcccaaatcttgtaactttgcaaataagagatccaaagatgaacacgacaggagtagaatgttacatttccgagcgatcgatctaaacctatatgaaccacatgtttcattatttttcttccaaccacggactcacatctgtacacatgctccctggctgaatccagaaaggggttggacatttctatgctattggaagtttggaactcaggctccggttgctcgatctcatcgtcgtgggcaatcaacgatgtttctctgtcagacatatagaagagaaagctctcatttttgcatgcacatttctcaagcgaccagacatcatgtttttttaaaaaatataaaaaatattttaaaatacatcaatttatattaaaatttaaaatagtaaaatacttcactaatcgtatgttacactgtaaacttagccaggtatcgtaagcgcgtggtaattggagttgagacctgagacgtggcatctggcacgcgaatgagtcacgtaaattggccttgtttagttggggaaaatttttaggtttggttatcacatcggatatacagacacacatttgaagtattaaatgttgtctaataacaaaacaaattacagattccgctagaaaaccgcgagatgaatttattaagcctaattattccatcattagcaaatgtttactgtagcatcacattgtcaaatcatgacgcaattagacttaaaagattcgtcttgcaatttacacgtaatttgtatattttttcctacatttaatcctctatgcatttgttcaaacgctcgatgttacagcgtgaatttttttattttggaaacttaaacagggccatacgagaaggaaaaaaaaaatccgcgacccatcggagcaaaaaccacaccggcaccggcaccgcgcgaacggccgcggctcgcgccacgccgacgctctcccgccacaaccgcgggattcccccccccccccccccccaccgaacttacctaagcgtcgcctctcgtcttttttcccgtgcaacgttgcaagtgaaatcatcaatcgtgcgtgcgctgcgcccgaccatggagctcgcggtcagagcagccgccgcggcctcctgctcctccggcgcctcgctccagctcccgcgggcccgagccccgctccgcctccttggccaccgccgcctccccgctcgccgggtggctgtcgaggccgccgcgatcgccgtcgagccggtgagttttaagtcatttgatgttgccgcccctttgcctgacaggtgttcggcgttatgcggacctggcagcaggtcagctactaggtggtctggagctagtggaaatctcgcagcgattcttttttttttcttgcgcactgaggcgatttcttgcctctgctgtaaatggttagctgtttctatctcttctttgctataagtgcataggaggccatatatctgcaaagaagcttcgtagaatactgacaagatacattatctgtggatgatcagctgagaagttacatggacttatggacctataagttttttgagacttgagactagtgaccacttgggtaaattgggtttcgggtacatgctgatgatgactagcagtaacggggcacctacatataccatggtggttttgacttctgcttattcaaggtgcccacgtatgctggggcagagatgggcttgtcaataatcacattgcgtctgaatgtctgatgtttctcattagaccctgccctgctgtttgtgtgttatatcttggacttttggagttccaacctgacaataacgatagcctttttcgttctgtgtgaaactaaagaatttggctgtagcttctttgaagcaaaggctggaatgaattccattattaaaaaaaaaactgaagaattgattgtctctgtgttttacacttaataggaaaacaaagtaccgcagagtaacaattcagaagccgaggtgtttgcatgccctgtttgctatgagccattgataaggaaaggcccatcgggcataaacttgtacgtacaatttcatttctacattatgttttgcatgttttgttagattggcatttatgatatgttccttttatgcatgctccaggccatcaatttataggtctgggttcaaatgttcaaagtgcaacaagtcattcaccagcaaagatatcttcttggatctcactgtcacttctggaacaaaagaatatagtgaattgaagccagctagaactgagctgttcaggagcccactcgtctcatttctttatgaaagagggtggcgtcaaaatttcaatcgaagtggattccctggacttgacgaagaggttcatttctaggacattcccttcgttgtttgatatctcggcgttactaaataacaaagtctagccaacgtgacctgtggtgtaatatatttctgtttcaataagtaaagaagcaatgttaattcaccaagtgtttactatagaacataatcatttcttatgtatgtttttctgatctgttgttggtttcatcagtttcaaatggctcaagattatttccaatcagttgctggtggtgtacttcttgatgtaagctgtggcagtggcttgttcacaagaaaatttgcaaaatctggatcgtactcagctgtgattgctttggacttctccgagaatatgctttgccagtgttatgaatttattcagcaagatgatactcttgtaaacacgtgagctctcttcttcatgtctctgaatttcgttaatatcctttctgcttttcgtgtgagtacaaaaaattacagcatatgtcacacaaatgaaacaagacataaccttaaccacttctaacataaatatattatcaattaagcattttgcagagcatcactttgtctgtttgaagttactagtttatgtagtttaatttaatctatgcatcaattaccaggcaacacaaaaattacgtgattaacatccaaatgaactgcaattgacacagaattctattttctccatctggtgctttttaagacaaatactccaatctttatttagttcatgccaggtgcacaactaactgttttcctcttatgcttacacagaaatcttgctcttgtaagggcagatatttcgagactcccttttgcttcatcttcaattgatgccattcatgctggagctgctatccactgctggccctccccttcgaatgcggttagtatctgtccaatttgctctcatgattaaggtgactaatttggtctgtatagcagtattggagtctccagatttatgataatgaattgttctgtaaaactgtcatcactttaaactgctttcacctgaatctctgttcttctgctcctgtttaattatcaggtggctgaaataagtcgagtcctgaggcctggtggtgtctttgtagcaacaaccttcttatcttctcccaggaacaatcccttctctgttgaagcgttgcggccactgagacaggtaactttttctacttattttctgcttatctaaccctatgagcttatgcagtcatactcacattgctgctttatatactgcagattgttggaccagttaacaccagctacaattacttcaccgaaggagagctcgaagacttgtgcaaatcctgcggtcttgttaattacagcagcaaggtccagaggtcgttcatcatgttttctgggcagaagccgtagcctaaaattacatcaaaacctttgtagccaaagtatagctgtcaattctacaaaagtctttgtaaaatgccattcaccgatacctgcatagattagacccagcagaagtttttgcttggaattcctctccctgttatgaagatatagttgtcacatgtatactgtgcttcagtacagtgatgtaccacagccagggtgtatttcacacctggaagaaaaaaaaaacgttctagtactattttcccaacttgtatagggcctcttttggaatggaggattttttcaggaattgaactataattcctgtggaattcctataagattcctacgttcgaaagggccttaaatgatttatttaggcccataaactttcaatctagggtttataagtttgcaaaatttatattagtactacctccgtcccaaaataagtgcagacatgagtttccgcgcccaactttgatcgtctgtcttatttgaaatttttttataattaacaattttgttgttataagatgataaaatatgaatagtactttactcgtgacttatgtttttattttttttttcaaatttttttcaaataagacgaatggtcaaagttgggcgctgaaaattatggctacacttattttgggacagagggagtagttcactacaagtccaatctgccaaaaggttacatcaacatgttatgtgtgaatagcgaccagagttgagttgtgggactggggacaatcagaagacgggggcgtctaagtgtctactccctccgttcctacaatataaaggattttgagtttttgcttgtaacgtttgaccattcgtcttattctatttttttttcaaatataaaaaacgaaaagttgtgcttaaagtactgtggataataaagtaagtcacaaataaaataaataataatttcaaaattttttgaataaaacgagtggtcaaacgttacaagcaaaaaaaactttaaatcccttatattatgggacggagggagtaactattagccatgtttagatttggtgtttaactattagtcactcatatataaataacagctctcatgtgtctttgacataggggtccagtgacaagtgacagatagttaattgtcacaaagtggtaaatatttaaatctctcccagaaaagggctggagagaggtgatccgtccgcccatgggctgctataaaaagagtgacggcccatctagtgggaagattgggccctccaatctaacgtcggttcccaccgcgtaaacggcccagatctcacgccagcccggcccgcctgcgcccgca

SEQ ID NO: 60450 - DNA, 2677 bp, Oryza sativa
  unsure (1)..(2677): unsure at all n locations
cgtgtccttgaagtgcgatcttcttnctaccgcaagnagnncatcatacagncgnccgtaaaaaaaaagggcagaaaaaatgtcacgcaaaaaataaaacgccatcgaaaaaaaggcaaaatttggatcggtttctcggtgacgtactttttggttttttcacacacgcgtcgacgtacttcccgagtcctgcgggagtcctccgtgcgttactaaatcagtttgggtcaggtttttctgcacgtatatatcctattcacgatcacaatttgattcgataagtttcaagatttttttttccgttggtagagatagcatccatccagaaatcgaccgcgtcggtgctgatcaaatgcgatgctaacaacccacaaaactttccttgagctgagtctgccaaataaaaacatgaagcaaaagcctcattgtgacctaaactcctctcgtcacctagcttgttgctcccaccaagcggccaaagccaatcaatgtaagcccatgacgtgctctcgactatcgtccatacgatacttacaatacttgaggcgaggtgggagtgggcggcagcggcgacgacggccaggaggaggagtgacgagacgcggaggaggacagagagggtggcggccttgtcccgcgaaacggcggcggtgcaaggaagaggcagccgcagatcactggcgacagcctccgcattgccgcggggagatctttgccgtcgccatcgccgcgggataggacgaacgcgatggccgaggcgaatagcagagacaggacgcacatggcggcgcagggcagcgccaccacggagcttccctttgccttctcgccgccgctgggcggcggcctccatgttagccacctcgaccataggcttttgatgatgatgtgtacacgtaaggcccacttatctttttcgtcgcttattatcgcgtacagttttgctataaatctactaacgaattccttccttttttaggagaaaatttttccacaaatatatagatagtccctgtcgcgtacatagatcacttttccagcattcctgcccggcattacccaaatgggtcaggcctcatggaccccaatagaacccttgagcttagtgattaaaaaataatttgtgagtaatttttgtatgtgtgtctttaacggctaaaaagttattgctgaaaaagaaactacgttgaaaaaacatcaaaattaagttaatcgtattatgagtaaactaaaaaccgaccccattaagggctcaccacgacaaaggcattggaaaagattgatgggttaatcctcttcgatttcccttccatccctttaagagagaattaacaaaataaggcctaaatcgaaaaaccgagtgctcacccctgtgtgcacatgaagtagttcaagatcaatcccacacaacacaacaccaaatgcatttcgccgccccccggcccggtgccacccaaaaacctttcatgcatagtacacaagctgaccaacatatcaggtgagaaaaagaaacatcaacatattgggacaagaaaataaatatcaggaagttgaataatgatggtgaacttctcaatagttgggaaaacgccggggatcgggcgcccaacgtgcataaagaaaaatcgccccccccccttaacacacatgcgcgtgcgccttcggctggcttccacgcattcccaccactggcgttccattgaacaaataccccacatattacggaaatgccctattaaaggaaaccgtttcattttttttccaccaacaatgtttcagctagcactactacagaaacctggattggtgccagctgggaacccccgttaggtgtcggtttttccaaccggcaccccacaggcgggactgatgactagtgccggttgtagaaccgacacctatatcatatataggtgccggttggaaaccccacaactggcacctaagaggttccactagccaaaaaaaatggctcgatgcatcggctcgagcagctccacatcaccaaaattcagctccccatcacccaaatccaagaacacattcatcaagaacacatttctcacaatatcaccatccacccaacaacacaaagaggcggtagtgaatcaacaataacaacaacaacaacaacaacaacaacaacaacacatttttgttgctcgccgcatccaacaacacattcaacaacagcacaaaattaaaaaccaacagcaacacattcaccacgctgaccgtggggaggctgcccgtcgcgccgtgtgaggaggcaacccaccacgcccggcctcctccaccaccaaagtccaccacgcccggtctcctccaccaccaccatcgaatctggtcggaggaggaggggctccgacctcctccccgagctccggtggggaggggctgtgccggatctggccgtccctgagtgccggtggggtggggggcatgccggatctggccatccccgagtgccggtggggtggggccgtgccggagttggcctccctgagcgccgacgggaagggggtgggacggagaggaggagcggcggcaccggatctggctgcccccgagcagcagttgccggtggccttcccataccgccgcccccggtggaggatgaggtgaggggaaaggggaggagtgatgagctacatgcagagnacgcattcaaaccgcg

SEQ ID NO: 60451 - DNA, 5492 bp, Oryza sativa
ttttttgatatatttagtaaaacatgttcgataaacttggtgaaacaacgcccccgatttttaggcgcctcgcaactatattccccaaaaacttaccacagtgctgtcaagtactcctcttaagagggtataccaaagtgggggtgcatagtaccgcttgaccagtccgacgtcctacacatgaagggctggaaggtatattttaaagccctcattgttgtggaacccttaacttgtcttacaatagcctaaattccatcatgtagtgcccatagaacgactgaagtttaggccttagcttggtataaccaattgagagatcgagaactttacaattctacattccaaaggaggcctaggagcagctccagtgtttggtgaaatcgatcgacgcgtgtgaaaaaaaatcgaactgaacgtctaattaaggtggtttaaagatggttgaaagaaaaaagataaatgaaaagataaccatgtaaaaactgggcccgtttagttgcccaaaaacttttcccaaaaacatcacatcgaatctttagatatatgtatggagcattaaatataaataaaaagaaaaactaatagcacagttaggtgggaaatcgcgagacgaatcttttgagcctaattagtccatgattagctataagtgctacagtaatctacatgtgctaatgacggattaattaggctcaaaagatacgtctcgcggtttccaggcgagttatgaaattagttttttcatttgtgtccaaaaaccccttccgacatccggtcaaacgtccgatgtgacacccaaaaattttcttttagcgaactaaacaggctaagtcatataaaacctttagttttcctacaaacagtcgtactccctccgtaaaaaaaaaactttttttgggacggagggagtacccatcacgactaacgagagagcatcatacttgtcatctcctcatttattagtaaaagactccatcactcctgtcgatgataaaaaagaaaaaaaaaagaaaaaaatccacatattgcttcccttccatagtttaacgtttatatatattcacacacatacatggcacgaacaatttaaaatgttccaaattgaaacagggatgctcacaattaatttagacgtcaacaaagatgggactcaaaatcgaatcagaggcccatgacccctagagcaacggcaagatgggcaatggcctgaaacgctgaagcaaccttcttgatgggagagtctgacgctggcattttcgtcgatttgagcagggcaagcatcacaagtttcccgccccaccagcaagccggaagcgtcggctgctgtccgaggttggctcctgtaattgagatatatcacaccaaaatgacatgaaaaaaaagtgaagatgttttgtatttagttgttggttgttaattgaaagcattttacaccaaaatagaactgattgatcacatggaatttctgatatatcatttatgtatgtactcgatgcaactagctaggcctaatactttattcatgtggatacttaaaaaaatctttaaaataaatcgatatatggggttgggattacttagttttgaaatcctgcatccaccattcttcgatgctcacagtgatggaggcatggagccagaaattatcaaagaataaaactaagttagactcaactaatcagttgttcttttttttatttccaaaatttacatggtgatttgagagaattttaacaagattcgggaaacaatcctatggctcaaagtcctagatacattggactgcctccactcctggatgcgtatgggctacttgtagcagatatggtggtacatacaacttacattgcgattaaatggatcaaatataagttacaatgtaattatactataattatatatatatatatatatttagaagaaaaaatatcgataaatgtatagcaaaatcgttttgtcatggtgactatattgtcatacttgtgatacgcaacaactgaccttatggtgcacatgagctcattgtagtggtcatagacggcgagggtgtagccgaggacgccggccatggctaagccggtgagccagtagacgaagagggcgacgacgaggctgtggaggacgacgccggcgatcaccgggaagatcacccaccacatgcccaatcccgtcacggccatcgccgacttggcgccgtcggcgacgagttccccgcgcagcagcgtcccgttcacgaaggagaccaagcacaggaagtacgggccggagaacaccgccgcgtcaaacaccaccaaccccgccggcggcgggaactccggcagcatcatcatggtgacgatccccgcgaacgcggccgtcccggcgacgatgagggagaggaggcacctcttggatgactcgcggtgggccctctccgcctcggactcgtacgccggcgtcgcctcggcgatggcggagtggtggtggcggcggcgctccgcgacggcgtagcccagcacggcggcggtgtagaccgtgccgaggaacatgcccgccgcgccggtggcgtcggcgaggaggaggaggaaggcaacgcggacgaggacggcggcgcgcgctgccgtgctccacgacacggcggccgtccacacgaggaggtagccgccgatcagcggcgacagcctccacacggccgcggcgaaaatagtcctcctctttctcaaagccgccgcggccgcggggcagcagggacgccgcggcggcgacgaatagcagggacaggacgcacatggcgacctgggcggcgcggggtagcgccgccgaggccgagcttgccttctcctcgccgtcgtcggcgacggcggtggtttccatgttagccggcgcctcgatcgtcaattagggttttcgatagcgaacatacgtacgtgtacacgtattatgaagataacataaataattatataataaaatcgaattgcatacatattccgtatatattctgcatcaaagcaattcttttctatggaaaatcgtgttgaagtttctactttacatattcatgtgacttcaaaaattaattaatactttgagcaaccatataagatggatgaggcgtgatcaaattcatatggaaacatatatatatgatttttcttcttttgtaggggaaaaaaatccaagctagctcatctacccgtgttctgtagtcaaatttggcacaaattaaagtattaaaaaacatgcgtggatcagacaaattaacttccaatcatacatcttgcatatatatgtctagaccgaacaatcaacaaattagcgatcacattcttatagaaaaaaacatatacacgtctggaacatgcatggaacagcgggaaactattttaatccctcgaggggatgtcccctcgttatttgcatgtccccttattgcgagatacaaaagttgaatttgaacttgcatgtttttgggtagtagtaatatatcacgcgttaatacatcttcttaattttttttaatttttttataaacatttgaatgacatgaaaacaacgaggggatatccactcgagggatcaaaatccactcccatggaacggtaaatcaaaatgttccaggctaaaaaaaggtcgataatttgatctattgaaactacacaattaataattgaggtcaagaatatattcatggatccggcacattaatttctagaacaatgacaagatgggcaatggccagaaacgctgaagcagccgtgttgatgagagagtctaacgctggcactttcatcgatctcagctgaacaagaatcgcaagcttctcgtccgacgagcaagccggaagcgtcagacgccgtccgaggttggctcctgtaaaatcacagctaaaattaatcatatgaaacagcaagcaagatgtgtgtatggattatatatattgatcgaccgatctttaaacgtatttcacaactgactctctgaacgtattgtgaccagggatcgcaatttcggtcccaccgggaagtgattatctcaaccagaattttaggtttctctcatatttttgtgaatttggtcaaaatttagtcaaattcagttaaattatgctaaaatttcacaaaaaaaatcggtccaaaaattaacaaaaatcccaatatttcggtagaaccgaaatgagcgaagttttggacgaaattgaaatcgaaaaccctgattgtggccgtgtttaattcaacttctcacacttgtgactatgagctaaaattagtttctttttgaaaagatcatattatatactactccctctgtttcatattataagactttctagcattgctcacattcataacgataagtcttataatatgaaagacgtcaattgttcgattttatcatttactccctcgtctaaaaaaaaagccaaccttagtatggatggaacacttccaattaaggacaacaagtctgtcccatccacctagtacaacaaatctgtcacattcatgtcaaggttggttttttcgggatggagggagtaactttgactggtatagttatgtttaaaatttttcactagtccatacgaaatttctatggtcgaacaaagacctaattataatggtgtagatttgtagttaccttatgatgcgcatgagctcctggtagtggtcgttgacggcgatggtgtagccgaggaagccggccatggcgatgccgaagagccagtggccgtagatgaaggcgacgaaaaggtggagggcggcgccggcgatggccgggacgatcagccatgacgcgcccaggcacgccatgacgatccacatggtgtcgccggagatgaaggacccgcgcatcagcgtgctcgtcacgaacagcgtccagccggcgaggtacggccccgacaccgacgccgccaagcacagcgcgtccgccgccgtcggcatgccgccgccgccgccctccgccggtgcctccttccccaccacccatgacgtgaggacgagggacgcggcgacggtgaccttcaccaagacgacggcgacgaggatgccctccttgccgtgctcgcggcggtccctctccgccttggtctcgtacaccggcgtcgcgtcggcggcggcgttcgaccgggggcgccggcccgccgcgtggtgccggagctccgcgacggcgtggccgagcaccgcggcggagtagaacgggcggcgaacatggccagccgcgcggtgagtcggagtggccccaccagggaagcgcggccttcgcgaggaggagggaggcggtgacccctacgaggcgggtgggcgtcgccgacttcctccacacggcgggccgcaatgaggaagatgtagcccgaagatcacctggcgacagcctccacactgcgggcggggaagttctcttcgtcgccgtcgccgcggggcagcaagtgcgccacgtccgggacgaacagtatggacaggacggacatgggcaccattgtcgtagatggacagcgccgccgaact

SEQ ID NO: 60452 - DNA, 5502 bp, Oryza sativa
  unsure (1)..(5502): unsure at all n locations
agtcctttctcggtggaacagaaatgccgtccctggttacaatcgttaaagacgtcatttgtgtaaacgtgtacggatgggcgtacaacatatatagtccacccacgcttatggcagaagttgtcaatctcgcgggtgaatccattcattaatagtgtggttttgtgaaaatatactaccaaaatatatgtacttaagtaccaagtgttagtgtttgtggttttctataacttggaccataaaacgtgtagttttgtgaaatttactctagaatatatcgataaattgttttcttgtgtaaatacagtcggatttgcatatatattaattccgtatatatttgcatcaaggaaataattgttggggtttagtttatgaaagcaactgatggaatagtcaatagtggatgtgaaaactgaaaacaagatcagaatatcagatcatgtattgtattnnnnnnnnnnnnnnnnnnnnaacacaagatcagaatatatagcagatcatgcattgagtttgaggatagctgaaaactgggtgcctcatgaggcaaagaattagggttggcaacggggcgggtcgggacgggttaggttggaacgcccctgcccccgtccccgctctccgacttcttccccggccccacagaggtggtcgggcgggaaatatcacccgtccccgcccctgcaggggacccacgggtagttagcgtagatcaaatcggattgtactaattatactcagtgtacatttgtatcaagcggtctgctacttaattatagaaaatcgtgcagaaattttctgctcaaaatatatatattcatgtggttgatttccaaattaaattaagttttttgaaaaaaaaaagtgcaaccatagttatatggttatgcgcattgatttcttggggttcctatatatttattgcgtacatgtgcccagcaaactaagataagcatgcgcctatgtcagcgttctttaacatgatcaacatttgtgacagtggcacacgtgtcgtccataatgattccacgtaatcagagttctttttttttaatgaaaccgtttgatttagcacattgcatttttttatggtttttgctttctaacatctaaaactatcgattgaattctaaaaactcaatttaaattctaaacattttaattagaatacgtctcaggcaggaaccattaccggctaattaagttctctagcaaaacactactccctccatttctaaatatttgatgccggtgactttttaaaatatgtttgaccgtttctcttatttaaaaaatttaagtaattattgattcttttcatagcatttgattcattgttaaatatactcatatgtatacatatagttttacatatttcacaaaagtttttaaataaaatgaacggtcaaacatgtgctaaaaagtcaacggtattaaatatttagaatcggagggagtattaattgactttggacataacgtttaatcatttgtgacgtagtttgcataatatacgcacacaaatcaataaattacctatgtgcctcatattctttataagaaaatcgtagaaatgttccaaactagcactccctccgtccaaaaaaaaaaaaggaatagtatttgtccagattcattacactagaatgtcacatctactagattggttttttacgggggcgaacggagtaaaacggaaccgctacggatcagctcttcacttgacagttaattaaataattggggtcaataatatactccgtattcattccgtattcatggctccgacacttgtctaggacagtgccaagatgggcaatggcctgaaacgctgaagcaaccttcttgatgggagagtctgacgctggcattttcgtcgatctgagcagggcaagcagcacaagtttcccgccccaccagcaagccggaagcgtcggctgccgtccaaggctggctcctgtataatctcagcaaaaaaatatatatatatatatgaaacggcgccaaacaacactttgtagtatatacattgattgattattaattaaagatatttcagaagaatatacaattgtatataatggtgcatctgtatatactaccttaaaagactttaagtggtgctatatcacccactaacggacgttataaagttgtgatcgaaaggaattaaagcgatttatattatgtaataaagggagtagtccttagttactctatccatattttattgtatgacactattgattttttaagatacgcttgaccattttttttttcaaaaatttttatgtaagatacgcattatgtaattttaatatacgtagtatcatctattttattatgacttgatttattattaaatattatttaaatatgatataaatatttttatatttatataaaaaatttaaaataaaacaaatggaaaaacgtcggtaaaaagtcaacgacgtcatatattaaaataatacggagtacaggaaacacttttaatcacctaggtggacatccacccatttggtgcatgtcaactaaataggtatgaaaaaattcaaaaaatttgacaagatagatttacatgtaatatatcacccccacaaacatgcaagttcaaaaatcgtcttctacaagctgtagcgaaaataccaaatcaaactctaattagtatacgtatattcgcagttaaatttgttatttttgttacaacttataaaagttaaattttaagttgcatgtttgtgtagtgatatactatatatcaatctttcttgtaattttttttaaaaaaattttatgatcatttagttgatatgcacttaatgagtgaacattcactcgagtgtttagaatccaccttcagtacttaccgtatgatgagcatgagctcctggtagcgctcgttgacggcaaggctgtagccgaggaagccggccatggcgatgccgtagagccagtggccgtagagaacggcgttgatttgccggagaacgatgccggcgacgaccgggacgaacagccacgacatgcccacgcacacggcggcgacgcacatggcgtctccggcgacgaaacacccgcgcagcagaatgctcctcacgaacagggcccagacgccgaggtagggccccgacaacgtcgccgtcacgcacaccacgatcgacgccggcgacggctcgtcgtcgtcgtcgtgccccgtcggctgcggcggcggcgcgtcgttctcgttcggctgtagcgaccacgcgaggtaggtgatcgcggcgggcatggcctccacgaagaagacgatgagggcgatgaacttcttgcaggtctcgcggtggcgccgctccgcctgcgactcgtacgccggcgtcgcctcggcggcggcggcggcgtccgatgcctcggatgcctggtggtgccggcgctcggcgacggcgtagccgaccgccgcggcggagtaggccgtggcggccagcatgggcgcctcgccggcgagtggcccgaccagggagtcggcgtcggcgaggaggaagaaggcggagacgcagacgaggagggagggcgtcgccgtgtccctccacacggcggccgtcacgaggaagaggtaggcgcataccagcggcgacagtcttctcacggcggcggcgaagttctcttcgtcgccgccgcggggcagcacgtacgccacggccgcgacgaacagcagagacaggacggccatggcggccatggcggtgctgggcagcgccgccgacttcgccggcttcacctcgccgtcagcggcggcggcggcggcttccatgtcagccgcctcgatcatcatatattacgaacacacgtctatattgatatatatgaatgatgaagataaataaatgggattctcaattgcatagatattccgtatacatttgcatgaggactttttcctattaaaatgggtgaatagttaaaatggtcccctaagttttatctgaggctcagtttagtccctgatgtttcaatctatccatattagcccttcaatttttcattttagttcaaacttattcttgaaccaacaattctcttcataaatgacacttatacccctcatcattcacatatataagagaaaaattgcatgcttgaattttttttatagataatacatagataatacaaacgtatacgatagcaattgcttaagtttcatgtgcacctgttaaaataatagaaagtacatctgtaatgttgtttattcatgttggctttctcttttctaggatatagttgtatacaaattaagggcaaaaagaacattttttaatagaaatattgactagaaatagccatatggcatattaagtgggcccaaggatgatttcaagccaaaataaatatttggaggagctatgtggacaaaatgaaacgtgaaggaccaaattgtgccttcggtggaacttgagggactaaattagctattcaccctattaaaatcatgcagaaattgtgtgctttacatatattattcaagtgatttccaaattgaagtttacatttttacagccatagattaggcgggaaattaatttcctacgaaattattatggaatcactcagcctcaacacagaatctactaattcaggggaaataaagtgccatcatagtgaagtaatttcctaatacgaaattttctttagcagctggaaataggaacgacttcaaacattcatgaggaaaaaaaagacttgtttcatggtaagaactgcaattatacttgaccacctgattgtaccctacagtcacaaaagaaaaatctgtatatatagatgtgcctttttatatatacaattggcacgtttttaccctggcaaaagttgtaaatatggtggaatgcattcatattaacaaccacttaatttgcatctcaatctgtaatctcttcttgctaacaaaaacgaaaaaaagaagaggcaaattttcgatgcctaatttctgttcaaactgacaatatggtctggctacttagaggtgtcaaaaatgccaggccgtttgctgcctaagtgctctagctagctggagtattatatcatggttcagctcgctgacacatgcagtcaggcattgggagggtgtatatggaaatggaaccatttggtttcctgactccgaaacccttcgactcgctgtgccgatgtatgtcctgcatttggcgcttgaaccgatcccatctgcagccaagaaaatatagttgggtttagttcttgatcaggtgttcactggtgtaaagtggggatcaggtgttgactttgaggatcgctgaaaatagggcgtctaatgaggcaaattttttttatttggaaacttaaaagggaaacccggaaccatttttaatgtgttttaatgggtggtggaactccggtccaaatggcttcatttcattgctctacttcttgaaattagtaagtgggaacagggtattagtggcaatgattagtaaggtgtcacaaaaagttatagttgacatggat

SEQ ID NO: 60453 - DNA, 46128 bp, Oryza sativa
  unsure (1)..(46128): unsure at all n locations
ctggaccnggtgagattcgtttcacgctggagcaatcacagccacgaccctcgaaaaccactagagtcgacctgcaggcatgcccactctttgatcctccaaggcatgaaagtgcataaacaattcgaatggcacttaaccttggtgtaaatgtaaagatgatcacaggtactcttccaattgggaaaagaaaatccagatgttctattttttttatgtttttttatcacatttccaaaaaaaaaattatttcaggttgttatggtggtgatagttcatgttcagttattatatggtggatcagtaactgcaattttcatctacaatatgatgaacaactagcataaatgttcagtactgcaacctgttcaatcggaaatgcattattataatgtgccataaataagtaactcaattttcttcattaaaaaaaattaaaaaatccattgctcttctgtcattgtttggagccatgggaccatcaccagttcaaagagtctttagctctcatttactgaaaagaagctgctgttctgttctcttgaccattgtgatctatttaatcataactagtgaacatgcacatgcaaggcacgttttcgtaatatatatctttgctgatcatatactggtacagtattaaagaatcatcataggcaccggtaaaaatataattattgcattggttattcatgaaataaacctaatttgttattttattacatagcaacggaatgggaaaaatgtaaattatttgtcatgatagatttcatgtccacttccagaccagtcgctttcatgagatgaggtagcgtcctttagctctgatttgaccgtcctacatctgatggcattattgaggtattcatggatctgagatgaggtagtgtttttcagctctgatttggctgtcctacctggattctgatatcatttagtaggtcgtctctaacgtatggatgcacatgtatataatacgacacatttagtattatgtattttgtatatttaagtagaagaaatgaaatatgtgcatgtacctcgaatggaaccgtacacctcacttttttgggaatagagagttacagacaagctgcaaaacaaccaaattgtgtaccaacactttattaaattattttgtttgtatgaaaaaaaaaattgaccagattacaatgtcttcaaatcgcctgatcgaccctaatcgcacaggcggccatttacataaaaatggttgagatgcaaccaacattaatcatttcaactcaaaattgtattttgcacagtatcaaacacatactggtaaattgttcctttagtcaattcacataccacttggcatgtgtaagattatacattatacaaacagcttggagagcaacaacagtgacaattgtaatatacagtcatgaacagcaataaccttaatgtatctaaaaaaacatttatcaaaaaatcagtagtaaccctgtggtgaaaacaactttagaaaaacaactcccacagcacgatactgggagagccacttaccatggtttccctttcaacgagctgaaataccaaaggtccgaagttacatccatttcattgatttgacatcattacatgctaccgctgctaaagtatttccaacacccaaaaacgcaagttctactttctctattctttctatttaagtttttctattcagtaaggactaaatatatgaagtatctgagttagaaatatttgattgtgtcttggaaatgctattagctcatattatcatagatagtattattttacctttataccagagattagaaatgtacttttttactgttgttggctacaattacgatttgcaaagctcaaagaactgtctatttagtgcattttgctcttggaaggtacaatctgattttgtatttcgttgttctgattctaaaaaaatatctataaaaaatgcattgttccttaaaatacaatataaagaaatggatttctataggatataaatgcatagcaatcaaactgaaattcaataagccagtaatttacatatattgaattaatgaagtgagtatttggatgtacctgcactgtctcaagatatcaacacagtaggcatctctagtacacagattcatctcaccactgcaaagaaataaagttaaataaaggaacagacaaaggtgaaaggaaaaaaaatcgttaaatgaaatccaaatctcaaaatactctacctcttctttgttgtctcctcaacccctaaacttcacaaaagaacaagaaatcctaaaaccaccacagttcctgcaaactggaaaagcaggccgttgcatgatcctctcatattgcgttttatttcttatgaccaacgtagtgtcgtgcgccaaaacttgtttctcacctaccatgacctgatgtcaccaatgtagtgcacctcgatgacaagatagacaatagtacagtccggctgctggttgaactcaagctctcacattaaaggccctatatgatcagaaaaatacctctacttctgccccttttccaatgtgggaatttgtatagaagaattcaacccctctctgggtgcaataacttttgcctggctttctcttcaaaaatcgactaccaacaaagacaaattttcccacgaagaacattgtggaaacagcaaaatacaaaatctgcttgcatcaagacaaagatggcgatcacttattcttcaagtgctcctttgctgaagctttcagcgaatcgatgtttgcctagaaggcacagtaaagaaaagagaaactttatgatatatatatatagtagaaatgtgaaataaaaaaaataactctttttgcgggcaatccaaaaaacacttttgtgaaatgaacaaccgataatatataacacaacccctatctccctcggtttactcaggttgctagcgctccagttttctcggtgcatgagtatgggcgatctccggtgatctcgtccatggtgacgccgtcaccgccgggaggatggaaattctctcctggtgatgctattcgtgaagaggcttggcgtcgcttctattcgccggtccatttctcatcgaaattcagttcgtcacctttccggttagttgtggatcttccccgtgctagctttcgtctcactacttcttcggtggctgtggcccttaggactgctattggtggatctcctgccgatcttgtggtcactcatcttaaggatcgttcttactccttcgtggtctgttcgaagcaagtgggtttgtggatttatcgtcttaaatcttacacttgcggcgattttgttcttcgtttcttcctttggagacagggggccgaattggtagtgggaatttgattcttggagtcgggaacagaaaaaggaatgggtgcttgtggctcccaagaaacgatctacctcttccctaagacggccggatcgttcttatgctcaagttgttcagcaccgtgatatcctgattaagcaggttttttcaagtctaaaggactccttcttacgtgcctccaagcctgaccaacaaagaatttctgttttccaccggcttgataagaggaaaacagtttttatcacttctctagcgacctccaaggcggccgacgctgcgtagtcgtctattctggcaacggagttaattacgcatgcgaaaggtacacgggatcctaatttgtcgcccatttcaaatttggaaaacactccttgcggccgttgcctggaaaatggccattctcgggtttcttgttctgggccgcttagatgtcgggcctgtctcatgccgggtcacttagcccgtttctatttgaccactaagcccacaaaagcccaacaccctaaaaagctgaaccgtcggctcggactactactgtttggaaggccaaaactaatactctggaaatctcgccttcttcctcctaaaaccattcttctcccaaacacacagtgcttcccacccaaagcttccctttgctcccaatggccaatcttaaccataatccgcagcgcttcctaaggcagggtcacgctgtgaatgttgggggtgacttccgtatcccgcgggtcgacctcactatcctgcagcaccatgctcggcgccatgaagacttctatgtggccattgtagagccaatccccttggagcaggactgggatcatcatcgtgccctcattgccaactttgtacaagatgagctacactatgaggttcgtaatagcttccagcacccgtctacagtaggtttcttccagatgaagtctgctatgaatagggatgctctggtcctctctccgcccgagttctatgatggggttcactctgttacttttgttaatcatgaccaaggtcctaattggagggcggctaactaccatagagagggctggttcatgttcctagattttccgcttgatttcattgatcgccatcatgtgcacctggcagttacctcttttggtctgttaaccttttgggcggatgcagacagaatgttgggaagggtttttgttagggcaaagtacagggaccaggattttgtgctgagaaagattgttctctttgatcctcttggtgctgggggtgggggtgaatcttggacaatctcgattttcatgctacagggggattttattaatttcccccctgaagaggatctcccccctgccggtccgcagccgggccctgatgatgcagctgatgaggaccctaatgatggtaatgtttggcagtttggcaaccctaggaaccagggggctagaggttgggatgaggcagtgcagcaacattaggctgcaaatgaacagcaagaggatgcctggggccaagaccatctgatggggcaaattgaagaaaaccttggtcaacttattctgcctcaacagatggccacacctctctgatcagctaggaaggcaaccgtctaggatcctattctagacccacaagtctaggaattcttagctcagctgaacagaattgctagagatgaaactccaaggcacccctacttttatcaaatgaaaggcatattggacaagattgactttctctgtaaagcaaagggcatcatgcagactttgatccaggacaagcctatccctgctgctttgagaatggccaatcctttctcgacattggtcctgccaaggaagtacatctttgattcctctccctcagtgggccaacatgaacctgaatgggctttactgcctttcgagtctaattcccctcctctgccggaaagggtgattgaggatgttctaccaatcagtgtgaggcccccttctagcccaatcagtgtggcccctattgccctgcttccccccaaggcaccggtaaagaagaaaagatgggaagaccattctttacagtccttacagaagacaaagctctagacttctgcaggacatggcaaccaaagaattgcagatggatccaagaatgggcattgggaagccaaggggcaggtctgctaaaaagcttaaggaattagcaggtattgcaaaactctttattaatagtagtatgcaggagtctgatttcaatgaaacttcttatagtgatatgaactctgactcctctccctctaattgttcactttcggtcatacaaaagatgggggtagacatgtgcaggctctctcctaaagaggtggcagaatccagcctggggggtgaaagaagacagaagatccccaggccaaacatggaggataaataatgacgaaagattcagtcttgttgataggcctatgttttccatttatcatgctccaagggtctgtaatttgtttactgtcaaagttgttttattagatatttgtcctgtcagactgccaagacttgtgtgaatgtcttttggtttgtttttcggttagctgtgctagcctgggtacttttgcccctcccacaatggtgtgataatgaatagtaattttaaatcttggaatgtcttgtgctggaacatcagaggaatgaatgccgaaaataagctactgtctttaaggcagaatattgaagggagtggttgccaggttttatgtctgcaagaaacgaaaatggaaaactttgagctttctgacatcaagaaatttgcccccaagcgctttgcctcttttgcttttgccccctccatgggtgcatcaggtggtattctaattgtttgggcatcaagagttttcactgggacacccaaagaagttaaccctttctctgtgactgtggagttaacttctagattcacctcccaagtttggtccttgacttgtgtgtatgggccatgtaatggccctcaaagatcagattttgtgacctggtttaaaaacatccatattgatgctaaacagaactggcttttcctaggggactttaatttctacagatctatttatgatagaaataaagtgggagctgatatgaatgatattttattttcaatgagatcattagttctctaggattgcttggaatcccattaaaagggagaaggttcacctggagcaatatgcaacaaaatcctttgctggaaaggcttgattgggttttcacctctacatcctggactttaaccttccccaatacaactgttctccctctgaccaagaatatctctgaccatgttccatgtgtggtaaagattgatacaaaaatccctaagtctccaattttcagattttaaaacttctgggttgaagcagagggtttctttgatgtggttcagcaagtttggatgttagatcctggttttgatgatcctgcaaaatgtatctccttcaaattgaaaattatgaggaagaaactgaagctttggactaagaatttgtccagaatcatgctcctcttgagtaactgtaataaaataattgattttcttgatcttctagtagaagagagaaacctttctttatttgaatggaatttcaaggaggtagttaaacatcgtatcttaaaacttctagaattctggaaaatatattggaaaaaatgttgtactaatagatggatgatgctgggagaagaaaacaccaagttctttcaatctattgccacaggaaaggtacagaataaacacaatttctcaagttttgaatcatagtggtcagatagtttacctgcatgatcaaaaggcaaatttgttctatcaaagtttcaagaataggatgggtatctcttgctccccaacaatggactttaatttgaatgagcttttttcatagaacagatttggagtgtttgattgacatgttctccacacaagaaattggtaatctcatcactatgatcccagtagataaggcacctggcctagatggtttcaatggttatttcatgaaaaaatgctggcatatcattgcacaagacttctatagacttgtggcacattttcatgctgaatctacatatttatagatcctgaataattcttacatcactcttgtgccaaaaaaaccttctccaaaaacagttaatgatttcagaccaatttccctaatgggtttgagtcttaagtttcttacaaaattgatggctgacagattgcaaggtgtcattctcaaagtggttagtgaaaaccaatatggattcattaagggaagggccattcaggattgtttagcatgggcttttgagtatatttatcaatgtcagcagtcaaaaagagaaataatcatcctcaagacaattgaaaaagcttttgatacaattgaacacacggccatcttatctgtaatgcaaagcatggggttcccacaaaaatggcttaattggatgcaaatggtattctcctcgacaagctctgtagttctgttgaatggggttcctggtatctcttttaattacaagagaggagttaggcagggagatcatttgtctccacttctttttgttctaggggctaaactcttacaaagaatagtaaacatggcttttaatcttgatttaatttcaaagccagtcaatgaaaatgatggaagtgggttccccaacatccaatttgctgatgacactttgatcctgttaaaagcttcaaaaaaagaaatcttctgcttcaaggcactactgaacatatttgctcaatcgattggcctaaaagttaattatgcaaaatccagtctttatcccctcaatctctctgaagaaaagccagatctaattgcaggatttctgggatgttctgttggaaaactgcctttcacatatgtgggactccctgggaactacagggcaaagagtgattgattttcccccctggtagatagagtggaaagaaggctgacatcaagttcaatgttcttacctcaagggggtagactgactttaataaactctgtcctatcatcaatacccacatactacatgtgctccctacaattacccgtcactattatcaaggccattgatactgtgagaaagaattgtctttggataggaaacaaccttaaatccaccataaaatctttggcctcatgggaaaaagtttgtacaccaaaagaaagggggggggggctgggtgtggttaatctaaaagtccaaaatgcagccttgcttatgaaacatcttgttaaagtttactctgcagctgatattccttgggttaatcttgtggctaattcttacctggtaactaaagtccttcatctaataaacaaaggctccttttggttaaagaacattattgctcttgttgatgtttttagaggaattgccaaatgcaacataaggacaggcactacagttctattctggacatatgtggaatgatcaattcaaatgtcagcaatatcaacacctttatgcttcatctctatacaaaaacaattttgtacaagctatgtgtgccaggccattggaggattctttcaagttaccactctcttatcaagcctattgtgagtatctcaaccttcaagatgaactaacacatcttcacttggaacaaggaaggggagattcatggagtttcatttggaataacagttgttttacccccaaaagattctataaactcaatttggctgccattcaagcacacagacctctgatctggatttggaagaccaagtgtgtaatgaaaataaaagtctttgcttggttattcttctgggacagattgagtacaagagatatgttggataggagacattgttgcaaagaagatgacgatctatcatgtgtacggtgcagcactaaccaaagggaaactagagatcatcttatcttcaactatccatttagcactgcttgttggcagtttctgggaatttcatggaatgctaatattgaattttaccaaaggatagcttttacaaggtggcagttcaatgagcctggttttttggaaatcttcttcgtggctgcctggcacatctggaaacaacgaaatggcctcatcttcaggaatttgcagccaaccttccaatcttggaagtctctttttacagatgaaattcttctgcatctctgcagaatgaaggatcccctgaagcaaactattgttaattggttacaatctttatagagttttttcattttctcttgtattttcctgtaaatattacctgtaaaatattccttcaataaatgaaaatcacactgctgggctaagccctggcagtactttcagtaaaaaaaaatataacacgctttgatgtttccacacatcaagtgttattcagaccatttcatgagataaaccagtagcacctaaaaacacatgaacaattatatttagatgaataatagcattccgtggatactttctgaatgctagcaatatatatctagcaggctagaataaatatatgcatacaccgagttaaagagattagtgtaaactgagttacgctcctttcataaatgaaacagagcagagcataatccatgtgaaaaactgaaaaccatacagaaaatggagctgaattgataactattaagccttttcgtttgccctcttagcttccgttagaactgcacataaacaaactgaacaaatatccaaatttgtccagtaaatgcataaagatgcaaaatataagcagtggtcaactggagagcaggtccatatttgtacagtaagtgcatctgaattcagagtcatggcaagctttaccaataccaatatcagaattgaaagtcatgccaaaaaaattaagtgaagcaccatatagaacctgcagcagtgaaaattaacaagttcgtgctgaactttgtaaagtagcatctctgcttgcaatattaactcagaaaggaaagatcttaaatttgatctggctaaattgctagctaggatcctgatcttgtcatcagaatcaaataaactcccttgaagcactgctgccaaataaaaccaaacatcaacgtgaaaaagatgccaatatagaactctgaataaaataacagataaaagtagtagtcctgctaagaatatctttaatttcatttccaaatgacacagccatgtatatatagacttttgcagcgtcaattcttggtaacacatgaaaatcataaagacaatcatagcatgtaaaatggctctgagtaattgagtccctccaagcagaccaataccatgcaggaaggaccagaaaagaaaaagctaattttcagtggtttcactttctgttagagtgctcattccgatcttgatgttgcgtgcctgcagtttcattcagctgcatgtccaataccagtacgtagctatcaaactttaggttgtcatttaacaacttgacgttggtctagcattatcttttatgtaatcacaccaatgtttgatgcaaactcagtatttgatgtaatcgatacgtattggcatctagtcagataatagtaacaccaattaaaatttatatttagtagcataggaaatatgcatcatacatacaaagtgcttttaaatacgagcacacaattcagcacaaaatgcagcacaaaaattgcacataatggcacaggagggagaggatgccgggagtgcattcggcaaacctgcacgaggtcgctttcaaggatgatgtctaggaagccggatctgcacatgacgtagttgaggattgagataaactgcaacaggatgatggaaataaactccgatgacaaagtgcaccaggcgatggacctgcacccatcggggacgggtggaacaaatcggcgagggcgcgaggcggcgagggcggacggacctgaaagcggcgcgagcagagaagcagggagcaccgtggagtagtgtgggcgtgtgaggaggaggaggaggcggcggcaggcggggacggagattgggtgcggcacggaggagaccggcgacggcggcgaggcgggaagtagggcggctccagcgggaggcggcggcggcgagacgcgcgcgagcggaggggcggcggcgggctcgcacgaggcgagcggctccggcgggaggcggcggcggagggagcgcagccgcgcgcgagcggagttgcggcggcgggatcgcacgaggcgagcggctccggcgggaggcagcgacggtgatgcggcccgcggctccggcgggcgggcgcgcggcggcggtgctgacagatcaggcgcgagggtagacagcggcgcccggttgtccggcatgcgcgcgcgaggaggcgagtagggcgtgtagctccggccggcacgtgcgaggaggaggcgagcgactcctacaagaggcggaggaggcagtggcggcgggggaagtggtggtaggggggagcgggagagcaggcagacaagggagcggcgaccgggattccatgagcggcggccgacggcggtgaaggaaccgtcgacacgggagggggttgcgggaggaatcgggagggaatgcgggcgaaggggggagcgcgatcagggaggtgcgacgtggtcagccgatggtgtaaggtttgtttgggccggatgacaggtgggtcccacacaaaggattgcatgattgttgatgaacacgaactttttatatctatactttctatagcaaaatgccgatgcttcgctacggtgtattaaaactaaaaatatttgtttttaaccgaagttattttcacactgctttggtattttttgctcactagaaaaagtctcaaataatagagagaaatatagtagctcataataaattattattcaacagtgcgttgcaacggaataattttaactaaaatcacaataaatatttttaggatttaatttgtgatatgagtaaggtattcttgatataaatatgccaataaacaacatgttgaaaacaatatatttcttgtttaccagatttaacatcaacaaaggttttgtagcaattaaaaaaaagactaacttcctcttgttgggtaattgtattttgttgggtaatttttatttttagttttttcctatgaattagataggagatataattgagagagctaaagtggacttgttgcttttttttaaaagaaaaagactaaccataccgaatgtggcccaacaactcaatcgcacgtcgttagtgcttcatgggctgcatgcggcccagtagtgctgcatcccagagatggaggccagcccaatgcgggattgatccgagccgctcattttgatggatggctcggatcagtttcaaatccatcaaaacagctggtaccaaaactgatgcgaacccgctacggtttgtggcccgatctttcgatgagaggtaagggataactcgattagatgaagacgacgttcacggcccgactacaactgtccaaagacgctgcgccttagcaaccgatacaccgtctccaatggtcgccgcgaacttgtggtgcgcgtcaacccggccacgagggcactcgtcctgcaagtaatcgaagaacaagcaagaacaagtaggacaagcactgaaattgctagataaagatgaaagtttcactatcaaactcaatatggtggggttccgattacaggcagacgggcggtttagccaacacgcgcgctgcgagctggtagcaagaagctatctctaacatcaaaacccgcctgttcttggcggcgactagaggtataaaaagaggggaagaacgaccatagggtcgtgctccaaccctaggacgcgcccctaatgggcccaacttggatacacagcccattgggccaaaagaggtgacgcaacaccatggacagaaaatagtcgggagtaaaatgacaattgcggccgctccagaacagatatggacatgtggctggatccatttgaaagtagacttgataagctttccatgaagtacttgcacgcccaaatcggagtttgcatgaagtcgtggcggccgtcagaagttggcgctaccctgcagtccgaatccaccccgcgcgaatcctcttccctttggatcctctccatcgttcctgagtaaaatacgagtgcacgcgtctccggggtataaagacgaggaatatgaactcaagaaagaactcacctgataatttagttgacgtgcacgagcgcgggtaataggaccatcatgctgtacatggggggacgtggatgtatcgatggtgttgatgtcctcatcatcctccccttcttgcatttgagtcgtcctcgactcaagctcatcttcttctcccaaatacggcttcaaatctgcaacgttaaatgtggaactaaccccgaaatctgcaggcaaatcaatcttatatgcattctcattaatctttgctaacactttaaatggtccatcagctctaggcatcaatttagactttctcaaatcaggaaatcgttcttttcgcaaatgcaaccaaaccaaatctccaggttcaaaattcaattcccttctacctttgtcaccagcaaacttatacttagcattcatgcgctctatgttttctttagttgtctcatgcagttttaacatcaactcagcacgttgcttagcatcaaaattcagtttttcagaagatggtaaaggcatcaaatcaattggagcacgaggcaacaaaccatacacaatctgaaaagggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggatgacaagtagtagaaaacaaaagtttagtccccaatttagcccacaaagttctccaaaaatggctaagaaattttgtgtcacgatcagaaacaattgtgtttggcacaccatgcaagcgaacaatttctcgaaagaacaaatcagcgatatgagaagcatcatcagttttatgacatggtatgaaatgtgccattttagaaaatctatccacaaccacaaaaatgctatcacgccccctcttggtcctaggcaatcctaacacaaagtccattgaaatatcttcccaaggaacagtaggaacaggaagaggcatatacaaaccatgtggatgtaagcgtgacttagccttttgacatgtagcgcagcgagcaacgaacctgccaacatctcttcgcatctgtggccaaaagaaatgactagcaaggatgtcatgtgtcttcttggcgccaaaatgtcccatcaaaccgcctccatgcgcttcctgcaacaacaacaggcgaacggagctagctggaatgcatagcttgttagctctgaaaacaaacccatcattgatgacgaatttgttccatgttcttccatccttacaatgcagcaacacatcattaaaatcagcatcatgcgcatattggtctttgattgtttccaggccaaaaatcttgtagtcaagttgtgtcaacaaagtgtatctcctagacaaagcatcagcaatgatgttctccttccctttcttgtgtttgataacataaggaaaagattcaataaattcaacccatttagcatgtctacggttcagcttcccttgactacgaatatgcttcaaagactcatgatcagaatgtatgacaaattccttgggccacaaataatgctgccatgtttctaaagttcgcacaagagcatacaattccttatcataagtagaataattcagaacaggcccactcaacttttcactaaaatatgcaacaggttttccttcttgtagcaaaacaccacccaatccaatcccactagcatcacattcaagttcaaaagtcttattaaaatcgggaagttggaggagaggtgcatgagtcaacttatctttcaacatgtggaaggcgttctcttgtgatgtgccccaagtgaaaggcactcccttctttgaagcgcattcaatggtgcagcaatggtgctgaaatcctgcacaaagcggcgatagaaccccgcgagtcctagaaagctccgcacttgtgagaccgttttaggagtcggccaactctgaattgcctcaaccttggcttgatcaacctcaatcccctgcggagttacaacatagccaagaaaagaaactcgatctgtgcaaaaggtgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaaagtgctgggtgcattagttaaaccaaaaggcatcactaaccactcatacaacccaaactttgttttaaatgctgttttccattcatcacccaacttcatacgaatctggtggtaaccactacgcaaatcaactttggagaacacaatagagccactcaattcatcaagcatatcatctaacctaggaataggatgacgatatcgaatggtaatgttattaatagctctacaatcaacacacatacgccatgaaccatctttctttggtaccaaaattaccggaaccgcacatggactaagagactcgcgtacataccctttatcaagcaactcatgaacttgacgctgaatctccttggtttcctcagggttggttcggtatggcgcacgattcggtagggaagcacctgggatcaagtcgatttgatgctgaatgccgcgcaccggtggcagccccggtggcacttccttgggaaacacatcagagtactcctgcaaaatgttagcaacagcaggggccaaagaatgctgcatatcgtgaagtgaaatcaaagcatctttgcataccaaagcataggcaactgaaggtgatgcaatcaactcattaatatcagatttagtagcaagtaagcatctgggtttcaaattgattgtctcaggtttcttgccatcagattgggcttttttatcactctcacatttggatttggcagccttagcaacatcatcacgcaaaatatcttcaggagacatgggatgcaacacaattttcttatcatggtacagaaaagagtactggtttgacctaccataatgcatagaatccctatcaaattgccatggtctacctagcagaatattacaagcttgcatgggcacaacatcacattcaacaacatcatggtaatttccaattgcaaaattaatgtgcaccagttttgttaccttcgccttaccactgttgttcagccattggatgtagtatggatgtggatgcggtttggtgctaagtgcaagcttctccaccatctcgctgttagccaagttgttgcagctacctccatcaatgatcatgcggcaacaacgctctttgacgacacactttgtttggaacaacgtgtgtcgctgattttgctccgccttctccatttgtgcgctaaggacacgctgcacaatgagactctcatagtgatccgcaaatgcagccccaatgtgctcttccggtggctcattatctgcatggtcagccgcaagcaaagcaagtgtatcatcatcgaaatcactagcagaggagtactcaccatcgttttttactaccaaaactcgcttgctagggcagtcacgctgcacatgcccaaagcccttgcaacggtggcactgaacatctctcattcggcctgtggatgccattgaagaagcactcggtgctggctgagcagcctttatcgctgacttgtcaccagatggaggaggtgctgctcgactggttgtgggtgtggaagatggagaagtagtacggccggccggaggagtggtgcgtgtctgccatgatgaagttttaccagcagaaaaattagccttggcactagcacgtcgtccctgcacttcccttttagccttacaagcaagatgaaacaatcgggtcatattagtgtaatctttatagtctacgatgtcataaatctcgcggtttaacccacccaaaaatctagccatggcagcgtcctcagtttcctctaaattacaacgaagcaagcccatttgtaactcctgataatattcctctacacttttcgcaccctgtctcaattgttgcaacctattcagcaagtcacgtgcatagtaagaaggaacaaatctagcccgcatgacccgtttcaaagcatcccaagtttgtggcatgttattaggatttttcttgccatgttctatccaccaaaccgaagcaaaatcggtgaactcactcgtagcagctctaactctagtgttctcaggaaactcatggcatgcaaatttttggtcaacagcaatctcccaagagaggtacgcatcaggatcatattttccatcaaaaggaggaattttaaatttaattttagaaaaagcatcatcattgttgcgtacctcgcgtcggcggcgaccacccatacctcgtcgattgttgtgtagccgtcgacgatctcgagcatctcgatcatcttgttcagtgtcagcaatatattcatcctccaaattatcctcgacgtactctccgtcaatgtcatcgtcattacccccaccattgcctccagcattgagagcatcaaaatgcctcacaagagcagcaaggctagtgtcaatgcgggcgaccgctgtctccagccctgtaagcttagtgttggtggagatctgcgtggactccaattgtccaatcttctcatttgtcacctgcaaatctgtatcaagtccttctgtgtgctgcttcacttgccttgtaaagtattggatgatgcctttggtgcgtggggaatgagatgcaccctcctcatctttatcctctagacctgccatggtttagaaatgaaggacaacaaaacaatggaggatgtaatgtaagccctacacaactattgggatgtagcttttgcaagacgctcattctcacttcactcgcagcttgtctcacaagctcttaccagttcttaccttgcccacaggagggggacagcaacccacaagttagcaaccgtggaacgaggtgtatcggtgctgtagcaacaagacctgtcaagctgtagtcgggtttgtggtggagctgttggtgggctgaaagcaatgctcaagagaaaactagaaaccacgttagccaaagcaaattgaataatcgctcaagggtatagtgtacagtgctggtcctaggctagttgaagtagagacgcgagcctaaccacaaaggatgccacaaaacacaaacccaaacagcaacgaaaacaagaaccggtggtggaaggtggtgacaaagggggaatggtggggtgtgctcgctggatccttttttttttttttgcttgctctctctagtgctgaggagagagacacaactttttttttatttttttcttttgatatttttttcacaaccaggagcacactagaaccaaccacagaaaatcttatctcaaacggacaaagtatgaagcttgtagaatttttttcaaagttctatgcgaataggtcccgaagcttctcgccacaaaaacagaattttgcaagaggaatttggcgattttaaatttgccgaacccggcaatgccagggagaatcggatgtaactttttttgtagatgtccgtggatatattataagcctaatttcgagtccgtatgaaaaagatatgactgttttaaggaaggtcactcgaatcagggttctatttcctttctagtggcggcaggatacaaggcaactcacaaaagctatcggcagcaaatcaaacacaaatagaaagtgatttagtgggtgactgcgacggtggtgacggtggtgatgacggcaaaattgatgaaggtggcgatgtgcggtggtggcaagaactcgaaactctaatcgcttaacactaagaccagcaaattaacacaaccgatgcaatcaaaaactcaacaagccttaactaagcagtactagtaaaaaggcacaatggtctataggatcacgggaaaactaatctactatttttttttggtcttttctgggctataggaaaaaaaattaatgacgaagggaagggtaaattctctcaccgatgaaccacgctctgataccacctgatgcgaacccgctagggtttgtggcccgatctttccatgagaggtaagggataactcgattagatgaagacgacgttcacggcccgactacaactgtccaaagacgctgcgccttagcaaccgacacaccgtctccaatggtcgccgcgaacttgtggtgcgcgtcaacccggccacgagggcactcgtcctgcaagcaatcgaagaacaagcaagaacaagtaggacaagcactgaaattgctagataaagatgaaagtttcactatcaaactcaatatggtggggttccgattacaggcagacgggcggtttagccaacacgcgcgctgcgagctggtagcaagaagctatctctatcatcaaaacccgcctgttcttggcggcgactagaggtataaaaagaggggaagaacgaccatagggtcgtgctccaaccctaggatgcgcccctaatgggcccaacttggatacacagcccattgggccaaaagaggtgacgcagcaccatggacagaaaatagtcgggagtaaaatgacaattgcggccgctccagaacagatatggacatgtggctggatccatttgaaagtagacttgataagctttccatgaagtacttgcacgcccaaatcggagttcgcatgaagtcgtggcggccgtcagaagttggcgctgccctgcagtccgaatccaccccgcgcgaatcctcttccctttagatcctctccatcgttcctgagtaaaatacgagtgcacgcgtctccggggtataaagacgaggaatatgaactcaagaaagaactcacctgataatttagttgacgtgcacgagcgcgggtaataggaccatcatgctgtacatggggggacgtggatgtatcgatggtgttgatgtcctcatcaaaaaccctaaccagagcttcagtttttcctctcccaattccctcaggctgaaatggcgaaggcggcgatttttggcagtgcgacggcgacaaggcacccgctccccgcgagcggcggcggcaccctccccccaacgagcggctgtggcggcgccctctgtcccgtctcgcctccctcgccccctcctcctctccctctcatctccctcccgcggtggcagcgggttggcggcggcgtcgacgttggcggtagccgcgggcggatctgagggtgatggcggcgtcggcggcagccacgggcagatccctccgccccctctcgcctccctcccgcatcggatccgatggcggtagcggcaaccgtgtgtggatccggcggcagttgtgatggccgagggtggatacgttgatagcagctcctcccatgactgatctggcggctgctgctccctctccccagcgtggcgggtggctgctgcttccctccccggtgtgttggcagcagctgcccccctccccagctgcccctcacctccccgacatggagccaacggtggttctctcggtatagctgtagtttgatttttgatttgtgaatattctgaggattttatgatttgggatgttgatacagtggagattgtttattttgatttgggattgcaattgagtgattttgtgattcatgtgttttgggaattggggccaatgggattgggagcaatcggctcgattagccgattgatcgagttggattttttttttcactccaatgctgtttgattaaatttaaatttgtctgtggggatctagctctgggattttttttttaagatagactcggacacaaacaacggatgaaaaaaatcgatcggaagccttacgtattttttaagtaggtatatagatatagatattgcctgtgatcttaatagtgggatagaatctgactcgacatagaatcaggatataatctgactcctgacgtgggctgggcaaactggagtaggaatcggtgtggggtatttttttgcgtgtgaacctggagtcgtgtgtttttttgtgtatatatgcgatatttttttggtacgcgatcttttttcttgcgtgaacctggactcctcgtttttgtgtatatgcgatcgttccttttttttttttttttttttttttttttttgacatgactacatagagaccgcactctatattgtcttaaccatagactcatcttacacatggttgcatactaggacaccaaatgatacatatttttttttcttcttatagatttttcttttaaattatttatccgatttataatccgattacatcattgtgttcattgcaattaaatctttacaacaagatcttacatgactatattttgataaaagaaatatatatgttataaattacttttattatatatgtaagtttatcatatatataaattacttttcgatttgattaaattacttattatacaatcataatgttgtgagttgtttattttattatcttttttagtcaattccatattttgtgctgattaaatttaatttttagatagactcacgtttttatctccataatggaactacttttaatgttatgacaaagttatttcctttttgtcttaagttacttctataatatatgtaaattactttaaagctttactgaaattacttttatatgtctaaaaagtaatttagtgaaatctaaaagtaatttagatatactataaaagtaatttgtaatttttcatcaaaatataatcatgtgagatcttgttgtaaagatttaattcttatgaacacaaccgtgtaatcggattataaatcggatgaatagtttaagagaaaattttatttaaaacataagtgatagtaatatattttctatttacttgatggggatagtgctacagttaagacatctaggtagggtctctcgttagcactaaaacgagaagcctcttgatttagattttgccttttttttatgcgatcttttttttttggcgtgaacctgaactattgcctgaactattgcgtttgtttgggtgaaccaagaaggagcatgggcttaaaatctggatgaacctggaaggagtatgggcttgtagatggatctagaatcctgaaagcaatttagaatcctgtgtatgggcttatagatggacctaaaatcctggaagcaatttgggcttgtgggcttgtggatggatctaaccaaatcaaaaatcagatacggacaaaaaaaatcatattggtgaaaaattagaggcatatgacggacgaaaagttacggacaaaagattatgactaaaggaaaaatacaaatcttttaattagttaagatataagtgtgaccacaaacaggcaccatgttgagccacgtcataaaaatagtttcaaccgtaggatcgacaagtcttttcaggactagcctttagataaaagtcccctccacttcctcaccaattaaacaatgccattgatcaccaccacatctaaatgctatctatttaatcaggtagttaattggacaacagcaatcaagatattagatcatatttactattccaaccatcattcaatcaatttgatatacatatgctaatagaatatatatatatatatatatatatatatatacatatatatatttatgtatgtatatacacacatatgtatatttatgtatgtatatatatgtatatatatatctatgtatagaactactacatggcgctgtgcgccccacacaatatatgacgcgtgacacacatatccccccactctaacccaccgcaaccaacgcacacgcactgattcatattcgttagttaaatttttattcattcagtataaccattcgttgaccaatattgtaacaatgcgcagatgtgcatgtatagttaaattttaacttttatcgtatacatcgtgtactagcaaatttttaacttaaataaggacaggacaatgctatgatctttttttttcgttaatgtcttggagttattttttaactctgattttttttacaagagtcttagcgttttctttcatttttttaataatatctgactatcatttatacagcggatcttcaggggagtctctgattcatatcattagcgatctgatatactccctctatcccagaatgtttgacgccgttgacttttttaaaaatatttgaccgttcgtcttattcaaaaaatttaagtaattattaattcttttgtatcatttgatttattgttaaatatacttttatgtatacatatagttttatacatttcataaaagtttttgaataagacgaacggtcaaacatgtttaaaaaatcaacggtgtcaaacatttagggaaggagggagtatatcttaaaaaagctaacgattcaaccggtcaccaacgccacatcaatacaaagttaatatttaactcaccagacttttagatgcatacttcatactagccagggatcgaacaattgcattagagtttatgtaactgaaagttaatttgtaacaactattgtagattgggatggaggcaggccatctgcatttagatcgcattaactaatcgtccgtgttgcgcgcgacagagccccaactcaaattactttttaactaacagccctgattgaattagctaatcgtgtgagtcgcgccacattggcttcgctggcgcgcgcaccatgtgtgtcgctctgcgtagcggctccgtatctatgtatacatacatacatacacacatatatacatacatacatacatacatacatatatatatatatacgtacatatatatatatatatatatatatatatatatatatatatatatatatatatacacgtacatatatacatatacatatatatacgtacacacacatatatatataggatacctatgtagccccaattaatttacctatatatatatatatatatatatatatatatatatatagacacactagaaaaatgcccgtgcgttgcaccgggtaatgatatggtgactgaaatttgatttgaactatttttatgaagaaaatgaattataatttaatgaaatataaaattttctgcaatattaattacactcttttaaattatagcaaaagtggtcttgcgttgcaacgaaaagaaaaaacagataaaattgaattaaaacatattaaattctaattaaattctaatatttggtattttttaagtagataggtatctaattaaattaatttataagtaaagtaagtgtaagaaataaaatgttatggttggatttaacttttattaaattttctatattaattatacttgttgaaattttcttggaatttaaatagcttaattgctaattttgataatacaaatatcatttcaacatttattaaaatagtggtagtagtgaggatagtgccctcatatctaataggttaaggtggtttgggctatattttgtacgggtatgggctattactctatattgtgtgttgtttggtggtttgtaatctctacgtcacccttcgtggtcttgtaatagcctatgtttatctgtgagccctttttaggatgttttgcgacttttgtgatttgaatggttaagtgatgtgaacttgtgcgatgatggatggtgtatgcgatattgatatatatgtgagaccatcttatgcttatggatgaatatttcttgaagttcacattgagttattgctcttgtgtgtgtgatatgttgaaatgtgatattgaaatgtgcattagcttcatatttgtggcttatgtttgatatgcacatgtttagggggagcttttgattgttattgcaatatatgtccatgtgttctatgttcgattatttatatatttggggagtttgtcatcgattaccaaaaagggggagattgaaacatctaggcccccgttgttaattttggtatttaatgacaagcgctaattgtggactaaccgttgctattgagataatattttaagttagggccacgtcatgtgtgcccctggatgactttcaagggattaagaaggggcagaaccccaagaaacaagacgattaaaattagtgctttattttagaattgatcgaggcgtagggcgaacaaaatcgtagtttattttctagtttcgccgtactattaagagggggaatgacctagcaaagagatgatttaattgccacattaggacattgcattttcacttgtgctcacattttcatcacacacaaaaactttcactgagctcggcctgaccatgggcggtcagaccggccacatagtggcggtctgaccgttttttttggccggtctgaccggccttacagcggcggtctcaccggcccataaggccggtctgaccggcggcacatgcccggtcagaccgtccccctggaggctgggatggtgctgctcggggtggcctttacagagccgacggagccgtatttggtcagaccgagcttatggtggtctgaccgagcccaggccagtctgaccgcctactcaacaccagtctgactggccaggccgatggggccctctgacagcactacaatggctagttttctagccgttgtagagtagcacggtctgaccggccacatacctccggtcagaccggcagagcacaaagttgggggatttcgcccccaacggctagttttggttggttggagtataaatactccctctccagcagcaaggggactctcttggcacccaattcaattacatacaccccttgcacctctctcacacccacttgagctttgtgttcatccatctagtgtgttagagggttgattagcctagagtcaagtgcattgcttccattgtagagctagtgtggcacttgattgatcatctccacgccatgtcattgcttgttactcttcgaggttgccgcctcctagacggcttgtggaggagttgcccggtgacctttccgagaagattgtggaggaggtccggcgccggtttgtgagtggtttagagttcaccaccttcggagtgaaggaagaactaccctagtgatcgaggcttgggtagtcctctccgggggccagtgtcacaccctgcagttctcctcccaagcctaaaatttaatttataaatgaccctaagaaaatgccggtgcaaatcaagagaaaaccctaagaaagtaatacaaataataatcgaatctggcatgtggaatttttcttgagttctacatgtcgaaagtcactaacaggatttatagtggaattttcagagccctagaaataattttaaccaattaaaattgagcaagcaatattttaattccagggaaaatccttttcttcctttttctttttctttttcccccttttcttttcgagtgggccgccggcccattctccttcctcctctcctcccgctgggccggccgaaggccaaggcccagctaggccgcgctggccggccgcccgccttctctcacccgggtcgccgacaggtgggccccacctgtcgggcccgtcacctaccttgcgcccgcgccgccgtgcccgaaaccgacggcgagcccacaccttcgcctcctacgggccacgtcggccacacccgcgcatgcgccggaccttccgcgcccactcccctctctctcccgccggcgcccacgcccgagatggccgggattcgatttttgaatcccacctctctctcctcccccactcccccacgttggccggtgattcccgcctcccccggccatgtccggccccctctctacctatttaagctgcgccgtcgtcccctctctcctttttcccatttcgccgaactccctcgtgctccccatcactcccgcgccgtgcacccacccgccgccgcctttcccgccgctccggccgccgctagccgccgctaggctcgccgccgcaccgcgccgtcgccgccgtcgggttcgcaaggacgaactccaccccgtccgcccttcctccgccgggattcgtcgccagaattcgcgtcccctcgcgctccgggcaccccgaagcccgtccgccggttgccgtcgtcctcccgtagcttgccgtcgcccttcgctgtcgtcttcctccgcgccggccaccctcggtgaggcttcctctcccctctattcccctccctttccttcctagccgccgcttagcgccgccgccttcgcgtcgcctttgcgccgtcgcctccgccgccggttgccgtcgctgaaaacgcgttcgcgcgcgcgtgccgtcgccatcgccgtgggcggtcggccggccttgagccgagccgagctgggtcgccgtcgcccgtccgatcaacaccgggggtgatctgggccgtcggtcccgtggaccggcggtggaccacctgcgtggtcccggtccacggtggaccacccccccttttttgagccgctgcctagtggggcccgcttgccggcgccccttttccctctctcccgagccgctgaccggtgggccccgtatgtcggcgccgtgcccccttgatgacgtcagccctgggaattattgcgcaataaatggtttaaggactttttgttatagtaataaacacagtgaatcttctaaaattcataactaattcatccgtgctccgtttaagcccattcaagtctcagtaaatcaagaaaaatgtgtagaatccattaaaaatggttttgttctctgtttcagtagtattatagcctgtttgcaatgtttgccttgtatgtcgctagattccagttcttccgatgctccggtgtacttcgaaatagtcgccgaggttcctccagcagcagagcaaggcaagtcatgcttgccacttgaacatgttgatcctatattgcaaatgctctattgtttgtcttcaaatactgcatcgttttataatgttattatgggatgtttacctattgtcatagccatgctattgttgtaccatgtccctttgtcagcttggggttataacatgactagagattggactagggattgcttagccatgcttagttcaactagtgcacaatggggaaaatcctattaatgtttagactgttggttctaatggtattgttggattagtgccaccgctttggtgttggttaattaaaataaatcacatggtgggctgtgggtgcatggttttgctggtcgcacccatggcagttaaggaccggttcgcgggatgccctggaagaacttatcatacttaccacaagccagcgtgggcaacggctgggcttgtagtgtaactttcctctagctgacgcatccaggcaagggtgggcgtgatggagcggggcgggccctgcgacggcctctgtcgcttccggattcacctaggcaccagaggggactgcccgttgcccgctagggacgggggtgaaacctgaagtgtggtgtgcttggctagagggggttatgcgaagggtcctgtcacggcctcttttcggtatgtcgtggtggcatgtcggcgcacggaaacgtgtcgtggggctgtgtcttgtgggtatagttgtacacctctgatcagagtaaaactattcaaatagccgagcccgcggttatgggtggtcaaccagattcaccatgattagtctcaccctagtgtaatcttttgaatttggatagtttaggtggatggttgggcctgttgcaacgtgggatagcattggacagtggatagttaatattaattaattactacaactgtttaaatctttcaacttctgtttataaatgctcgctttatgcaaatgaaccactctaactctcctttgataattccctgcatcatacccctattccggtatgacttgctgagtacagtgggtagtactcagtcttgctctatttttcccaaccccagagtacgagtatgtgtcagatggaggtttctccgaggagtaggcttcgtccgtgccgtcgaggatgcctgtggagtggtgttcccgctgcagttctagtcaaggcttagctccggttgtctttcgcttttccgctgcatttatgtaagacttttatgatgtttgtaagacgtgggtctgaatgtcaactttgtcgtttgtgtaccccggccggtcctggacggggattttaatgcacaatctgcttggaattctattcgagaatttctgggcgtgcggtggcttcgtggttgagcagtggagttgggctcgcctcaacggggagtaggaaaccggcgagtttcccaacctcggtgaaaaatctcttgtctccttgtctcatttgattgtcgcatttacatttgtacaatttacatttctagagacatacttgagatcatatcacctaggattgctaaacattgacataggagtgtgatttactttcgtagagatataattgagccactatcaccctaggtttgcaaaacataacttagttgcttagttagagttgaccctcaccaagcctagcaacttaggttagttttgattaggtgtcatttagttttaaatcacctattcacccctcctctagtcgacatctcgatcctacaagtggtatcagagcttagtctctcttgattgggcttcaccgcctagagagaagatatcgaacgaggtgaaccatgtagggaaggctcccatgtttaatggcaaaaactatttcacttggaaaattaaaatgtctactcaccacaaagctatgagcttccatatttggagtattgtggatgtaggctttgctatcaccggcacgtccttgacggagattgataaccgcaacctccaactcaatgcccaagccatgaatgctttgttcaactctttgagccaagaggagtttgatagagtgagcaaccttgagaccgcatatgagatttggaacaagttggcggagatccatgaggacacaagtgagtacaaggatgccaagcttcatttcctcaagatccaatatgagacattctccatgttgcctcatgagagtgtgaatgacatgtatgggaggctcaatgtcattgtgaatgatctcaaggggcttggggtaaactacaccgatcttgaggttgcccaaaagatgcttagggctctaccagagaagtatgagacccttgtcaccatgctcatcaattccgatatgtcaaggatgacacccgcaagcctcttggggaagatcaacaccaatgacatgtacaagttgaagaagaaggagatggaggaagcctcaccttccaagaagtgtattgctctccaagccgaagttgaagacaagggcaagggtaaggtgaatgaagccaatgaggacttggaggaagagattgcccttcttgctagaaggttcaatgatctcttgggaaggagaaaggagagaggaaggggctccaactccaataggagaagaaatagaagacccaacaagactctctccaacttgaggtgctttgagtgtggtgagaagggacactttgcttccaagtgcccttccaaggatgatgatggggacaagtcatccaagaagaagagtggaggctacaagctcatgaagaagctcaagaaggaaggcaagaagattgaggccttcatcggggaatgggactcaaatgaggagagctccgcctcatccgggtccgaggaagaaggtggtgatgatgcaagctccaagaagaagaagatggccgttgttgccatcaaggtaacatctcttagtgatagtgagagtgatgatgattgtgatgatgtttcctatgatgagcttgtgagtatgtttgaggagctccatgcttatagtgagaagtagattgtcaagttcaaggccctaaagaaggatcatgcttctttggaggtcttgtatgaggagctaaagacttctcatgagagactcaccatttctcatgagaagcttaaggaagctcatgacaacctcatttccactactcaacttggagctctcattgatgttggcatatcttgtgatttgcttgatgatagtgctactcgccatattgctcatgttgcatcatctagcatttctacctcttgtgatgatcttgtggatatgtctagctctagctctagctcttgtgtttctatttgtgatgcctcacttgttgttgagaagaatgagcttaaggagcaaatggctaagctcaacaagagcttggagaggtgcttcaagggtaagaacactcttgacaagattttgagtgagcaacggtgcatccttaacaaggagggacttggattcattccaaagaagggtaagaaaccttctcaccgtgccactcgttttgttaagagcaatggtaagtattgctccaagtgtcgtgaggttggacatttggtgaatgattgccccggtggtaagcctcctaagacttgcatgtttgattctcattatatgcttaggaaggcttatgatgcaagcattgttgctagatatgtggattaccctatactcggtggaaaaaagaatgccatttgggtgcccaaagctttggtctctaacctccaagtacccaaacaagtttgggtacctaaaagagcttgatcttcttttgtaggtgaactaccacaccggtgggagccattgggtgcttgatagtggatgcactcaacacatgaccggtgatagggctatgttcaccacatttgaagtaggagggaatgaacaagagaaagtgacatttggagacaatagcaaaggaaaggtaattgggttaggtaaaattgctatctccaatgatttgtcaattgataatgtctctcttgttaaatccctaaatttcaatttgctttcggtcgctcaaatttgtgatcttggcttgtcatgtgctttcttcccgcaagaagttattgtttctagccttcttgacaagtcttgtgtgttcaaaggttttagatatggaaatctttatttggttgattttaattctagtgaagcaaatttgaaaacttgtttagttgcaaaaacttcgttgggttggctttggcataggaggctagcccatgttggcatgaatcaattgagtaaactttcaaaacgtgatctagttgtgggcttaaaaaatgtgaagtttgagaaagataagctttgtagtgcttgtcaagccggcaagcaagttgcatgttctcatcctactaaaagtatcatgtccacatctagaccattggagctcttgcatatggatttgtttggcccaacaacctataagagcattggtggtaatagtcattgtcttgtgattgttgatgattattctcgctatacttgggtgttctttttgcatgacaagtctattgttgccgagcttttcaaaaagtttgcaaaaagggtccaaaatgaatttaattgcactattgtgaaaattataagtgacaatggttccgagtttaagaataccaatatcgaggactattgtgatgatcttggtatcaaacacgaactttccgctacctactcaccccaacaaaatggtgtaatggagaggaaaaatcgtacattgattgagatggcatggactatgcttgatgaatatggtgtttccgatttcttttgggtggaagccataaacaccgcttgccatgcaaccaataggctttatttgcatcgtctcttgaaaaagacttcctatgagctaattgttgggaggaagccaaatgttgcctattttcgagtttttggttgcaaatgttatatttaccgaaagggtgttagactaaccaaatttgaaagtcggtgtgatgaagggtttcttctaggttatgcctcaaaaagcaaggcataccgggtctacaacaagaacaaaggtattgtggaagaaaccgccgatgttcaatttgatgagactaatggctcccaagaagggtacgagaatttggatgatgtatgtgatgaaggcttgatgagagctatgaagaacatgtctattggagatgtcaagcctattgaagtggaagacaagccatccacctccactcaagatgagccatctacttccgctacgccaagtcaagctcaagttgaagtggaggaggagaaggcacaagatccacctatgcctccaaggatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtgggtctttaggaacaaacacgatgagaacgggttggtggtgagaaacaaggcaaggttggtggcacaaggtttcacacaagttgaaggtttggacttcggtgaaacttttgcccccgtggcaagacttgaggctattcgcatccttcttgcatttgcatcatgatttgatataaaactatttcaaatggatgtgaaaagtgcttttctaaatggtgaaattgccgaacttgtctttgttgaataacctcccggttttgaagatcctaaaaatcctaaacatgtttacaaactctcaaaagctctttatggtttaaaacaagctcctagggcttggtatgaaagattgagagattttcttttgtcaaaggatttcaaaattggaaaagttgacaccacccttttcacaaaaatcattggtgatgatttctttgtgtgtcaaatttatgttgatgacatcatattcggttctactaatgaggtattttgcaaggaatttggtgatatgatgtctagggaatttgagatgtccatgattggagagttgagcttcttccttggacttcaaattaagcaactcaaggatgggacgttcgtgagcaaaaccaagtacatcaaggatctactcaagaggtttggcttggaggatgcgaagcccatcaagacacctatggcaaccaacgggtatcttgaccttgatgagggaggtaaaccggtagatttaaagctttatcgttctatgattggtagcttgctttaccttaccgcatctaggccggatatcatgtttagtgtttgcatgtgtgcacgatttcaagccgctcctaaggagtgtcacttagtggccatgaaaaggattctaagatatttaaagcattcctctactattggcttgtggtacccaaaaggtgctaagtttaagcttgttggctattccgattcggattatgccggttgcaaagtggatagaaagagcacatctggtagttgccaaatgcttggtagatcccttgtgtcatggtcatccaagaaacaaaactccgtagccctctctaccgccgaggcggaatatgtttcggtgtgtagttgttgtgcccaattgctttggatgaaacaaacattgttggactatggcatatccttcaccaaaaccccactcctatgtgacaatgatagtgccataaagatagccaataacccggtccaacattctagaaccaagcatattgacatacgccatcacttcctaagagaccatgttgccaagtgtgacatagtcattagccacataagaaccgaggatcaactagccgacatctttaccaagcctcttgatgaaacccgcttttgcaagttgaggaatgagttaaatgtcatagacttctctaatgtggcttgagatggtgcaccatggttgcttctgttgcatattgtatatttgctcctatttgctcttatgctttggatttattgccatttggttcttcattgcgaaaatggagcatgtcacattaagggggagttttgcattcttgcatgtgctctacttccctttatatgtgagcaaatcaactagtggtgctagtagtattttcaaaatgcccaagtcaaaataagtcaaaacttttgcaaaatcaatgtaatttgaaaattatctcttggaaaatgtttcaaaaggtttcctatatgttttccaagcctctcattgcaagaaaaatgatttttaaatgaaaatgcccttttggccctcttttgaagaaattagattcttatttttggccaaaatgagattttcctccaaaatgagattgagagagaatttgagaaaagtttcaaaacaaagttggtaaagaggaggatttgaaatgtttttagtattcatcaaatcatattcaaaaaccaaatatttcaaaagttatttgaaaaacaatttagcccaaaaacccctatagaccataaaaggtcacctcctagcactaaagtgagttttgttgcaaatcatcataatcttcaaatattatgggtggttagcaatatttaaactcacacatttcaaaaattgctccaaaaatcaaatttttgttgaattttattgtgtggggttgccggcttgtgcaagggctgtgcacagccggcagggggcctggcggtctgaccggcgctataatggcggtctgaccggccacatagggccggtctaaccggccggcaggtgggcctaggacttttgtcctttttcttctctcttcttcccctacccgacccaatattctcccattcagccatcttcttacccaactcgtaaaaaaactcctctctcctctcccaaaccctagccacctccctccaccaaatcccctcggtttgaccgcagatttctctccggttacaccgtaagtgattctcatccgcttcttctctttattccatggattagttcgtgtttttgttgagtttttgatccatggcatggaaccctaggtgaagcacgaggtgttcttcgatttgcaccaatagagggtagtttcttggtgtgattcaacacctccaactggtaaatcactctccctcttgtgcattctctcaaatcgatctatttcaacctagggcaatgggtagttgttccaatcttgatgaaataggtccaaccctttgatgttctagttccaatcttgtgcaatattgttcttgcaatttttagactcaaatgaggtctgcccggagccacaggcggtctgaccgtgggttagccgctggtttgacaggcgtgtgtgcccggtttgaccggccggcagccgtcgatctgaccggccaccggtgggcggtctgaccggcctgatgccgtcgttctgactggctaccatgggcggtctgaccggcctgatgccgtcggtctgaccgccgtactggctgcggtctgaccacccctccacaggatataggcaaattttcacctctccaaattgtttctagaattattgctaatatcctatcatcctttgatctttgatagtgatgcctccccgcacttgtcatgatcgtcgtgcgcccactccggatcccgtgagtgagcctggggaatcgagcggagaggattacgctcaaagtgatgaagaggttgaggcaaatgttgagggggctagtgaggaggcaagtggagatgatgacagtggaagtggagaggatgaggatgaaggaagtgatgatatgcacattgatccctccatccaatttgttgattacataaggaatccatcgcagtataccatcttgaggcaccatgatcagtttttgaggcctcgggacaccccggatccccgttttcacaccgctttctagaagagtgtgtatgagcaagtttatgtagggaaagcttttgcagagcataagtggatttcttggagagacatcaatgagactccagagtttgagggcttgcaggatctcttcaagactgttggcattgatcggattatgactctcaagcaagactacaatgaagatctgatccggcagttttatgctacagtgtgggtggctggggactatagtgagatgaagtggatgtccgacaccctccagtgttctatctctaggaggcaattctggcggctcctcaatattcgcttggactttggagatgacttgcatgaggagcacacccataatccgctctccatagactacctctctcagttttatgaagatggagtgcggtacacacatgggaaggttgccggcttgaggaccatccccagtgtggttaacaggattgtgagagctaccatcctccctcgccttggcaacaatgatgacattaggggggtggcttggcacgtcatcgatgcgatcattcagggtcgtcagttcgacattgtgtctctcatgatgcaagagattgccatctctaaggggaccttcactcagggaatctattatgccccttacatcatgaggttgattcaagacaagcttggggctgctgggcaaaatttgaagaagcataagcagtacaagccccgccttcagcttggaactccccgtgctcctagagcggcgccctcctctcatcctggagctagctcaagctcagcacctcctcctcctcctcatgggtatgttccaaatgctttcttccatcctcagtatgcctactttggaatgtagccaaacgaatacttcaacccggtacttggggctattaataccctaagtgaaagcattcaacgcttgtctaccgggcatgaagctttgcatgaggatgttcgtggcttgcgcacgaatgttggagacttgaatgcttccgtggggagattgcacactagagtgggtacattggattctcgagtccaaatattggagagctcccaagcatgtgtatcatcgtcgtcgtgatgctcctcattcttccatttcggcacatcttccttctcctccacaagagtgaagacctttttggtgcttgatgccaaaagggggagaaaagtgtgctttgtgttttgtgggttgggactagtagtagtgaggatagtgccctcatatctaaaaggttaaggtggtttgggctatattttgtatgggtatgggctattctctatattgtgtgttctttgtcgttctataatctctatgtcatttggatccttcatggtcttgtaatagcctatgtttatttgtgagccctttttaggatgttttgcgacttttgtgatttgaatggttaagtgatatgaacttgtgcgatgatggatggtgtatgcgatattgatacatatgtgagaccatcttatgcttatggatgaatatttcttgaagttcacattgagttattgctcttgtgtttgtgatatgttgaatgtgatattgaaatgtgcattggcttcatatttgttgtttatgtttgatatgcacatgtttagggggagcttttgattgttattgcaatatatgtccatgtgttctatgtttgattatttatatatttgtggtgtttgtcatcaattaccaaaaagggggagattgaagcatctaggccccgttgttaattttggtacataatgacaagcgctaattgtggactaaccgttgctattgagataatattttaagttaggtccacgtcatgtgtgcacatggatgactatcaatggattaaaattgacggcgcaaagcaaagagaaacaagacggtaaaactagtgctttaatttagaattgatcgaggtgtagggcgatcaaatttgctagtttattttctagtttcgccatactattaagaggggtaatgacctagcaaagagatgattaaattgccacattaggtcattgcattttcacttatgctcacattttcatcacacacaaaaactttcattgagctcggcctgaccatgggcggtcagaccggccactatgtggccggtctgactagccggtctgactggcgtgccctggccggtctgaccggcctcacaacggcggtctgaccggcccataaggccggtctgaccggtggcacatgcccggtcagaccagccgcctagaggccgggatggtgctgctcggggtggctgatacagagccgacggagccgtagttggtcagaccgagccaatggcagtctgatcgagccgaggccggtctgaccgcccactcaacgccggtctgaccggccaggtcaatggggccctctaacagcactacaacggctagttttctagccgttgcagagtagcacggtctgaccggccaaatacatccggtcagaccggcagagcacaaagttgggggatttcgcccccaacagctagttttggttggtgggagtataaatactccccctccagcagcaaagggactctcttggcacccaattcaattgcatacaccccttgcacctctctcacacccacttgagctttgtgttcatccattttcggagtggtttggagttcaccaccttcggagtgaaggaagaactaccctagtgatcgaggcttgggtagtcctctccgtgggccggctcccgccttgcccaccccttgacgaagggggcgtgcggtggcttcgtggttgagcggtggagttgggctcgcctcaacggggagtaggaaaccggtgagtttccgaacctcagtgaaaaatctcttgtctccttgtctcatttgattgtcgcatttacatttgtgcattttacatttctagagacatacttgagatcatatcaccctaggattgctaaacattgacataggagtgtgatttactttcctagagatataattgagccactatcaccctaggtttgcaaaacataacttagttgcttagataaagttgaccctcaccaagccaagccacttaggttagatttgattaggtgtcatttagttttaaatagcctattcacccccgctctagtcaacatctcgatcaaacaagccgcctcctctttccccgcccccaacgatgcctcctcctccccctctccacttttattgtgcctctccccctaccttttctcgcaggcgggcgactcccccgccaccggggccgtccctcccttctcgccggcacggagcggcgacagccgggtgcggcggggtgtggcggcagcggcgccttcccccatggcgagcggcggcggcggcggcgcctcccccacggtgagcagcggcggcggcgcctcccacacaccgagcaacggcggcgggggcgggggcgccgccctccccacagcacgatgccccccgactctctccacttctccccctttctctctgtgtggcggcggcgggagggccggcgacgccctcccctccgctagatcaggggtaggggaggtgcggcggcgctggtcctggcggaacgggaggagcggcggcccgacggcgtggaggcgggcgtcggcggccgccgttttttttgtaattttttccatggctattgctaaccgaatcggattgtgtatggacgaaaaacgcacgaaaattagatgtgacgaccggaaaaatacgaatatttatattagttatagatatatatgcacatatatatatacatataggaaaacgcttatatatatatatatatatatatatatatagacacacacatgttcgtacatatacatgtatatatatgtacatatatatatatatatgtatatagccatactatactagacccatggtgcgtagtaactaaaatgctccccctcacatcctactgttaacgaccaaatttagcaatatcagcattggagatgaggattagatcgaggtggaatcgaagacgaagatcgattcgggaacagagtaagaatcggctggagtccaaatcggctacgatcaggatcggctgggtctgaatcagactgggtaagccgatacagctgattccgacaatacgacttggtgtacgacatcgggttgagttgatatgcttcaagatgattgccgcgcatggatagagtcctgagaaggcaattgtatctattaattaggatattttatgtaatttccttagagatatgtttagggcaaaagtctgtcgtaaagacttatggtatcttagagtttattagagataagagtcgtgtccgatatggacatagattgtaattttcgggtataaatagaccccgaaccccatgcaatcaatttacacacatgttcaatacaatttcggcgcatcgccacccttttgctttatttttattttgatgaggtcttgctttcgggttgagctgtatcggttttgatcttcaacaagagataaaacttgttatgacagcttgcgttctcaggattagtgcttccatctttctgatactctaatcttgtttatgtaattcgtcgagttatcatatatcttacataatctccagcaatattgctgtttaacctattatcggctaacatctgtcggtagagggcagctgattaggttaaacatcgatgttgacttagattatataggatatacaccactctatgaaacttccagcggtttgattgtctagatattgttcttctttttatactaaatgctgcatcagttgagtttgatctattaagtcgttcttagaatatcaatctctagcctgccttctggttgccaattagggtagtatcggggtttcagccgatcttatctaatttaactatatttactctatacgcctcattgatatgtgaaatctaccctttatgttaagatcttgtcacatttaagtatattagacttttgtttgatatactctacttgttttaaaatcttagtatagagtggtattagagtattagctggtacatgctagatatatctgatcggctatgctatgaacatatatagtctcgatattaatatatatttcgatttaagtgattcatactgtctcggcatagcgaccgatctatcccaatcacttgatttaagtatatatcgatataaggagtacatattgttaatatctacagccgattgagtagatctacttctttcttacttatttatgaccgccgattgatacataaatgacatcggcccaaagataaattatatgtcatcagcacttagccgatcggctatcgtttataggtttaaccgcggtttgcttgtatctatttcttttttattacaggatcaaatcaactggcacgctagcatacccgaaggcgagtttggacctgcactggagttaagcagatcttccaggcctcgtgttttccatcaacacgcttttggcacacccggtgggacagattagaagtcagaaattttctctcatggacgacaagccgccagcatcgctgtcctcggctagccccagttctattaaagagaagattcagtagttgggcctatccgaggttaatgaaggcaacatcgtgaacatcactccagacaagctgatacctaatcaaaagaaggattttgaagcgatgatgcagcaggcacgtaaccagttcttgagctcatttatgcaaacccgcaaggctcagtggtgcagaagtataaggtaaaggtagttgctgatgttcctggtactggttcttccaaggatggagaggtgaaacaagctccagatggctcggctcaaccgagtgacaaaggtgctttagatggttctcaaggaaatcaaggtgacaactcccaaggagtacagggagtttgaaagtgcattaatcctcctagtgggttttggtgattaatgacaaatgtggttaagggactaatgagctcattgagtagctttcaggtgcattagtccaaggtgtggaagatggatgcttggagaccccccaaaaagtataaaatcaaagcggaccggaactcgagaagtacataggatagttatcttctgaaatcgagtttttaggtaaaaccgtactatgaagaggggttccaagtgatgctctgagatatatcaagtgctcttagtgtgaaccaagtgtcaagtttccctaggagttctttttttttttgaaaatactccatctgtccaaaaatgcaagtccggaacttcctgtcttccaagtccgaaagttccggtcttgtgaaaaagattttcctaagtgtagtccggaagttcccgtcttccaggtcccgaacttcctgtcttgtttccagttcaaatttgtgagtaacggctagatgacgtcacctagctgttatacatatacagctcgtttccagctcgttccttagccattccactttcacttttcaaacctagagctattgctagcctctctgaagtgtttcttgtctttccactgaatctacagcctaattcttgtgtgaaaaagagattgagagggagagaagaagatttggagaggtgtgaagactaggatcttgggtgagcactaggaatatctcgtgggctgtcatcttggtgcttattactcttggagatgatcaactagacggttaggtgtcacccgcgagaatccattgcatattgtggatgtcccgggtaattttgtgaaggatttcccctcctccgaaagggaacgaggtaagttagtgaagttcttgtactgagattctagaggctttccaagtagagcaacccatacttgtggtggatttctagaagtaggttgagttggatcttggtggtcactcaattctagaaatttgcctaggggtgtttggggttaaaggctgtggatttcctctggggtttttgcacaagtgaggcaaggggttaatcgagacccagctcttggagctcctcaacggagagtaggatcacaagattcgaacttcgggaaaaaatcgctcttgtctctttctgtgatagttctgtggatgattctgtggtatatcctctgcttagaatacctgtgcaccatcttgtgaagattggcttagtctcttgtttcgaaatttaaatttcctctctgttctgttacccggaagttcctgtcttagaacaccggaagttccgggcctgggaggtcggaagttccggagttgcttaccaggaagttctgggtctaattgaattttaccgctgtgatttgtttttaagttttcagggacagcctattcaccccccctctaggcttcatcagcgcgttcaaacacgccactcctgcctcggcttcgttttcttcagccgatgattgatttcttgctcgtcttcctgaaagcactccctattcctcaatctttgaacccttctcttttgattcgtcgtaatgataccagaaggacaccattgagttttactgttttcattgtcctcctagccacgatcttgatttactggacccaatctctgatgaacaggaactcttgtctgccttagccgattgcccctaccaaacgatcggcttgagctctccgcaatatcactgcacccaggatagtcctcaatagatggcagcctcataccttcattccaacaaaatcgaaagaactcgcaaccccaatgaggatcaaagccatcatcatcttcttcataatgcttctcctgctgcttgtcatacttcctctgatatttgttgataatcttagccgaatttacctgaaatccttttgcacgacccccatcggctgttcggcaagctgtatgcaccatattgacaggattgccatcaaccttcattggcctcttagaatcatcaaacttgattttgcctcctttaatagccgcttggatctgctgcttgaagactttgcaatcattagtagtatgagacccagaattatgccacttgcaataccttttcttgcccaattcatcagccgatggaattgtgtgatcggtaggaagttgaatctgcttctctcggaatagcaagtcaaaaattttgtcagccttggttatatcaaagtcatacctctcctctttccctgagttcttcacccactggctgcagctatctcagagacatcatcctcatcatccgatccatatatataaggacatacatgattaacctttctagaattcttcctagcctctgcaaacctttgttcatgcaagcttacattctatgtaagatgtgacaagctttcaaagtcctcagatgagaatttctccctaattggagcaatcataccctgaaaagccaaatcggctaactgggcatcagttaaacttaagctgtctcaattattcctcatttctctgaacctctgaatatactcgtacacaggctcatcatgtctttacttgattgctgtcaaatcggacaatttcatctcatgtaccccactgtagaaatagttgtgaaaatgcttctccaaattagcccaactgttaatcgacccatgtggcaaggaagaaaactaagtgaaagccgatccagacaaagacaactggaataacctaaccctcaaggcatccacagccgatgcttcaccacactgagctaaaaatcggctaacatgctcataagttgatgcgctatcttgccctgagaattttgaaaaatctggaactttaaaccggttaggtagaggaactctctcaaaccattcaggatatggctgtcggtataaatttccagcatctttcggcctaagcccaaactgctccttcatgacatccacaatcaaatcagcccatggtcattgctgcggtgttccttgagattgctgtggcatgggctcgaattgattatattgaggaacaaactggggttgagccgaccctgcctgctagtattgaacttgaggtgatggtggctgatactaatagttcaaattgcccgcttggtaattctgaagatccggctggatgttgcgcaccaaatgctcgggaataacttgaggtatcacagctgtttcttgttgtaatgatgaaccgatcgctatgccacacctcattctaccgcataccatatagtgtatagtattgtgtcgctgnnccatcgagtagctaatcaaangngcacca

SEQ ID NO: 60454 - DNA, 2205 bp, Oryza sativa
caacattctcatcgtcttctacaaacagtggcggagcgctcggtatggcaaggtctggcactcgccatacctcgctccggccgccggtacccccacccccgcgcgcgtctttgaccgtgactccacgagcgcaggcgcagcgcggcgtcaccgttgctgctgggcggttgggccactcggtgctcgtacgcattaagcccatcgtgctcttttttttttttggtaaatactccgtatgtgggagtagtaaccctatccggcgcatttgggaaaaaaaaatccacagtcgctgcatcgattgagcgattgtcagcgtgcggccgtgcgccatgcgcgtgatgatgacgcggggaggccggcagtcggcggcagcaaggcgcaggtgctgtcccgctgaggcgggtaccgcgaaggcatgcgccaggcgagcgatgggccgacggcaagcagcagcaacaggcgggcgacggtcggcggcaacaagaggcgcgcaagcggcgctggtgctggctgcggctggggatggcaccgcaccgcgcagcaagtagccaagcagggagcaggcgagcagagcagcacttagcacttcagcagggggcagccaactttggggaaaatgaatagattggagaagggaaatgtcttggcatcacaaagaggtgcctatttttgaaaatttcaaaacattgcgaatttcagcactcagcacttcattacttgaagtattcttcgtggtatactcttttatttatgcaaatggataatggattacgatcaatggttgttgccatgcttaatataggtttattgacataatattttgtcgtacaatatcgtgcaattgagattattttttccttatttttgttgggtttccattgttgggtttccattctcgcgctagtccatatgtgccacacctagttttttttccatcctccgccactttctacaaagcaggattgctagtctactataagcggagtataatactgtgtactaagagtggctaaatgctactatctcttcaatagtttcctactttcctggccatcttagaggcagcgaatcgaagctgaaatccactcaccgatgcggagaggtcggtgatggcgctgagggcctcctcctcctcatcatcatcctaccaatccccctcctcatccccatcatcatatatagtacgtaaaatctaaacaatgcacgctctcattttagtctaatcgcgcgatgcatctcccaccgtccaatctcgttatcttttcattttcggcttacgttatcgctttctccactagtacttgactgtagataggctgacacacccacgtaacagtaaagattgatatagacatgtatgcctgttttctcttcaaataaaattttctctcaaattatttatccgatctacaatccaattacatcattgtgttcgttacaattaaatcttcacaacaagatcttacatgattatattacgatgaaaaaatatttatatttgtaaattacttttattatatacgtaagttacttttattatatgtttaagttacttttagatttgactaaattatttcttagatatataaaagtaaatttaataaagtctaaaagtaatttatatatatatattataaaagtaacttaaaacaaaacggaagtaactttgtcacgacattagaagtaaattcattgtagggataaaatatgaatttatatagaaaactttatttaatcaatacagagcaacacacataagtttaacaaattttaaaagtaagttcaatgttaacttcaacacacataagatacatactattgcattattcaagtcgaaaggagacactagatggattataaaccaactacgactagctgtttagtcatgtccaatgaaaaatgcatgcattaaagttactttcttttgttctaagttacttctataatatatgtaaattacctttaggttttgctgaatttacttttatatgtctaagatgtaacttagtgaaatctaaaagtaatttagacatatcataaaagtaatttgtgatttttcatcaaaatagtcatatgagatcttgttataaagatttaattattatgaacacaacggtgtaatcggatcgtagatcggatgagtaatttaagagaaaattttatttgaagcataggtggatagagtctctcatagatgggagtgga

SEQ ID NO: 60455 - DNA, 9387 bp, Oryza sativa
  unsure (1)..(9387): unsure at all n locations
agagaatagcaagttcatacgaaagcagacgacagagatacacattccccatcgccaccgccaccaccaccgtacaggtccctcgttgcggatgaagcatatagaccgccggtgttaatattggtaataaatgacaagcgctaaatgtggactaaccgttgtctttgagctatacattttgagttaggtccacgtcatatgtgcgcatggatgattatcgatggattaaaattgacggcgcaaagcaaagggaaagaagacggccaaactagcattttaatttagaattgatcgaggtgtagggcgatcaaatttgctagtttatttttagtttcgctgtactattaagaggggtaatgacctagcaaagagatgatttcaattgccacattaggtcattatgcatttagacttgtgctcacatttcacacacacacacacacacttcactgggttcggcctgaccaggggcggtcagaccggccacatagtggcggtctgactggcgtgccctagccggtctgaccggccccaagcgggcggtctgaccggcgcataaggccggtctgaccgccgccacatgcgcggtcagaccggccccctggaggccgggatggtgctgctcgggatggccgatacagagccgacggagtcgtattcggtctgaccgagccgaggccggtctgaccgcccactcaacgccggtctgaccggccaggccgatggggccctctgacagcactacaacggctagttttctagccgttgcagagtagcacggtctgaccggccacatacctccggtcagaccggcagagcacagagttgggggatttcgcccccaacggctagttttggtgggtgggagtataaatactctcccaccagcagcaagggggctctcttggcacccaattcaaaagctctttatggtttaaaacaagctcctagggcttggtatgaaagattgagagattttcttttgttaaaggatttcaaaattggaaaagttgacaccacccttttcacaaaaatcattggtgatgacttctttgtgtgtcaaatttatgttgatgatatcatattcggttctactaatgaggtattttgcaaggaatttggtgatatgatgtctagggaatttgagatgtccatgattggagagttgagcttcttccttggacttcaaatcaagcaactcaaggatgggatgttcgtgagccaaaccaagtacatcaaggatctactcaagaggtttggcttggaggatgcgaagcccatcaagacacctatggcaaccaacggacatctcgaccttaatgagggaggtaaaccggtagacttaaagctttatcgttccatgattggtagcttgctttaccttaccgcatctaggccggatatcatgtttagtgtttgcatgtgtgcacggtttcaatccgctcctaaggagtgtcacttagtggccgtgaaaaggattctaagatatttaaagcattcctctactattggcttgtggtacccaaaaggtgctaagtttaaacttgttggctattccgattcggattatgccggttgcaaagtggatagaaagagcacatccggtagttgccaaatgcttggtagatcccttgtgtcatggtcatccaagaaacaaaactccgtagccctctctaccgccgaggcgggatatgtttcggcaggtagttgttgtgcccaattgctttggatgaaacaaaccttgttggactatggcatatccttcaccaaaaccccactcctatgtgacaatgatagtgccataaagatagccaataacccggtccaacattctagaaccaagcatattgacatttgccatcacttcctaagagaccatgttgccaagtgtgacatagtcattagccacataagaaccgaggatcaactagccgacatctttaacaagcctcttgatgaaacccgcttttgcaagttgaggaatgagttaaatgtcatagatttctgaaatgtggcttgagatggtgcaccatggttgcttcttttgcattgtgtatatttgctctcatttgctcttatgctttggatttattgccatttggttcttctttgcgaaaatggagtatgtgacattaagggggagttttgcactcttgcatgtgctctacttccttttaatcttttatatgtgagcaaatcaactagtggtgctagtagtattttcaaaatgcccaagtcatcataagtcaaaacttttgcaaaatcaatgtaatttgaaaactatctcttggaaaatgtttcaaaagggtccttatatgttttccaagcctcatattgcaagaaaaatgtttttttgaatgaaaatgccattttggctctcttttgaagaaactagattcttgtttttggccaaaatgagattaaaccccaaaatgagtttgagaaggaatttgagaaaagtttcaaaacaaaattggtagagaggaggatttgaaatgtttttggttttcaaatcatattcaaaaaccaaatatttcaaaagttgtttgaaaatcaaattcgccccaaaaacccctatagaccataaaaggtcacctcctagcactcacgtgagttttgttgcaaatcatcataatcttcaaatattatggatggttagcaatatttaaactcatacatttcaaaattgctccaaaaatcaaatttttgttgaattttattgtgtgggggtagccgaactatgcaagggctgtgcacagtatgctggtggctaggcggtctgaccggcgctatatgcgctgtccgacctgcctggtagcggcggtctgaccggcctctagggcccggtctgaccggccgcaccccggcagtctgaccggccgcatatagccggtctgaccggcttgggatggtgggcccaggacttggtcctttcttcctcctcctcctccttctacccgacccctcctcatcccatctcatctcttcacttctccaactcgaaatttcttctcctctctcctctcccaaaccctagccacctccctccaccaaatccatccggttcaaccgtcaaaatcactccggttacaccgtaagtgaatctcctcctcttcctctctctattccatggattgatttgagtttttattgagtttgtgatccatggcatggaaccctaggtgaaggaagatgtgttcttcgatttgcaccaatagagggtagtttcttggtgtgattcaactccttcaaccggtaaatcactcttcctcttgtgcattgctctcaaatcgatgtatttcaatctctagggttaagggtagtttcccccattgcttcaatcttgatgaaatagacctacaccttgatattcatgttccaatcttgtgcaactctgtcctagcaatttttagaatcatttgtgtggattgtggaaggattcggttgtgctactgtcagtggcggtctgatcggccgagggccgtcggtctgaccagccttgagccgtcggtctgaccggccgatggccgtcagtcggatcgacttggggcttgcggtctgaccggccttggctctcggtctgaccgcccctgataggcagcactcccccttccccccacctcactatgtggtttctaaaattattgcttatatatcctttgatctttgacagtgatgcctccccgcactcgccatggtcgtcgtccgcccacgcccgatcccgtgagtgaggagtcaagcggagatgagtacactcaaagtgatgaagaggttgaggaaaatgttagggggcaagtgaggcaagtggagatgatgtcagtggaagtggagaggatgaggatgaagaaagtgatgatatgcacattgatacctccatccagtttgttgtgaacatgaggaatccatcgtagtataccatcttgaggtatcatgatcagtttttgaggcctcgggataccccggatccccgttttcacaccgctttccaaaagagtgtgtatgagcaagtttatgcagggaaagcttttgcagaacataagtggatttcttggagagacatcaatgagactccagagtttgagggcttgcaggatctcttcaagactgttggcattgaccggattgtgaccttaaagcaagactacaatgaagatttgatccggcagttctatgctacagtgtgggtggcaggagactatagtgagatgaagtggatgtccaacacccttcagtgttctatctccaagaggcaattccggtggctcctcaatattcgcttggactttggagatgacttgcatgaggagcacacccacaatccgctctccatagactatctctctcagttttatgaagatggagtgcggtacacacatgggaaggttgccggcttgaggactatccccagtgtggtcaacaggattgtgagagctaccatcctccctcgccttggaaacaatgatgatattagggggtggcttggcacgtcatcgatgcaatcatttagggccgtcagttcgacattgtgtctctcatgatgcaagagattgccatctctaaggggaccttcactcagggaatctattataccccttatatcatgaggttgattcaagacaagcttggggctgccgggccaaatttgaaaaagcacaagcaatacaagccctgccttcagcttgaagctccccgtgctcctagggcggtgccctcatctcatcctggagctagctcaagctcaatacctcctcctcctcctgggtatgatccaaatattttcttccattcacagtatgcttattttggaatgcaacccaacgaatacttcaacctggtacttggggctattaataccctaagtgaaaacatccagcgcttgtctaccgggcatgaagctttgcatgaggatgttcgtggcttgcgcaccgatgttggagacttgaatgcttccgtggggagattgcacacttgtcacgcccgaaaattcactagtaatttccgaacttatttgtgcataaaatcatcgtccaggaatcagccgaggtacacaaactgacaatttaatatacaaatccatcttaataataacgttacatacttacaaagaaaagaaaacagcagcggatttaacggtctagcgatggcttcagctccactcccacaggcagctcaactggggtataagccaaacgtcttctccttctggatccttcatcttcaactgaggtttgatgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgagcaacacacccatgctgcacaggcccaaccatcctgaacaaccatacccggctgtacagatctaactcaaaaccaggagctaagcaaattattaccagttatagtatccataattattgtgagagatgtgagactaatcacgaaaaacattgctcaactcgcccataaccgcgggcacggctattcaaatagttttactctggccagagatgtaccactgtacccacaagacacgattccacacatgttgccatgccccgaaataccaccacggcattgcaaagggggaaatcgtgacaatacccttcgcacaacacaactcaccacagtgcaccattcctggatcataatcaccccctctataaatataaccagaggcatggactccccagcgacccccacggacttctcgccgcttctcagtctggcaccctgtaatgaaccatgctatacaaaagataaagccgttgcccacgctggcttgtggttggtacggttaatgtttcacaacagtagctcgcgaaccggtccttaattgtcatgagcacaaccatcaaaaccatatgctcacaacccaccttatccaggttttaattatcaattaattatcataacacgattaaccatcgtgagctacatttaaatctaaccataagtaataagaataatataatataatttatatttaatcccctttaattagctaatgttactaagcatggctaagcaaacatacatataacatttagctgaaccaatccaatatgtaaggttcatgctaatcaaattataacccataggaaaataagatcatcttcggccattaattaattgggaaaggttcaccacccgatgacattcgaaaacaatgcatagttgaaataaaataatagctttaaatgggttcaacatgctcaaagggttgtttgggatctgtgtgacttgccttgggcttccgcaaacgcttcgtaccttcctcaacggaaacgctctccttcagaacgtcgaaaactaaagcgaaagaataaaaatcaacaaaacagtacaaaaacaagcataaacagtacatgtggatatttttaacatgtagatcttgattttagaaaaatttagcaacttgaaccactcgaatcggatctacagttatttagttatgattttcagaagatttaatctattagaaaaagggaaaaagaaaagatgatgatgtcacgatgacgtcatcgacggcagccacgacatgggtggcgacctcgccggagctagagaggtcggccgggctatctaagggcatctacacgtagaggacgacgacgcgatctcaacgatactcaccaacgcgacgaacgacgacggatgacggccggcggcgagcttgtgcggcggtggcgactcggtcgtcggcggcggcgactctccggtgaccggcgacggcggggagggggcggccgagcttcccctcttccacgcgcacccgacggcggcgagaggaggcagcggcgacggccaaaacgacggcgcgaggcggctgttcgtcggccggcgacggcggcggctaagacgacgtggcggcggctctacggttgacgagagagctcgggagatggggcaaaagaaagagaagaactaggggatgctttatataggcttggactagagagatcggactccaaacgagaggaatcgaagccggaaaatcttcgggttagtttggagagataaactcaaaacgaattttatttggataaaatacaaggaattaggttccgattcttgggggaaacgaaagaggaagataaagtaaatatttcccctcaactaattttaggaaaacacaagagaaaaggtcggatttggaggggaaaaaccgagcccactcggtctcagttcggctgctagaggtagaagatgaacagtgccaagggaggcaaattagactttttcggttggctgagaacagaacagagcacttgacttgggccggcttgggctgcacagcacgcgcgccagggagagagaagaggaaggaatgggctgaaaagggcccaagctgaggaggaggatttaaaaacttttttccaattaaaataatcacttaaatgatcttttaattgttaaaaatacttccaatgctcaaataattccaagaaaaatcttgaacatacttggacactcaaagtatttaatataataatatccagatcatttaatgattaatttattatttaaataaattgctaaactgttctttgtattattaacattaggaattgagctccgaaaattccgagaatattccagagagtataattaaccatggagaatttaataaaaattaaatccatccatgctttatatttagaaaattttatttcccacaattaacttcacttgtaaattattgaacatttcatataaattctattaataatttattaaataatttataaatcctaagacgaaaatcagggtgtgacaacactagagtgggtacattggattctcaactccaaatgttggagagctcccaagcatttgtgtatcatcgttgtcgtgatgctcatcatccttccacttcagcgcgtcctccttctcctccacaagaatgaagacctttttggtagttgatgccaaaagggggagaaaaatgtccttaggcgtgctttttgtcttgtgggttgggactagtggtagtgaggttagtcacctcatatctaataggttaaggaggtttgggctatattatgtatgggtatgggctattactctatattgtgtgttccttttcgttttgttgatctctatgtcatttggacccttcgcggtcttgtaatagcctatatttatttgtgagccctttatgtgttcttaatgtgaacttgtgcgatgatggatagttggtgtgacattgatatatttgtgaccatcttatgctcatgattgaatatttcttgaagttcacattgagatattgctcttgtatttgtgatatgttgaaatgagaaattgaaatgtgcattggctccatatttgctatttatgattgttatgcatatgtttagggggagcttttgcttgtcaatgcaatatatgtccatgtgctctatgtttgattatatatatttgtggtgtttgtcatcaattaccaaaaagggggagattgaagcatctaggcccccggtgttaattttggtaattaatgacaagcgctaattgtggactaaccgttgtctttgagctatacattttaagttaggtccacgtcatatgtgcgcatggatgattatcgatggataaaaattgacggcgcaaagcaaagggaaagaagacggtaaaactagcattttaatttagaattgatcgaggtgtagggcgatcaaattttctagtttatttttagtttcgccgtactattaagagggtaatgacctagcaaagagatgattttaattgccacattaggtcattatgcatttagacttgtgctcacatttcacacacacacacacttcactgggttcggcctgaccaggggcggtcagaccggccacatagtggcagtctgaccggcgtgccttggccggtctgaccggccctaagcgggcggtctgaccggcggcacatgcgcagtcagaccggccccctggaggccgggatggtgctgctcgggatggccgatatagagccgatggagccgtattcggtcagaccgagccgatggcggtcatatattntcttgcttattttactacctttaatagacgatttgccatgtcagccaatcaaggctcttgcaaacggtcaagtggaccaaccacattcgaaggttcatgcatgtcaaattatcccccaaagcaaattaaaaactaattcgtcctttatttattggatatagttcatcatgcctcccacatatttcgcatacatgatttactccactcacactcatgcgctcgtggcttctctttaaaatcctc

SEQ ID NO: 60456 - DNA, 21731 bp, Oryza sativa
  unsure (1)..(21731): unsure at all n locations
cgcgatagggcctctgacaacactacaacggctagtttcctagccgtgcaagagtagcacggtgtgaccggccacatacctccggtcagaccggcagagcacagagttgggggatttcgcccccaacggctagttttggtgggtgggagtataaatactcccccaccagcagcaagggggctctcttggcacccaattcaattgcacctctctcacacaacattgagcttagtgttcatccattgtagtggttgagattgatttagccaagagtcaagtgcatttgcttccattgtagagctagtgtggcacttgatcatctccacgccaagtcattgcttgttactcttggagattgccgcctcctagacggcttgtggaggagttgcccggtgacctctccgagaagattgtggaggaggcccggtgccggtttgtgagtggtttggagttcactaccttcggagtgaaggaagaactaccctagtgatcgaggcttgggtagtcctctccgtgggccggctcccgccttgcccaccccttgacgaagggggcgtgcggcggcttcgtggttgagcggtgaagttgggctcgcctcaacggggagtaggaaaccggtgagtttccgaacctcggtgaaaaatctcttgtcttcttgtctcatttgattgtcgcatttatatttgtgcaatttatatttctagagacatacttgagatcatatcaccctaggattgctaaacattgacataggagtgtgatttacttccctagagatataattgagccactatcaccctaggtttgcaaaacataacttagttgcttagttagagttgaccctcactaagcctagcaacttaggttagttttgattaggtgtcatttaattttaaatcgcctattcacccccctctagtcgacatctcgatcctacagcagcgcggcggcctaggcgggcgcggggcatgggcggaggggtggagacgaggaaggggcgaggtggcgccgcggcggtagcgaacgggaggaggcggcgaggggtcggggtcctggaggggaggagaggcatgcagctgcgaggaggcggcttgtaaattagcaccactttgttaaaatttagcaaatattttagaaactagaagggtgtgtttgtaaaatgggttaggagaggtgagattggaaaatgaaaatgaatagacggataggatgaaatgggggtgagaagaatggatggctaagattgaagcttgtcctttgaggggtgggaaatcatatcccaaacctattatccaaacacagccgaaaggtgttacagtgtcaatttccttcgagaaagctactgcatttgggattattgagaaatgtccttccacaaattactccctccatccaaaaaaaagccaacctcgtactaggatatgacacatcctagtacaacgaatctggatgtgtcacatcctagtatgaggttggctttttttgggacggttggatttggggcatatgacattattttcatgtaaatccttttccccgagtagtgatggtacataattttgtggtaatataaaaataaatattgttttcttataaagaacagcaagtatgatagccatttattccttcttcattttgaaattcacgctcatgagataccatattgtttctttttactggaaaaaaagaaacaatatggtatcattgttgtatcaatctcgttattgtatttttttactgtccgtttcattgtgtacgagattgtatcatttcaaaaaatatagtaacgtacaaaatgccatttattccttctttttacatcatctcgtttcattgtgtttttacggtccgttattgtatcattattgattatctctttatttctccaatacatacatgagctcaatattttttttccttggtgcagtgaggtactcctacatgttaaaagaagagaactatggtgccacagtaaatgaaaaagtcaaatcgaccaactatctaaattattgatgtcatgtgaacatggctctgttttttctttattttagtttggtgttatggataacaaactgtctaagctattaaaatgttggcacaatcaattgaaactaggtgaaacctcgcacgttgctgcgggagttcagtaggataacaataggtaaaaaataatgtataagatagctaaacaacataaacttacataaacactaaaaacaattgatctgatatggcttaattagagaatagagaaataacattaaccaagtgagaatgaactacataggtacataagatattataaaaaaataatgaatatatatattgaaatattatgtgaattatgtgggatgatgatttaacatgctttcattttaaaagctctaaaatgtaataaattttaaattatagataatatagcatgtttgcattatattaaatgtattgattgttagtggatgatgatgtgttaacttgttagtggatgatgatgtggtatctttgcatgttaagctttatgagttagtgggttataactttatagtcagataggatatgacgggttctcttagtctagctacttgagatgcgctcatagcgcagtggcaggattgctggcatgcaccccatccgcccaggtttgattctcctcgagcatgctcacttggaatatttgttcctttcttcttaaagccatcagcaccaagccctttcttggtgtccaacttcttaatctagctacctaaaacttcatatgtacatgttctttatctgctagctagtctaatccaggtaactataggcaatgttttgcatcacatagatggcaacatcatatgacctattaaccttatctaggtttgacatgagaagtccatatattatgttttacttgggtgccatcttatagttatcagtgagctttattattgatttattctaatttacctggtgtttttgtccttcaatgcagcccatatctaatgaattgaatttgtatctttattgtgatgtgcatctgttgtatcacacgtattattgtaacttcaggacattagaaataaataagtttgtaatttgatagcaactttgaatgatgttcggcattgccacaagatattatttattctgactgacaatcttataacacaaaaaattgaccaatcttaatgaatgatgttcagtattgcggtattgccgtaagatattatttattctgtgacaatcttataacacaaaattttgaccaatctactgagaaacttgcaagcatttcctgctactgaaaaagcatttatgttaaaaataacaatgctgaggaagacaagcatttcttgaatgtgataatataggcagctgaaatttgtaccagattatgtatactatcgtatacttgtttctaacttattataaacatgtataattaatgtggaattttaggcacaaatctctaaggaggcaatgtacatttgacaaaacgcatgaggacctcatcattgcttaaaaagtacttcatctgtttcacaatataagtcattctaacattttccacattcgtattgatattaatgaatctagatagcatcaatatgaatgtgggaaatgctagaatgacttacattgggaaacggagggagtagtatataagatattctctgcatgggtgaaaaacgaacactctaaaatggttcttatgctaactgatgtgaagaaaactttgtgcggaattataaataataagaatatgtttcaaattgtatgtgtttattactactgctatcttatagcttcacagatttaaacaattggcatcatagggctcatttggcttggtacccaacgaaattagttttggcactaccaatgttttaatagagttggggtataaaagctatattaatttaggtaaatattggcattaatctaaatattcagaaagtactatttaaatttaccaactattttgcagggcaagtttaggcatcaaaccaaaatagcccatagtttgatggactactatctttttgcaatacttttatatatgattattctcaaactaaacatggattttgatgtatttccagtttgtaaaatagaacatctctgacctcaaaatccatgcattttaacaaaatatcactttcttttccaaatgtttccaatcagcttctgtctactttctgataggcggctaggagaaagcatataccgatggaactgaataacaatgaacaccagtctcttctgcggaaaagaaagaaagaaaggaaaaaaaaaaaagccagggtcggttttgcttatcggggtcccccttatccacatcagcgtctcctcaaccaatcgccatttgccgcgccttatccacctcaccaaaaccccacttcttcccccattttccacctccacctccacctcccccttcccttctcgccaatctcacttcatcctcctcctcccatcaatggcggcggcgctcgcgttccccacctgctgctgctgccgccgcccctcgctgcgtccttccgcgggtcgccgcggccgtcgccccgtcgcccgctgcgcgctcccctcctccgaggtgagcgaagcttcttgcgattctttccttttagttgcgcgagcgggatggcttgggtgcctgcattggtgggagccggatggatgggtttggggtggatttctggtgcgcggcaatgtgggtcaatcggtgtggttggtgggaatcgaattagaattatcctacctgcgttgtactatatacgagtattgcggtatctctgtggtggagggggcttgtttactttactgccaggggtacaagtattcagatgttaatgcacacatgattaataacctaatggcctgagagcaatgtattgtggttcttgcaagattttagtttgttcatgtggggacgcttctgcgttgccataagttttcagctcccagtcagcgtgagactgactgacaaggtttgagattttcctctatgtaaagttctgcatgtgcgtttgcttagtgttgcgagttgaaaattgggtgaaaacagtattatagacatgatacgtagtaaaactgttagatgatgcagagttttatagctgcaaatttggaaagtgaattgttgtgtgtccaaactccaaaggattgaagtgcgaaacattgaattttattaagtaactacgatatttttctttcataattgcagctaaacctttttcttttgcgaaagattagatttagttggcaaactttcctatgcttgttcttggttgtagcaaatacggaaccatccaggcatccagtaagattggtaattctgtttccataagctattcttactgactgctgttgtcctgcatgtttcatgtgcgacctaagcttaggaaggtaaaaaatttgttgatggtatgcagcttgtgctattatacgaatgaaaatattttctcctttgcattcataatcatgtgtaaaagttggctatgttcctttcgttcaaatagttgcatttattttctgttctgcccttgtaaaacaacaatttccttcattatcggtacggataaagtttcatactgtgatacctctagtcagatggtttggttctcttttactttgttaatttattctaattttttaattcaattcttgcagaagaattcatttagctggaaagaatatgcaatttctgtagcattatcggctggattaatcactggcgcaccaacgttaggatggccagcacatgcttctcctcttgaaccagtgatcccagatgtttcagttttgatctctggacctcccattaaagatcctggtgctttattgagatatgctttgccaatagataataaagctgttcgtgaagttcaaaaaccactagaggatatcactgacagtcttaagattgctggtgttagagccttggattcagttgaaagagtaagtcatccttttgagctgccgattagaaatggtctaggttttatctagaggacaatgcattcaataactgaaagcagccaccttttatttcaactctcttgaatttacttactcacttgggctactggaaatttataatttttttcttcaaattttagaatgtaagacaagcatcgagggcactgagtaatgggaggaacctaattcttggcggtcttgctgaatccaaaagagcaaatggggaggaattattggataaattggctgttggacttgatgagcttcaacggattgttgaggacagaaacagggatgcagtagctccaaagcagaaagaacttctccagtatgttggaacgtgagtgaacataactcctcaaaacaattatatgtaattgtttgtctttccattgctaatgtatggagtagtagatgttctgaccacaggaggctgatagatacaacaatcctattgcctgacttgttttaagagaaaaggcaaactagatgttttcccacctgccattctggggatcaaacccgggtggtgcatttcagccccacaccttcactactggggacattgacaaattgttatggtttgctgaacaaaagttcttgtgaagtgataactctttagtgctacagaactgaattatgtcagccactaaataaaataattgtgatcactcttacggaaaggctcttctcgtactttcaccactgaggacattgacaaaatgttctggtttgctgaacaaaagttcttgcaaagtgataactctttagtgctagagaactgaattatgttagccactaaataaaataactgtgagcactcttatggaagggctcttctcatttataccttgtcattgactctgcagctgagatcttcctgggacattgcatttctgcagtgtagaagaagatatggtcgatggattcccctatgaagtgccagaagaatacagcagcatgcctcttctcaaaggaagggctaccgtggacatgaaggttaagattaaggacaatcctaatttagaggattgcgtatttcggattgttctggatggatacaatgctcctgtgactgctgggaacttcttagatctggtggaacggaagttctatgatggcatggaaattcaaagaggtaaggttgcttctgtgatacattccatagatatagtccaacattgtttataccaatcaccatttttaattgcattttgataaacatgtagtagataatcttgatagtaactagcaagctcgttttactgactaagccatggcattacccattttttcaatgaagaagcctctctagttgttctctgttatttaggattgagaagtcagaaccttaattatctagtgagcttttgttaactattatcggttcttttgcagctgatggttttgttgttcaaactggcgatcctgagggaccagctgagggatttattgatcccagtactggtaaagttcgtacaatacctcttgagttaatggtcgatggtgacaaagcgcctgtatatggtgaaacacttgaagtaagtaggcacagttctttcttttttcagtttcagaatctaccggaaattttggcaactgtatgttgatgagcttgttcttacagtacacatgatcatgcattcaggaacttggccgctacaaggctcaaacaaagcttccttttaatgcatttggaacaatggcaatggctagagatgtaagtatcatgatactgcttcagtgtaatgtatcaagcatctgcagatatgggcatgcttcagcattttctaacattaaacgtttgaatatcatggcaggaatttgatgacaattctgcttctagccaaatcttttggttgttaaaagagagtgagctaacaccaagcaatgccaatatactggatgggcggtatgccgtatttggatatgtcaccgagaacgaggactacttggcagacctcaaggttggggatgtcattgaatcgattcaagttgtctcaggcttagacaacctcgccaacccaagctataagattgtaggataaaatgtttctttttttcaggagttccttgataggcaattattttaccatattgaaatcagtgtgaagtgctataatctctaaccctcatctcatgaccttctatgttttgtgagctttgcaatatgcgggattcaatattacttgaaagtaaagacgttcatcatttgtctcttgccatatgacctaaaactgaatatcaaccgttttgtctgaaaactagcatggcgtttgtgtgttcaagggtctgctactatgagataatgaattacaagagggaaaagtaaaagatatgttgcttattttcacactgcattctgacttactttaggacttctcagaatggctgtctcccagtgcagttctagttaataattctgaagattttatcattctgttagcgcttttaccagagtagacattgagatataacagtttgtaggggtgtttcatatgtgccactctaaaacagtggtgtttcctatgcaaataagtcgcagttgacaatatgtaatcctatgttataaggccactcttatagttgcattggcatatctcaaactttgcaaaagtacaatggcatggttccaatttacccttatttatttatgtttatttttatataaagtgaatttaccaggagtatctacaatgttttggctctactccaatgagacaatacccaagagggttcagaaacttaccctttggcttatcttggtgaaaaccaaaatggtctaaatatgaacttggaacacctagaaaagctttagaagcttattttagtaattgttatgtgcatgtgtggctatattccggcaaaaaccatgcttgcaaaaaggcccagggaaaccgaaacatctctatgagctctctctctctctctcttgtagagctgtgaggagtgagccatcagcgccgccatcgatcacacacctcccgcttttctatgtctcgtgtgagagtcgagatatacttgatagtacagtggtaagagatgtgtggttttaacaccaaggtcctgtgttcaattcctaacacgctcacaatttcttcttacaaaatgttttgaagtacatctgtccctccaatcctcttttttttccttgtgtgagagtcaccacaccgctggacttcttcgttggttccacttttagccccctttatccttatcctcccacgtgattacttggcttgtcgaaaggatctccgccctggtctggagtgccctcgccgccacaactacccttgccgcgtcaaccgtgtccgacatttgccccgtcgaagcggcgagagccgaaggtgccacaccagcttcggcgaggggcgtcgaaggctctactccctcttcggcagccatctcccctcctgcttcactctcctttcgcttagcaaccttctccttcgcgaccttcttcggtggcattcgctctcaatggtttcgcttagaggtccccacggacggcgccagctgttatcgaatggacaactgcgtcacatcgaaggacgtggttctctcaacagtggttggaagtaaagaatagttatattacttagtgaaaaattttttgggatccccccattacatggcctagaggggctatttataaccctattacaggtcctctcccctagggtttaggctttacaggggaatttacatggttacccttacgataaggacattattagggatacatagtgtcctttacatgtatggaccctaattgggctaaatggcttggcccattgatctggcgaatccttttcggggacgcaacggcccgctgggcttcctcaggtggggtttggtgccttggcgaaacccatgccctcgggccaaggctttcgccttaccatattcgcctaggtgacctcctgacggggtccttgtccggcgaaacacgtgtactcccgagccgtggctttcatccttggggtatccctcttcgaccttctccgctcgcctccggtctgagcctgttgcccaagttttcggtttcggtaggcccggccgaaggcccttcgtggtatacctccaacagtgataattagctgttgtacactcctctcattattttatcatttccagccgaaactaagagagaaagagtggtgaaagtaccaaaatgcctctacgtcgttttgcttgtaaatgctggtcaaaccagacctgatcccctcacgcgccatccctgtgcgcgcgctactcaacgtcctcgcgtcccgccctcggcggtgtgaggctcgcgagatcccacgccccagttaattggggcgttggtgtcatggcgcggcgccgcgggttgtggcagccagcgaggtgcgccttgagcgccagtttggatgacgtgggggcggggaaacggagttcttgaggccgatcgaggagcttgcggtggcggtgggtgtgcagcgcacgggttgcgagtggctggcgagcgtggagagcagcgcggggcagagctgggatgcctttatcgctccagatgctgaagcggaagaagcagcagcagctggtggtgtggcagacgcggtgggacgagcggctactggactccgccggcgactcgatggggcgcaccttcttgtcgatggtgctcatcgtgcaggagctgcagagcttcgcgctgcagcagatgcgggaggcaatgctgggcgacaaccaacagggcgtcctggcgcgagtccatggcgagatgcacgcctccttcgtctggctcttccaggacatcttcgccagcaccctggctctcatggtctcccccatgctcctcctcgccaacttcatcgtccactccatgggtcagtgtcgccgccgcagcagccatccctcccgctctgccttccaccgcggctgtcgcggtggtcgacacccaacacgccgacccatcccagtgggttaaacactattgacccaagggcaaagttgtctctctccattaataataaaataataggagtatccagccgctaattaccactttttacagtgtccacgaaaagattcacgttcttcgggtgtctttaagcaaatgccacaatctttgagtgccctgtagcaaattttgcctttagactatatgcatgtcgccacatgaataatacaattctttgggtaaagcaagtattggtaaggttgcaatcgctaaagttgggtttattacatttaagatgttctaatttttttatgatgtcttagctataacgatcgatacaaacattatcattgacatggttatacttgaaaagtagttagatttttttcacccgttacgacgcatggacatttttgctagtaatacacatgttactcccgtgtatgatacaatgggtggtgtacttaagaatactgactatcatacttaggggtgaaaacgggcgggtacggtcagattatggcattcccatatcctaacccatattttcttttaaattcggaaccggatacggataataccggataatatatcactcatcccgtatcctatcccatattatttccttcgaatcgtatttgggaacggatatctatttgtatctctaattcatagatattaaatatcataaggtcattaaagtattaaaatacatacatcaagaaaaaaaattatacaatattacatgtgaacattaaaataatgattaaccgatcttttatcatgtttctaggtagatttataataaatttacatacatattttataatacgggacatacggacggatacatgtcttcccgtttcgtaacccatatttttctaacgaattcggattcgaactcggtatcccattttttctcccatattcctcccgcgagcctcgggtcgggcgggcggtcgggaaatacccgctccattttcacccctaatcacactaagtttgagctaccaaattttttagacatatgctccgtcacctttatagagagagacgattcaaaagataaggaaaccaaaatagatttattttgagatagtactcctataacagaagaaacccaccgaaggcccaataaagtggaagcatataaccctatgcccttgtaaggtaaccctagggctaaccaccagcttcctcccaatccccaaatccaccgcgcagacacgcacgccggccggccggcggacgcgatccgctccgttgtcatcgctcgcgatacacgcagcgactaggcccagcaggtctgcacggcggtctcctccggctgctcctttcattccaggcacgccgggcacccccggttcgttcatcgcatctcaaagaaggtagggaagcatcgcatctcgccgggtattgccagttcgccgccatgccccaaccgaagtgcccaacggagcggaagaaggctgaccacctccaattgattccttgcggggccccggccgggtcttgcgggggggtcttgcaggataacaatgtgcaccaagattgatgtaagttgctccgagcatatagtgatgtaaattcttatactctcacacatcggcgacatcatgtgttattcttgaatactctcccgcgcctagccgtagcccgaaggcactgagcctcaatacgcatatcatatctaccagttctcctttatttttccattgttattagagaaccggatctgagccgtcttggtctcatgtctttctttctgtctttttttcttttcctaaaaaaaaaattaaaattggatcttgcctggcagtcccgttgtaagacgaacaccttgtccggaaaggatgtcgattccaaaaataacacggagaccatgttcgagttcatttaccaataatccctatggcacgcatatatacatatataagtatagccgatgcagtgtattgtatacagattattattattattttctaacaccgctagttaactcattgctaattctgcatgtacttggcgccatggactatgaattcaagacatacaagaagaggcagaggggacaacagcaaatggactttgaattgaagacataccacaggaagaggcagaggcgaagggggcaccagcaaactgtagagttacccgatgagattgtgagggaagtcttgatctggctccctgtaaaatccctggcaaggttcaagtccgtctgcaaggcctggctttccattatctccgaatcttgttttatccgtgagcatctccagtgctccaagctgaaaagatactggaacccgtcttcctttctcatcacgccccatattcctctgaaaccaggtgactctatctttgctgctttctccaccgacatccgcttctatcagtggtcattacaagaagacacgagggctgctgcaacactcctttataggaggcacttccctgccggtgagtttgaaccggtgctcccaatggcacattgcgatggcttggtgctgctccccactaagaccaaggcctacgtcttcaatccggccacaagggatgtccttgcactgccagagagcaatcgcaacatgaggcaacgtgacaacttgggctttgatgcttcgactggcaaatataaggttgcacgatctttttatcgttcccgtgaatataatcccatggggatcgctgcaatgggtttcgaggtcttcactattaatggagaagaaagctgttggagagaaactttggtggatccaccctaccctgtgctgtattcaaagattgttacacactgcaaggggtgtctattctattacattgataagaagaatcagcaaaatcccccacaggctctgctccgtttcagccttcaagacgaaacatttggtgtcactccgttgcttactgacacgtaccctcaagttgaagatgatgaagttacaattactgagcttggcggtcaactatgtgctactttcttttgcaatactctgcaacaagtatgtatctacatgtcaggagatgtcatggatccagattggaattgttggcatataataaactttatgaattgctatccaatagcctcgcttggcagcggtcggattttattgaggagaggtagtcttgtcttctgtactaatctgaaatcgtacagcatagaagataaattggatattgatgatataaggtaccttgggcccaatgaagacaacttggggcatgcatgggaagacttatgctggtatgacatacttccttacaccgaaagtcttgttccaattattcctagggccaccttacaggccttataatgtgtatgcctttgcgcaccaacttagtggataacccaacatcttcatcgagggaagcatgaagaaaaagaagaatgaagattatttaatgatttaaggggcacttaaatgaggtgttgcatgtttgttatttgagagccggttcattttgtagtgtaaaactttggcatatagccaatatttggtcaggtggtcaggttgagaagtataagttatgtttagattgttaccattgtcttgtgagacgaagattctagaattaacaaagtttggtaatggagacaagtgtcggcaatgtttagaaatttggtaaggttagttttgacaacaaagtgaacatctcctgagttgtttccttataaacaccctaaggcagtgtttggcaaatggcaaagggaaatgatttcccactcatctttaaatcctaaccattcattctcccttcccatccatctttaaatcctaaccattcattctccctctttcacttaattctaacccttcatttatttcccaatcccaatcccaccccccatttcctattatccaaacacaccctaagttcttatgattcttcgcttgtaatagtatttctttctgggtgcctttggcagggctcctgtttgtttacgattctccaagttccagattttgttcatactaaaaaaagggactatctatacaacattcagctaaaaatttgtaggtttttgccgaattttggttcatccgaccagacatgcgtcaacatcccgagcgagagagcagagcgcatgggtagcactcctctgcacactgttctgttttttcattttttaatttttttaatatttacagaaataatctatcggcgttaaaaattacaaaaatagaccctgccgcctcagtggtgggcggcaagctgacgtggcagacggcggctcgaccacgccgtctgccgttgtcggccaaaattacatttagccccttgccgccctttggggctaaatgtaattttggcagcccataaagagcttggggatcgtactttttgcatctgggcccgactaaatgatttatctctatagacaaatgatttttgtctgttatgttaataataattaaagaaatatttgttggtaaaaattgttaataatgttataaaaatgtattgaagttggtggtttcgcaatttcatatgttaagtaagatattattttgtaacttattcgacgtattagtgtgcgaaattgatataggcctatcgcagtctcggtcgtagaaacattatatggacttaaacaaggagaattatgtaacataaagaaatagtagtaaaattttaacatgatacatctatttccactgcggttacgtagatgatattagattcgaactagaagagaggtagtgcaagagttgaacacaacgacgatgtagtaatgggacaaggaagcatgacagtagaaatttcaatatgccaagttgtccgataatagctaacccctacgtgaggatccctctactctctcaaaccgcgctttagtaaccctgtatttctctggtagttcaagctgcacaacacggctaggtggagttagaacccttctggtgtctatacattctctgtattgacatctccttggtggttcctgggggaaagaatagatgtgaagcgaacaaagttagtaaatgttgtcagaaaacaaggattcatgataatcaaaatattcttaccatgaaatcatcgtcaagaatatttggacaaataaagaaccttcgacccaatgtcgtaggctttatggaacgaagaacctgacaacgatcaccgcacctgcatcttggacgggcttcccatggagggagtgctgtagttagcacccgccagtcgcactgttgttcacgacattgtcgttcgtaagccgcttttctctgcaagtattgctcagtactttcggatgtgaaataccagcgtccttgtaaacaagtggttaggtcgagaatgggattttctgtatcgatccactcaatgtatgcgcaaactgtagtgcgggtctgacgaatagagtagtattacgaagaataaaacaattgcccatacagaatgaataagcatatgcagataatagaatatctcacggtcatagttagggcacctaaaaaagcgccttgctcgaatatcaggattcctcgaagccattagttggcatcggtcactacataggcagagaggacgctggcaccaaggtggtagtaggtatacacaaggatcgctatgcagttcggatcctcaacgcctaggcgtctagccattgacgaaagctggtaggatttgtaatggagcaagtggggaagagagtactgaatgtggctgagttatgaaagattgtgaggcctcactcgttaaggcgacttatataggcacaaaaaattgcagtgatatccctaacatgtcaacgtcgtggggcacggtgggtacgcctgattggcgccgaaagttacattggtcgtatgcgggcaatggcaggcaattagtggtatcgcacgtgaataaaggaggctgcatcggtgcggcagaaagtagtcgtgcatgcgccgaaaggtatcgtgcattcgtaaaaagtaacagcaaagttcagggatgagaacccgaataacaacaacgtattcattacacaagcatacagtactagcatgtgaagtaaataaacaaagagaagtctgttctactggccctgccccgcgccgcgaccacgcttggtccttcgggcctgtgcttgcacgtggtcctaggagtacgtaaaacgatccagtggcacagcacgggtagcacgagtgtttggcgacggagtggacagcgactggtcctgcgtctgcacaggcggtgcgcctcccagctgtgaggggccgatgacgtcctttgtcgagcctgaagcgaagtcgaaatcggtgatgtcgaagagcaaggtggaagccaccccgtagtccgacgaggtcccagcatggtccagtggtggaccctgactcgacgtgccggctgcctgtgatgaagtcccgatgtactgccagaactgcgctgagtgcgaggtcgacgcagctgcctgagacgctgaccctgcagcctgggagaagtgggcagcctacgtcgtagcgaactggacgaaacctagacatcgacaatgtaacccttgtaagctaagacataaaatgcatgtaaattgattgtcgaagtactgttgttttttgaagtacctgtggggggcacaacagatggcctagccgaggaaggcggggtgctgaacggtgcacgaaaccctgaagcaatcggatcaatcggctcacatagatgtgcgaggcatgtaaaaaaaatccttaaaaatacttacctctgtgcggagggggagtcggccttggaacgtgcgtagctggacgggaacaagtcggtaggggtggccgctgtggtgctgcgtctgcccgagcaacgtcgtctacatgacaggtgagcactcggagaatcgagcgcatcgactccaccatccgtgtgtacgtcgtaaggtgctcctctacgggtaccggaatccctgcaactaaacgttggatcgtcgttgaaccgtcaacgacgaccctattgatgttgacgacctgcatggttaatttattcgtaaatattcgtaacatttgacgaagagaaaggaataaaagataaaggaatggtgcgatgcagggtactcacagcacgagcgaagtcctggtcgcggtgcctggcgtagaggtctctagtgctcgcaacgtgggcctgttgctcaaagggagcgaaggtgactctagtacgggtgcgtggctggtaccagcgtaggtaggcctcgtacgcctcctctgtgtgtggctctccctcgtgctccacgacctcctcggttgcgagcaaccagtccttaacaaaagcaaccggcgagcatgcgtgcccaagccgccgccggtggtgacatcaccgctgacgtcatcgtcgccgtttcccatagaccggcggtagatcaagtcgacctcggccgttcgttttggatcgagtagatctcggccgtccgttccgtagaccgccgctgtgcacccggtccaccgtgaacccgagcccgctgacgcaataatcctcttttccttttcaaaaataattcattattgcgtcataattcaattaaaatctatataaatgatttcatccgatttaatctttgaaaattcataactaattcatcttagcttggatttagttggttcaagtctctaaatttttctaaaattgagatctacatgttaaaaatatacatatgtactgttcatgcttgtttatgtgctgttttggtgtttttgctcttttttccttagattctgacgttcccggagagtccgatttcgcaggagaagattttgaagagttccaaggccagcaaggcaagtcgcacagatcccaaaacaaccctttgagcatgttgatcccgtttaaagctattgtttctattcaactattgcatttatttttgaatgtcattgggtggaaataacctatggccttgttatagcccttttgctattaattcccaattctttgtcacttggttaataatttgattagctagaacattatatggttttagttaaagtgaataggatgcttagccatgcttagaggccctagctcatataaatgggataacttatgattcactattatttaatgatggcttaatgatagctcatgatggtcaatcgtgattggttaattaattaaattgccaactaaaacctgataatggtgggttgtgagcacatggttttgatggtcgtgctcatgacaattaaggaccggttcacgattttcagttgtgaaacattaaccgtgccaaccacaagccagcgtgggcaacgactttactttccgtatagtatggttcattgtagagcaccagactatgaagtggcggagataagcccacgggggtcgctggggagtccatgcgttgtttacaagggggtgattatgatccgggaacggtgcattgctttgaattatgttatgcagagggtattgtcacaatctctattcgggtacttgttaactatcgcgacgcatggttgacatgatgttgaggttgtgtcttgtgtgtacagtggtacacctctggccagagtttaaactattcgaatagccgtgccagcggttatgggcgggtctaacaatatctttcgtgattagtttcacagttctcaccatattaaatgatgctgttaataacttgtttagctcctggtttggagtggtatattcctggtttggagataaaactgtgcagccgggattggttgttcagaatggttgggcgtatgcaacagggtatgttgtatagcgttggattaatattttttaattaatactttactgttttatgaaattctgaaatgtttattaaatgctatttatgcaaatgagactatattatgccttcctttgttatcccgtgcacttgcatatttgctgcatggcttgctgagtatgtcatatactcaccttgcaatcattcatcagaggagttctacagtgatgctgatggtgtggaggattaggcgtagccctggtcaagctgcctgtggagtggagtcgtctgcgtcgtttatcttattttccgctgcttagaactttattgattgagaggaactatctacctctgtaatgacattttattcgcttattaattagagtaataattgtactctattattaatttgttattgtgtgcctcggctaattcctggacgagggtttacacacatgtaagcgtttggaattttggatagaaattccgggcgtgacaaataccccggactgattgatcaaagcatgatgcatagcgtaatcaacccgatcttgaaagttattgaaaaaatcttatgctagttcactattctgattaagatttcctccttgtggctcctgtgcaccatcaccttggacgccatgaactccttcagaattgtcgccttgatcgcttggggagccgtcggtagcacctttagtactcggctgagccgagttgcctagagcttgtttcacttctccatctttagaagaaccagtcccaggactatcagcaaccacgtttattttatacttctgaacaagtgtccccttgcgggtctgcatgaatgagttcaggaactgatcccgtgcctgctgcagcgttgcttcaaactcctccttctgcgcaggcgtgaatttctctggatcgatcggcatgacgttgtcatcaatgatgtcagtcaatcccagcttcaacgccttgcctttaacggaacctaggcttgatggtggtggtggctgtttctcggccatgagtaagaactgacgtctgacttcttacaggtcccaccgggcgtgccaaaagcgtgttgacagaaaacacgtggcctgggagatctgcttaactccagtgcaggtccaaagctcgccttcggctatattagcgtgccagttgatttgatcctgtaatcaacaagaaatacaagcaaagaaaccgtggttcaatctataaatgatagccgatcggctagatgccgatgacatatcatttatctttgagccgatgtcatctgtgaatcgatcggcagtcatgaataagtaaagtagaactagatctattcgatcggctgtagatattaacaatatatactccttatattgatatatacttaaatcaagtgattgggatagatcggtcaccatgccgagacaatataaatcacttagatcgaaatatatatcaagaccaggcttatatatgtttacagcatagcaatcagatagatttagcatgtattggctaccactccaatactactctatatcaggatatcaaagcaagaatatatatccaaccaaaggcctaacatacttagatgcacaatatcttgatataaagggcagatttaacatgtcaatgaagtatatagaccaaatatagttaaatcagataagatcggctgaaactttgatgctattctaatcaacaactagaaggcaggctagagatcgatattctaagaacgacttaatagatcaaactcaactgatatagcattaagtatgaaaagaagaccaatatctaaccaatcaagccgctagaagtttcatagagtggtagatatcttatataatctagatcaacgtcaaaatctaacctaatcggctgccttctgctaacagatgttagccgatagtaggttagatggcggtattgctagagattatataagatatataataactccggggaaaaacccggggaaaaaatttntaaacgaattacataaacaagattagagtatcataaagatggaagaactaatcctaggaacacaatccgtcataacaagttttacctcttgttgaagatcgaaaccgatgcagctcaacccgaaagcaagaactcgtcgaaacaaaactaaagcaaaaagggtgatgaactactgtaccatgtngtagacgattngngagcgcc

SEQ ID NO: 60457 - DNA, 9528 bp, Oryza sativa
  unsure (1)..(9528): unsure at all n locations
tctttagtaccggttggtaacaccaaccgggactaaagattccgggggggcctgacaagccctgacagcatttgaaccaggactaaagataatttttagtgccggttggtattaccaaccgggactaaagatcagatatgcccgttaccctttttaaccgggactaaagatcaggtttttgtttcaaccgggactatcgtggaattcggtcgaccgacgaaagatggtttctccagcagtgcttgctcaatgtgccagcatgtgacggcagctggttaatgttgttaactaacatgcgccaaaagctacaagtctgttaaatttccaaggttattcccagatcgaactcggcccaatcagctcgcagcttcaagaatacagtacatgaaaaagaaatgatgatttggcagagtgccaccaaatgtagtttcgtcctactatatatggcaacttttctgttaaatttccaaggatcccagatcgaagtcggcccaatcagctggcaacttcaagaatacatgaaaaagaaatgttgatttggcagagtgccaccaaatgtagtttcgttcaactatatatggctacttttcgctgaaaaattaaatgtccatactaattaaagctgctaatattgaatttcttcttcctcagatatatatatttcacatctatagcttgcgattatcaaagtctaagtaatgtaattgttcacgtttaaaactttgctaattacttgttttaattaactaacctttgcatccattcgaaatttcattaatcttacagaaacttttgtcccgggctcccggcacggtaattccttgtgcatacattgataacgctgcaaatacaaagtgagttacactggaaaacaaaagatcgagatggggtcctaaacaatttgctgcagttaaaaatacatgacaatacgctagcatgttaattagtaggaaaaaaaactcttgaggtttattgttgttgccatccctgtgaatgcgaaatacgccagcatgttcattgaggatccagaggattgttgtgagctcgctgccacaggcgagctgcttggcatcggaatcccttgtgcatcggaccgacgcaaacatcagaagacgcacccgtgccatgaagatatgttccagcatgtccgacatagagaagtcctcattgtcccgttctttcaatactggaatcaattccttataccggatccgaaggttttcggtgtagtaatgctgatcctttctctgtatcggtttctcattacccgacttagcgggcaccaaggtgaagctagttctgtcagagagaattatattctggtagaaaagatcacttgcgaattctggcctcgacttgtgggtactatatcctggcctccnnnnnnnnnnnnnnnnnnnnatcattggtttgggctgttcctccttgtctattaggagttgggcgagattcttctttcctccatgcacttaacagaagattgtaattggttgcccttaatttcgttcagagctttgagggcaccttcgtacaggctgcgtagcttaaggcctggtagcatgcttgggcgcaccacgacgaggaacaccatgtaatttgacagcgccttgatctcccgtacatgtcacgacgatgatgcatattcaccactgatcaagaggaagatgtctgtggtgatgtgcaatataaggatggtcctttggaatgcaggtgcgaagtccagagcctcttctagtacccgatgtattgctggttgcggtttcaccaccgacaccgccgctgctggtagttccccttccaatgcaggcgccatgggcagcaccttgtcataaataggtgggtacgctgacttgatacattcccatatacattcgaacaaaaggttcctgacatctgatgaccggtagcataacatatgaaagcccatcgagttgtggtatctgtactccatccaatggtcatccagtgaaactaattccaacattgatttgaatgtcttcgacttccatgtcatgtcacgagtgcactcgtcaaacaagttgtattgcccactgattcctagccacctcctgtagctagttgttggatccttggaaaagaacctcgatggatctagagagaggatggaacggtgaatcatgcgccatttccctaagcacagaagggaatggtgaagacaggagcgtggcctatcatccaagaaggaataggtccatgtcgaggccactgctctgagaagccatttgatatccaggatgacggtgccacccagtacgatatatgtgatcaaaacgtcaggctgctgcggaccttccctgctctgagaccaaaacagcaagaacattgcagatgtgacgaaatgggaggtgaaacagatggcataaccaccccatgtgtggaccttgactgcctgtcacgcccggaaattcactagtaatttccgaactaatttgtgcataaaatcctcgtccaggaatcagccgaggtacacaaaccgacaatttaatataccaatccatcttaataataacgttacatacttacaaagaaaagaaaacagcagcggaattaacggtctagcgatggcttcagctccattcccacaggcagctcaactggggtataagccaaacgtcttctccttctgggtcctttatcttcaactgcggtttgatgattattgcaagaatgagcatatgacatactcaacaagccacacagcaagtatgcaagtgcacaaggataccaaaggatggcataatataggctcatttgcaaaagcagcatttagcaaagatttaagagtagtaaaacagtagagtaattaatcaccacttttaatcaacactgaacagcacacccatgctgctcaggcccaaccaaacctgaacaaccaaccccggtcgtacagatcaaacctccaaactaggaattatccattccaaaccaggagtcaaattaattctcacattattaacattgatgagtagtgtgaaactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttccacaacacaactcaaaacagtgcaccattcctggatcataatcacccccttataaacaaggcacggactccccagcgacccccgtggacttctcgccacttctcagtctggcgcactataatgaatcaccctatacaaaagataaaaccgttgcccacgctggcttgtggttggcacggttaatgtctcacaacagtagctcgcgaactggtccttaattgtcatgagcacaaccatcaaaaccatatgctcacaacccaccttaaccagattttaattatcaattaattaacatcacacgattaatcatcgtgagctaccattaaatataaccataattaataagaattatataatttagatttaacccctttagttagcttatgtttctaagcatggctaagcaaacatatatatagcatttagctgaaccaatccaatatataaggttcatgctaatcaatttattacccaaggtatcaaggaatagggcattcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcgatcttcaattaaccttcttgatcacttccaacgcactcacgaaccttcgcaacgacggaaacaacaagctaacacgcaaaacgaagaaaaagactaataaaaaccaaataaacaatacatataaagtaaacaaacatgtagatcatgattttagatgaattatgagacttgaacggccttattctgactccaaatgaatttattatgaattttacaagattaaatctaattaaagcccatttaaaaagaattaaataaatttaattcaatttatggacaattttaatatgtagatctttattttagaaaaatttagcaacttgaaccacctgaaacggagctacggttatttagttatgattttccgaagatttaatctattaaaagaaattggaaaagaggaatcatgacgtcatgctgacgtcatcatcgtcggcatgacacgggcgacgacctcgccggcgatagagagatcggccaggctatgcaagggcacctacgcgtagaggacgacgagacgaatccgatggtgctcacctatgcgtccaacgacgaccgacgacggccgacgacgagaggaggcgacggcggcggcttggacctcgccggcggcgagatacggcggtcggcggcgacggggaggaggcggccgggcttccccaccaccgtgcgtatgcaaaggcggcgacagcaagcggcggcgacagcaagcggcggcgacggtggacgcggcggcgcggcgtggccgaaggatggccggcgacggcggcgggttgggcgacgaggcggcggcgctacggagcactagagaccacgggagagggggcaaacgaaagagggcgacgaggtggtcctatttatagccttggattgaagagatcggactcctcccgcaagaaatcgatccgagaaaatcaaaactcggttttggagataaactcgaaaacgagtttgattcggataaaatacccaacgatttgctccgattcttgaggggaaagatagaggaggatgtggggataaaaacccctcaaaaatccagaagaaacggggccggattggagcggatttgagaggagaagggggcggctcgggctcgactaggccggccggccggaggttgaagaagcaaccgacatgtgggtcccacatgtcggtgacccgaggaggagggggtgggcggcgtcggctgggccggcttgggccggttcggccgcgcgaggaagagaagagttgggccgaaatcggcccaacgacttaggggaggatttaaaaacttttccaattaaaataatttgtgaaatgatgtttcatttattaaaaatacttcccttgctcaaacaattcccataaaattctagaaaatagaggaacaagcaaagtatttaataaaattttatctagctcatttttatattgagatttaacaaattaaaattagatcttctcttttaagcttttaaaatcatttctaataattccttttaaacaacaatttataatttaaggattttaaacaagaaaagcacttaacaattataattagaccatttaatgattaatttaatatgtgggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcacttgtaaactaatgaacatttaatataaattctattaataatttattaaataatttataaatcctaagacgaaaatcagggtgtgacactgccttggtgtacaagatgtcgtacgtgagggagagctccatgtccaccacatcgtacagcatctcattctcattccaggtttcagggcgaacaatctcttgtttgtcgacatcatgctcgtgcaccaaattgtcgatgaaggcgccctgatttttatcttacaccaattatttctatatattcgtggagcttaactttacctataagctattattatgaagatgctattaaaggatttgtaaatttatatttgcttaatatttggtgagaggtggtgttgttagacttgatccttatgtcttcatgaatacttcctaaaggtatttggaagtttgtatgtgtttaggtttgtgtccaactgggtaaagcttaaggtagaattgagttaatatgttttacttatcttttatattcatgagacctattatggaatgcattcaaaatccaaaaacacacaaaggactcatggcacatcagtacattatgcaaatgcaagcactcacgaagttttagctttatcagtaggttggtaaggaaaaggttttaaattattcacaaatttatttatgaaaactagtcataaatttggaaacacatttttattattttaacgaaatcaaaatttgaaaatcgaaatttgggtatgttacaatttctctcatagcaacatactcaccatacaaccaattacttccatgtcctggatagagactcccattttagtgcagtttatctcatgaaatattttcatatttaaaagcctaccaccggatcttccatgggtagctatatcctaacatctgaagcaattatattgccatatgttttagttcattttgtgctaatgttatatatgtgtgtgatggagtcaataaaatattaactttaagaataacacagaaaaaataatatatgctatggattgattgatattttgtgtttgcaggtaaggcatgtaaataggccctgtttgtgcatttgacaaaaaaaattctgggttgtgtgccccatcaagatcttattattctctttcaaaattgtcaatgtatcagtagacaaaccagcagatgtttaggtgttcggttataatctaaatgcctgtaatgcttattttggattgtaacattttttacagcatgtatattgtacattaaatctactgtaatatattgaacagaatttgtatgtgttgcatgtcatgagctcatttcgattctatccatgtccacacgcagcgtagcgcgtgtctcttgctagttagtactgatccataacggctagaatcactacacgatggtctaatttaccaaccgacttttgttggcaaaaggtcagtttagacaacacatcaactgtaggcaaatatgtataacaacgccaacgcactatgtgtcacaccccaatctggtaccgccgaacaacggcacctgactggagcgtgtcgtaggaaaaactgcgcgaaccgcttcctatgagaccgcgatatcggtaccagtccaggatatagcgcttatatccacggggacaataataaatcattgcaatccttaaattaaatagatgacttatttaccttaacttgagttgcaactctcgggaaactgacaatgcaatagatgacacgaaagcagcaatagcagaagcagaggcaactgagaccaacaaactaatacccaacaccacaggcaacagcaaggaaccaggatgaaaccctaatcttcacttcacttgaacttcaccttcggagcaggcaaaactatatatagagatcaagggtgagtacttacgtattcagcaagccaggggaacttaggtggttaatgcaagtttcaagggaaggctgctattttgcaatcggttttttaatacccaaaaaattcgaccaataaaagaaattctaaaaatgcggaccttcgaaaactttataaataaattgcatcatgccgattttgttcgatgattttattagattttgatctcggagttcatagaggaaaaattaattaggaattaaccctgaaattagcttggttaaagaaataaataaattataatttaaaataaagattaggtgtggattgaaataaataaaatattaccacgaccatatttgtatcaattaaatttaaatgcgatggaataagaattaaccctaattaaaaattcaaataaattatataaataaaatatgggtaatattagtctagggtgaattcattagttaagataacacaaatattgagtaaaatccatatatgcaaaaactaggaattgtggaatcaaatttataaaagaaatagactaaaatgagaaaaataggaaaatgcactgttcattgcactctaggtggtcgacgtggtccccctaacccagccccctcctctgccgtcgtcatcaccgtcgccgtcgcgccgcgcaccatcgtgttgccgcgcatctcgttccctagccctagcccctcctctaccaagctacctcgcgccccgtgcgccgcgcgccgctccgcctcccctctgccgtcgccgacgcgtcttgccgccactgtgacaaatgcttagaaatgctattctagaatcatgcatactcatatttatcaaatgctatatgcttgggcaattgcctttgggaaggtaattgagatgcggcatgtggagacatgagcaccacattgccatgatattgatgacatgatttgcgaaaggagaaataaaactaaacaactgttttcgactggggcggacggaggatttgggtggtatatggaaaaggctagtaccgtccccggtcaattaaggaccgagccatgaagttaagcatgaaacgacccccgtacaaccgcacttctcgtatgggtatagacctagtggattagatagccgagcggaggcagtatctctgcatagatggttcacccctgagtgaggcaggtgcgctacggtgggacagccgttgaggtagggccgagaggcgtgccctacatcggtgtcgccattgttaggactgccatgagtgtgtgtgagagagaacttaacttgaaccataatttaatatgtgtgtgagacttctctttcccgggagagccagaactcctctcactgctagaaacatggacgcctagagtgcatgaggatttaggttcatggagcgggtactgccattgcaaggttatcgaaaagctttgccgtgacgagtctcatgtgttgggacgaggctcatgtgttgggcagtcgtggagtgtgggtaaagtgtacatccactgcagtgtgaatatcctcttagcattaccggtaagccgagcaagcgtgatcagcgcttctcaaggatcatgaataaagatccaaattgcactcccatggctacgcatggttcttgaataatgtaaacagaacatccggaataatgaaacatgaataacgtcatgagtttgaatatgggtcgaaacacgaataagtagcataacgtcatagccatacaatcagtaataacaagcaattgaataataattatgcaagtaaagccaaacaaaacaactcagttttgtccatcacataagttcgtcttgtacttgccttaactcattcgatactccgactcaactcctccaacgttggaaccctccacacctgtggagcaaaactacacataaaccactatattcaactaacgatggttacaggggatatttactaaaatcgaaacctataacatataaaccttttaccgatttgtattaaataacctatagctgttccattactgttttatgagtaactcacaaaccgtctaacggaaactagcaaataatacaacttcggacatctagacaaaattgtctacaactttcatgctgagcacaaaaacagataaagcctctgaaaat

SEQ ID NO: 60458 - DNA, 2810 bp, Oryza sativa
aaaaaccggaaacagatcgtcttaaatataaattagaaacaactatagactaaaacggattacctagcagtactaatgtataaggaaaacgaagaatttggaaatattcaccaaattccccaaatttcccttctatcaaatttccccttctttccttccttcctgttcttctctgccttctctccctccttcctgttcgttgcaggccaacagcagcagcagcagaaacgaatatcggcagcaacagcaagccgtgcaccaccagcaaggaagagatcagatcggcaacagcagggttcggcagcagcagggaaattaacagaaacaacagtagctcacccacgaaccggctgcggacgacgacggctgtggcgaccggcgacggctgcaccagcggcggcgccggcgaagagaggaacagcagcggtggcggcagagcgcaggaggtgcggcggctagggctacaggagaatcgctcctgtttcttttttttttcgtttgttttttttttggtttgttatataaagagactaaataagatctaacggctcacatctattcaatcctcgggacttcgttcggactccgattactataaatttatagtctattttgcactactcggcgagctctaggcatccacggttcccgatcgcctatacgaacaatggtttaaaagttgaacttttacgcgtttgctctaatattccgcaagatatattaatttaaaactcggggtattacattcttccccccttcgatcgaattcgccctcaaattcgcccaatcatactctagaacacgggatattacattcctccgtccttcaatcgaattcgccctcgaattcgtccagttatacctcggacaagtatagaaaggaactcataggtaggacttatataactcaccagacgtgaataactctggatacttctcccgcatctgtgactcaagttcccatgtggcctctcgctcggtctggtgcgtccagagaaccttgacatacttgatagttctatgcctgagcaccctctcagattcctctaatattcttacaggatgagactcaaatgtcaaatcttgctcaatggtcatcggctctacggcaacatgatgttcagggtctctcaaatattttctcaacatggaaatatggaatacatcatgtacacctttcatggactctggtaactcaaggcgatacgctaggattccaactctttccactatcgagaatggaccaatatacttagggctgagtttgcctttcgttccaaatctcacaacacctttggttggagatacctttagaagtacttgatcgcccacttcaaactctaattctcgtcttctgacatcggcgtagctcttctgcctactttgagctgcaagcatgtgttgtcgtatttctactatccgttctgtggtctgttgtacccaatcgggtcctaaaatagttctctcccctatggaatcccaacacaatggggatcgacactttcttccataaagtgcctcatatggtgccatttgaatgctagcatggaaactattgttgtaagcaaattctacaagcggcaaatgatcctcccaactgcctttccatgaaaggatacatgatctcaacatatcctctaaagtttgaatagtccgctcagattgaccatcagtctgagggtgaaaagccgtactgaatttcaattgagtatcaaatgcctcttgcacagattcccagaacttagaagaaaacttagcatccctatcataaacaatcgagcgaggcacaccatgtaacctcactacctcgcgtgtatagatcggtgccaagtcactcgcagaataagtggtgcggataggaatgaaatgtgccaccttactcagacgatctacaaccacccagatggcgtcctttgctcatggagttcgaggtagcccaactacgaaatccatagcaatatcatcccaagtccatacaggaacttccaatgattgcaactttccagcaggactcttatgttcagcctttactcgctgacataccccacatgacgccacgtacttggccacatccactttcatcctcttccaccaatagatcttcttcagatcatgatacatcttgttctccccaggatgcacagtatatggtgttcggtgtgcttctcgcaaaatctcttccttgactttagctttttgtggaacacataaacgcccatggaatcgcacagctcccgaggaatccaaagtgaaatctccagtttttccttactttacacgtttcttaacttgttgcagcaaccgatcgtgttgttgggcctctagcactcgttggggtatggcggactcaagaatgactcgtgactcggtacttgccactccaacataacaataggagatatccatccgttcaaaatcagttatcaaacaacccatagttggaggaacgaccttatggcttagagcatctgcaaccacattcgccttacccggtgtgtattgaatgttaagatcatagtctttaatcaactctagccacctcctctgccttaagttcaaatccttctgagtgaagatatatttcagactcttatgatcagtgaaaatatcacaagattctccatacaggtagtgcctccaaattttgagagcaaagaccactgctgcaagctcaagatcatgagtggggtaattctgctcatgcttctttaactgcctagatgcataagctataacattgccctcttgcataagaacacaaccaaggcctactcgtgaagcatcggaatagacagtgaaacgtttaccag

SEQ ID NO: 60459 - DNA, 11733 bp, Oryza sativa
taccccgccatacccaaaaactcctcacatccttaacattagtcggcctttcccatccgacaacagttaaaactttgcttggatcaatcgagataccttgctgattaattacatgccctaggaaagccacttcaggaagccagaactcacacttcttcagtttagcatagaacttgttttctcgtagggtccctagtaccatcctcagatcacgctcatgctcctctacatctttggagtaaatcagaatatcatcaataaacaccaccacgaaattatctagaaaactatgcaacatgctattcatcgcctccataaaataggccggagcattggtcagcccaaaggacattactctatactcataatgcccatacctcgtggaaaatgcagtcttctcaatatcctcttctcgcactcgaatttggttataaccagattgcaagtcaattttagagaacaccttcgctccctttaactgatcaaacaaatcttcaatacgaggcaatgggtacttgttcttgattgtcgcagcatttaaggcccgatagtccacacacatacgccaactttcatccttcttctcagtaaaaataacaggtgcgccccatggcgacacactccatcggattaacttcttagataatagatcatctaattgtttcttcaactcttcttggaaaggacgagctaaccggtacggggctttggagataggttgtgtaccaggaacaagatcaatacggaactctacatcacgctcaggtggcatccctggcaattctgcgggaaaaacatcaggataatctcgcactacaggaacatcttcaatcactaaaggcttggatgacttctcggctaaggcccataataaccccgtctttacagcacgctgcccaggaaataaccttgacatcacgaaaagagaatgcggaggcgcgctcccttggaaaaccatatcctcgcctgatggagcttccaaggtaatagtcttccagaaacaagagattacagcacgatatcggttcaaccaatccatgcccaagatcacatcaaagagcggtaagggaatcacaattagatttgccacaaattcctccccatcaatagagattgcacaacctagacatactactgaactagagattataccccctagagagctgacttggacagatcgagagacctcttgactaaatagattagctctttttgcaaactcgattgaaacaaaagaaaatgtagcaccagaatcaaacagaactagggcatcatgcgaatcaacttaaagtgtacctgtaacgacatccgggcgaccaagggatgaagctgcaggcatgttgtagactccagccatagctggggtagtagaggctgagacctgctggtgaggtggagctgaagcagaaggatgcgccataggcggtgcaggcaactggagtggagcacgtggagcaaaagattgaggcatgggccaatactgtcctggtaatggtggtggtgggtaattatgtgtgaactgctggtaaggaagtggataagttgtcatcatctgaacggcaccacggggagtactagtggatgaacctgaacctcgaggatagctagctgtcgaagaggttgctgaataggagctcggcttttgccacttgatgatagaatttgggttacgcttacataccaactccatgtgtccagctttgccacacccacgacatgccctagtaaacccacactctgctgaatggtgattctttccacacttaaagcaaattagcccttgccctggaacagggcgaatcaactgagactccgttggacgtgaagctgcattaggctgagaaccccactgcctaggtttagatgatggttgagtgacctgattttgtttgtacttcttgaaaggtggtcgctgtgagttctcacccccttcctaatgagctctcttctgctcattaccagtgacattgccagaacgattcttctgcgcagtagtaatttggagctcaacctccatccctcgagcctcctcaactgcattgaggtatatagtaggcgggtttcttcccatcacttctctataccgagcattgagccctcgaaagaacttcctagccttctcacgctcatcacttgccacgctaggcacaaagcgtacaatactgctgaactcccgttcatactcatcaacagtcttgcttccctgttggatattgtttaactcatcactcatcttgtccctaaatgattctggataatacttagctctgaactgctgaagaaaaacttcccaagtaatagcaccacgatcagggttccacgcttcaacaactccatcccaccaaatgtccgcctaaccagtcaactgaaaaggcatgaaagtaaccttctcctcaggagtcattctagatcccctcatatacttctccatcttgcataaccagtctgcagcattaacgggagtaccagacccatcaaatgtgtctaagcgcatggatgtccatctagtgagtgtcatcccccgagcagctcgaggagcatcatcagagacagcagctgagtggctaccaccctccacctcttccatgtgctcatcctccatctggttcgaggatgctgcctcattatggagacctctaccacgacctcttccacggcctccagcacggcccctaccacgacctccacgattaggaataggggattcagcaaccgagttgttcccaacctctttattatcctgagtattttcaacttcttcattatggtggcccctaccacgacctctacctccgcctctcccgcgccctctgttagccaaccgaacactcactctaggcggcatacctatatcaaacacaagcatttacacgtcattagtttaacaataggttagacaatggcatgcaaggaaacacaatcatacacatatatatgcagcagaaacataaatgctaggaatgacccatgctcccattcctattgtgcaccagtgtgtcaagtttttttagatgtttatatataacccaagttctactcttattatttcctaccctaagagaaaatatatttttttaattggttaggaactctagttcaaaattttatgttgatttatatatctcattacccagtcacttcccatggacctaccgcccgctctgataccaactgtaacaccccaggtaaccacgtacctagaatgccacaccaaattacactcaaaaactaagtcctaaaattattagaaatttcggcagagtctcccctaaaaatacggacatcacgacaggcagttataagaaaggtcaataccgatataaaccacacaatccaaaccattctagctccacaaatcccacgtgaaaaataaggatcagaaccataaatgacctttacaagttctatgcaaaacttatgctgagcaaaaattatagtctaaaactaatttcaattgtgcgcaataataatgtgtagtccaagggtgctactcccgccccgtgccgatcgatgtcattaggtacctaaaaaccaaattaaacacaagagtgagtaaagaatactcagcaagtacaatcttgaactagtaaaacatacgcatgatttatgcattaagaaaccaacatgaagggttggatttactttatttttaaaccaaagaagtcaaaagatagtagttccctcccgggcaggtgtgaatatcctcttagcattaccggtaagccgagcaagcgtgatcagcgcttctcaaggatcatgaataaagatctaaattgcactcccatggctacgcatggttcttgaataatgtaaacagaacatccggaataatgaaacatgaataacgtcatgactttgaatatgggtcgaaacacgaataagtagcataacgtcatagccatacaatcagtaataacaagcaattgaataataattatgcaagtaaagccaaacaaaacaactcagttttgtccatcacataagtccgtcttgtacttgccttaactcattcgatactccgactcaactcctccaacgttggaaccctccacacctgtggagcaaaactacgcataaaccactatattcaactaacgatggttacaagggatatttactaaaatcaaaacctagaacatataaaccttttaccgatttgtattaaataacctatagctgttccattactgttttatgagtaactcacaaaccgtctaacggaaactagcaaataatacaacttcggacatctagacaaaattgtctacaactttcatgttgagcacaaaaacagattatgcctctgaaaatcccagattaaggaaaaatgaactgctgtcctgatttcaggacccggtcagcagtactgtttttgctgtttctcctaaaccgtttaccggaatcgagtgaaactagcaccgttggaaagatattgacaatgactacaaactttatttaggacaactaacctgattcctgatggtttaataccaaatttgaaaatacggtttctgcctagcgttcgatataaaataaattcgaaaaaaccggaaacagatcgtcttaaatataaattagaaacaactatagactaaaacggattacctagcagtactaatgtataaggaaaatgaagaatttggaaatattcaccaaattccccaaatttcccttcttctatcaaatttccccttctttccttccttcctgttcttctctgccttctctccctccttcctgttcgttgcaggccaacagcagcagcagcagaaacgaatatcggcagcaacagcaagccgtgcaccaccagcaaggaagagatcagatcggcaacagcagggttcggcagcagcagggaaattaacagaaacaacagtagctcaccaacgaccggctgcggacgacgacagctgtggcgaccggcgacggctgcaccagcggcggcgcaggcgaagagaggaacagcagcggcggcggcaaagcgcaggaggtgcggcggctagggctacaggagaatcgctcctgtttctttttttttcgtttgtttttttttggttggttatataaagagactaaataagatctaacggctcacatctattcaatcctcgggacttcgttcggactccgatgactataaatttatagtctatattgcactactcggcgagctctacgcatccacggttcccgatcgcttatacgaacaatggtttaaaagttgaacttttgcgcgtttgctctaatatttcgcgagatatattaatttaaaactcggggtattacattcttccccccttcgattgaattcgccctatcatgctctagaacacgggatattacagctatcaacccctcaacggagtattcctatctcttgtgtttgagtgcagtaccgaaacctctccaagatggaggtagtttcgcaataatgcacccggccacaaatttgtcgggtaagacacacttaaggagttcgagttccttagtcatggtttgtatttcatgagcctgttcgactacagaacggttgtcagccatattgtagtcatgaaactgctccatgatatacagatcattgctagcatcagtagcaccgaatttagtattttgtgcatcccatgactccttagcgtcggtcatatgcatatacacctcgaccagacgatcgccaagcatgctaagaatgcatcccacaaagagagtagtggcctcatcgaattctttctgctgatcagcattaagaacgcccataggcttgtcagtactcacccagaagcatttcatagctgtcagccacagagtgaccttgatctgccatctcttaaagtgcacaccggtaaatttatccggccccagtgcatcggcaaaaccagccatagtaaaatcgcagcgcctataataagcagtaaaacatgaacagatcaaatatgcgcaacatgtcgaacacgtaccgaggtggcggaaagaccggttgctcggcaggaactactcgcggttgcgagcgtcgacgaaggcgcgcagcatgcgagcggagaggaaggcgagccgtcgcggacgaacagggagcagttgcgcgaagcgcttcccaaaaaccttattgccgccttctcccggtgcaggatgtcgaaggcagaggttccggagacctgctctcccgatcgccggtgcatactggcgagcgggatggagtagtctacgagcgacggtgcaacacagaggaggaggcaaaccctagattgatttcgcatgtgttgcgtgaaggcggcggctcggtttatatagagataggtcgcttgatcagggcgcccgcacgatctccacttcgcgtaaccgaaccggataaatcgcgcgtaacttatccggactccacgccgttttcacgcaccggatttttcggaatgtttcctacggtttatatagagataggtcgcttgatcagggcgcccgcacgatctccacttcgcgtaaccgaaccggataaatcgcgcgtaacttatccggactccacgccgttttcacgcaccggatttttcggaatgtttcctacaacttatccggactccaggccaggcgaggcgagcgagcgcgcgcgtgtgttccccctcttctctccaccacacatgcttcaagtggctaggagggcatcctcccttttaaggaggtccctctctcctagaataagtaaggtggtactaaactccacatgcatgccatcccatgaggtgggcttttgtgattttccaaagaattaatcttcgagtgggctaaggcccgtccattaattccaacacatcatggggacgatgcggaggatgagagtttgggactgcattctgatggagatgattatcatcgctgtcctcaacaacctctctgccaaggtccagcttctatggataaggtttgttatgttcaccttgacaaccggaatcatcatgttgctcgtgttccattagataaagggctttgtaagatgaaaatctccaggtcttctttctcaggttctcgtgattctaaggattgtctgcaatgggagatgtgttgtgataagatctttaatagtcacaactttcggaggatgagcaggtacgtgatgcacccattgaattcatatattatgctttgtcttggtggaatccattagtatgtgttggtcgtccacatacttggcaatatataaaagaggttatggcttgccattttgttcctgaacattgtactatatcattgtattcacgcttgtagcaactcaaacaaggtgattttagagtggatgcttattataaggagatggaagttaatgagccgtgttttggtaacagagaatgatgaagctattatttattgatggtctcaatgatgatgtgagagatcatgttgagatatcatattatcatataaagagtacgatgcaagcagcaactaaaaagttgtcacactagccattcccgttattttcagtgagacagtgatggatgtgttggtggtaagtcggtctatttcaagctgactactccatctagggatgtatctaaacctgctgctatttcgatgagtaaatccacatctaaaattgaatctactactgcatttggttctaaatcgcgatgtgtgaagtgttatgcttgtgggagaacaggacactatatgagaggttgtcctaatctgaaaagggtgttgatgacttcagaaggttatatttttgagagtatattagaaaattcagaaaagggaatagcttgatcatactctaactacagtatattgatatattgatgatttatcaacggatgatggtattgaacagaagaatggtttatctatggttgcacgtgcaatacaatgagatagctcttacattgatgcaaagggcaacactgcaatatttttcagtcagagtgcaaaattcagcagaagatatgtaaattaataattgatggtggtagttttactaatgctatcagtttagatttagtgcataatttctctttgtctacgtggaggcttccaatgccgcgttataatcaatgtacgaatcaagagggcacacttaaacttactcataagttaagaactacattttctatcggaaactatgttgattaagtagaggaagaccgtgcagtttgatcataatgcagcactcgagggccgaagtaatcactattcttctatgcatcgttgtgttaaacatctgccgaaaccgttacatgatagttctatcaagttagtagtatttcctatcgtaaagaagaagaacttcttttgaaaagaagaagaaagaactatctcaaattaatctaaagccaaggatggatttgttccaagggagggaggataacgtgagcaagaaaaaactaatatgtttcgttggtgttttacccgtcgtcgtgcatcaaagcatggaacatggtcaaacttcgagaactgtggaacagaacccagtaaaaagcaaaccatgtaggctactaagtatatatgtgtcggttaatttattcttgttgagttagcttagcctggtttcgagttaactagccaagggtcattagtaaggttattagcgactagattatcaaagtaattagtatattttatttttttatttgttgagtccgaaaaagacttcatctgagcctgcctgatccctttattagggttgattgactgtgtaacagaagggttcttttggtgtcattctgttgagagttctccaggaaagctgatggtgatcccatatacgaattgagattattgccgttgccgtgaaggtgcgagaagaagctatatttccttgatcttgttacttggtaaatgttagtgccctctcttctgatcatgttagaaagcacgggtagaagattattttatctaggatttgatgttcaactattgtaagcgtagctctcgattatttgatttgtttgctgctgaattctatttatatagacaagtctgatttaattcgttgagttaatgatttcacgctgcctgacaattttaaaaagttaacttgtttatttgttattggtaccacggaagagggacatattcgggtactcgctgtcggtgctcatcatctatgttctttgcaactgtaaacaaatatgggcatgcatagaatctagtaggtaaagaagtcgtatatataaaaagtgctagaccaataaggtgagtatactgatagttggattaacccagttagaaggaaaagaatgtgtgttgctaatttattgacattggtccccatgctggtggttataaaatttttggccatcccctttgttaatgggtatgttcaatcttctaatacaatgcatgcacctagggatttgaattatatcttatgcttgatcatctacgaagaggctcttgcaaacattgaacaggtaatgaatgcccaacagaacattccctagatctgcgtgcagcttctcttttctgtcctgctcaagataacgatggcgagcacttgagcgctcaaacatgaggacgatggcctcgaccaaggtagagaacacaagcagcaccctgaacttgcataatgaaagttagcaggtggcacaaccagagcctattgtcctcctaggaataatctgtggtgttgtctgggccacccaggtgaagcaataggaatgttgtccaggatgcaatcagctggtgctcacctgagctgctgctcgtggtgatggatagccggccaagcatgcagattgcagtggagcagcagatacatagcaaagccagaggaggatccttcgcagtgtgtaacctttgcgccgacggatccatgacaagcggaggacgataacttgtagagcacagcctaggatgactagtatttggatatgccactctttccaaagctagctagctctgcagccatcgcacctcggcttaactgcaaacaacatcacattaatgaaatactgaatctagaaccggccagccttgcatcattagctaaaatgctcgtttttttttgtggagctaaaacacttgttgttccctgaaaggaaagaggaacattctagtagcaattttttttaaatcaaatcaaaataaagttttgtgagctctgagcgatgtttgaaaagagaatccaagcgctaaagataaatatttccttaaaatttgaaaactttgtcaatccataatttattaaaaattttctattaataaataaaaaggatagaatctaagttgaaaaatactgtcataatgttataagtttgttataatacaaatttaactatcaaagatttaaaagctaaatattttttggctggatatataaagtactccctccatttttatattgtaagatgtttttgttatgtcctaaatcatacttagggtaattgactaagtatatagtaaaatacaataacatctaaaccattaaattaggttaattaaaatccataattgaatatgttttgataatatatttattgggtattatagaggtcatccttatgtataatatatttttctcaaaatttcagttaagttcagagttgacttaaaacatactgtaactaccttatcgtgttatcaatatatttttagaaggtgtcgctctaaagtgttactaaatgacaacatatgtccaacgaaatatatatacagcagcttgcacgagagctggtaaagtggaaaccacacacccagtggcgcgccttcgggcgatcggcttgctaaagaacaccactggtctgctaccttcctggagcacagggcccatgtatgttctcgaagtcgctctcgacgatgaagtccatgttgaagtctggtagttgaagcactagggtggtcatttgggctagctgtagtgcatggaacgcagttccgccgcctcttcctagctgaagacctccttgcggagtagtgttgtgagttgcgtggcgatggagccaaagttgcggatgaagtgacggtagtagcctacaagccctaggaagccacgcaccgcccacgccatcttggggattagccaatcctagaaggcctggattttctggtggtccatcggcacacggagcttgagatgacatggccaaggcaggcaatggtggtgaggccgattttgcacttggagcgtgcgaggtgggaatgacgatcctgcagggtttggaccatgtcgagttgtagattaggatgtcataaaaaaccaacatgaaccgtcgaaggaacagaaggagtatgttgttcatgagcgtctggatggtggcagaggcattggtgcggctgaacgccatgaccaagaactcgaagagacccagatgcatgcaaaacatcattttgtggacattgtcggggtgcacgaccacctggtggtagccgaagcgcatgcatgttgagcttggtgaagaattttgtgctgcgcagttcatcgaaaagttcttgcgccatcgggatcaggaacttgtccttgatcatcttgtcgttcggcatgtggtagtcgacgcgaaatcaccatgaactatcacacttcttgatcatcatggccagcaaagagaactccgacgcacttggacggatcacaccttggaggagcatctcgttgcattgacgctccaaatcgtccttttggatgtgggtgtactggtacgggtgcacgacgacggcgaactccatgtgctctaggcggatgctgtggcacatgtgttgttctgatgttaggccttgtggttaggcaaagatgttgatgaagtcattgagtagtttgtt

SEQ ID NO: 60460 - DNA, 15481 bp, Oryza sativa
  unsure (1)..(15481): unsure at all n locations
gtggcccgtgagtgccctccctacgcagnacntcatcagctgtcatgcatcagcaatatgagccgatcatgcgttaacccaaacacttgggtaatatttcttcgaatatttgccattgagcgctcgcccataaacttcgccatcaagcccttgcaacatatatgctcccttagacacaactttatcaatttggaacggtccttcccagttcggcgaccacttgccgaatttactatcacgagtaccaatcggcaaaatcagcttccacacaagttctccttccgaaaaatctttgggtaccactttcttattataatgtcgagcaacacgttccttatccttggtaaccttcgcaagggcttgcaatcgtgactgaaccagatcctccctctcatcggccataaggttgtaatactcatcggttgttaaatcattttgtaattccgttcgtctagagccgattctaacctcccatggcaaaacagcctcatgcccataaacaagtttgtaaggaggaacttaaattgatccatgacaagccatcctataagaccataacgcttcggccaaccgagtatgccattgctgaggataatcagaaatctttcgcttaatcaatttgatcaaacttttattagacgcctcggcttgcccattagcttgtgcataataaggtgaagaattcaacaatttgatacccacactatcggcaaactgaacaaactcatcagacacgaagatggaaccctgatccgtaataatagtttgaggaagaccaaatcggtagattatatgctcctgaacaaattgaatggcatccccagaatcaactttcttcaatggaatcgcctctacccacttggtaaaataatcagttgccaccaatataaatttatgtcctttactcgatggtgggtttatcataccaatgatgtcagttccccaacccctgaacggccatggtttaataataggattcatagccgacgacggtgctcgctgaattgctacaaacctctgacaatcttgaacaccccttataataaccgaaacaatccctccagcattgtcggccaaaagtaccctacacgccgaagcaaccacttcatcttgtgagccgattgatgagtaccacagatcccttcatgaacttcgccgattgcaaccttagcctgatcggcacccaagcacttaagtaatactccatcaatcgtccgataataaagctcgtcatccaacagtgtatactttaatgccttatatcttaatttcctagaagccgattgagatggactactcaaatactgatgcacatcgtacctccaatcatcgactgacatcgctgcaatttcaactttaacatctttgatcattggcttataccccgacgccccttgagctaaatcattagcttcaatattttgttctcgagatacatgctttaaagtaaccagccgaaactctttcattagttcctggcacttctcattataaaccatcaatgtatcgttcttgcattcatattctcccgccaattgactgattactagcaaagaatcccccatgatttcaatggtatcggcttcaacttccttgagtaattgcaaccccttgagcactgcttcatactcagcctgattattggtcgcatatggttcaatagtataagcaaactcgaaacatgcccccctaggggaaattataactaagccgatgccacaaccatgagtacataccgacccatcaaagaataaagtccacggcactatctcaactgagccgattgaatcatcacgatgctctacaataaaatcggctatagcttgtcccttaatctctttcggcgattcataccgaagatcaaactcggtcaaggagaatatccactttccaactcttccctttaatattggagccgatagcatatacctgactacgtcggctttgcatataacagtgcactcgttagataatagataatgcctcaacctcatacacgaaaaatatagacacaagcataactttttcataggagaataccgagtctcagcatccaagagccggtgactgagataaaatacaactcgttccttcccttccaactcttgaatcaaaaccgaggcgattgacttcttgccagccgataaatataacctaaacggtattcctttctgtggaggaatcaaaacaggaggagagctgagatactccttaatatcatccaaagctttttgctgctctgccccccaagtaaattgctgatcggcttttaaccttaataaaggtgtaaaaggttccaaccttccggacaaattagaaataaaccttctaacaaaatttatcttgccgatcatctcttgtagctctgtcttattttccgggggctgaatcttcttgatcgcattaacgctcctttgggttacctcaatccccctttcatgaacaagaaatcccaaaaactggccggccgacacaccaaaagcacattttgtcggattcatcttcaagccatattttctggttctctcgaaaactttccttaaatcggctatgtggtcctccacttctttagatttgacaaccacatcgtcaatataaacttcaaccaaccagccgattaaatcatgatatatataattcatggccctttgatatgttgctccagcactcttcaagccgaaagtcatgacgacccattcaaataagccggttgcaccagggcatctaaaagctgtcttatggatatcctccttagccataaagatctgattatatcctgcgttcccatccataaaactcaaaattttcttccctgatgcagcatcaaccagctgatcggctactggcattggatattcgtcctttggtgtagctttattcagatatcgaaaatcaatgcacaccctgaccttgccattctttttaataactggaactatgctagaaacccattcggcatatcggcagggacgaataaaaccagcatcatacaatcgtttgatctcagctttaacaggttcgagcatatcggctttacatctccttggaggttgctggcgtggtctaactcctggcttgataggtagccgatgttcaacaatcgatcggctgagtccgggcatctcataatactcccaagcaaagcaatctctaaactctttcaggagctctatcagcttggttctaaattctggagacaaatttttgctaataaatgtcggccttggccgatcgcctggacgtatgtctatttcttccaactcatcggccgacatgaaaccttgaccttgcttgtcatcgagatcatctactgtatccttggcgtagacatttgaaccctccacgacgccctcaaagtaatagcttgggttctccatcttcgattggctgtatatcagaatcggacacttttagaaaatctccatcccaaacttttctagataaacaatcaaggccatccatctcccaaaaggctaaatcggcactggcaacattaactgacctgtcggctggcacgatctctatcttgtcgccttgccattgaatcaagcattgatgcatagttgaagggatgcaacaattggcgtgaatccaatcccttccaagcaacaagctgtactgtcacaccccgaagttctttcccaagcctaaattgaagttataaatggtctcaagaaaatacctgtgtaaagcaagagtaaaccttaataaattaatgcaaataataatcggaattggcatatggaatttttcttgagttctacatgccgaaatacgctaacaagatttttagtggaattttcagagctctagaaataatttttaacgaattaaaattgagcacatgcaattttaatcccaggaaaaatcttttttccttctttttcctttttctttcttttcttttctcttttttctttgaatgggccgccggcccattcctctttttcttcccctcctcccgctgggtcggccgaatgtcgaggcccagctaagccgcgcgagccggccacccaccttctttctccccgggacgccgacaggtgggccccacctgtcggggtcgtccccttcctctggccacccgcccccacgtcgacgcgcccgcaaccgccgccgtgcctcgcgcccgcgcttcctgggccacgtcgttcacgtcggcctcgctctcgtgcctcccgcgcccactttcccctctctcccgctcgcgcccgcgcccgagacggccgggattctattttcgaatcccgcctctctcttctcttccactcccccacgtaggccggcgattccccgctctcccggtcacgttcggacccctctctatctatttaagctccgccgacacccccctctttctttttccccatttcgacgaactctcccgaggtctccatcgctcccgcgccgtgcacccatccgcggccgccgctcccgctactccggccgccgctagccgccgctagactcgccgccgcgccgcgtcgtcaccgtcgtcgggttctcaaggtcaagggccaccccgtccgcacctcctccatcgaggtccgtcgccggagctcgcatcccctcgcactccggtgagcaccacctctaccgccgccttcggccatggtttccgctcgccgtggtccacccctctccctctaatctctctcttttcctctcttagggcatcccggagctcgtccgcccgccgccgttgtcctcccatggctcaccgtcgccgttcgccgtcgtcctcctcctcgccggccactctagatgaggcatccctcctcctctattcccctccctctccttcctagccgcgccgggtcgagccgccgccccggtcgtgcgccgccgcctttgcgccgttggttgccgtcgccggcaacacacgcgtgcgcaccgccgcccttgccatggccggccggccggctttgtgctgagctgagccgagccaggccgccgccgcaccgtccgattggctctgggccgatctgggccgtcggtcccgtggatcggtggtggaccacccgcgtggtcccggtgcacggtagaccggccacccgtgcgccgctgacatgcaggccccgcctgtcggcgccgccccccccccccccccgtttgatgacgtcagccctaggatttattgcgcaataaatgatttaaggactttttgttatagtaataaacacaatgaatcttctaaaattcataactaattcatccgagctccgtttaagcccattcaagtctcagtaaatcaagaaaaatgtgtagaatccattaaaaatggttttgttctctgtttcagtagtcttatagcctgtttgtattgtttgctttgtatgtctcttagattctggttcttccgacgctccggtgtacttcgaaatagtcgccgaggttcctccagcagcagagcaaggcaagtcatgcttgtcacttgaacatgttgatcctatattgcaaatgctctattgtttttcttcaaatactggattgttttataatgttactatgggatgtttacctactatcatagccgtactattttgtaccatgttcctttgttagcttgggatataacatgactagagattggactagagattgcttagccatgcttagttcaactagcacacaataagggagatcctattaattgtttagactgtaggttctaatggtattgttggattagtgacaccgcttcggtgttggttaattaaaataaatcacatggtgggctgtgggtgcatggttttgctggtcgcacccatggcagttaaggaccggttcacgggatgccctggaagaacttatcgtacttaccacaagccagcgtgggcaacggctgggcttgtagtgtagctttcctctagctgacgcatccaggcaagggtaggcgtaatggagcggggcgggcccagcgacggtctctatcgcttccggattcacctaggcacgagaggggaatgcccgctaccttgcgaggagtgggggtgaaacctgaggtgtggtgtgcttggttggagggggttatgcgaagggtcctgtcacggcctctttccggtatgtcgtgatggcatgtcggcgcacggtaacatatagtggggctgtgtcttgtgggtacagttgtacacctctgatcagagtaaaactattcgaatagccgtgcccgcggttatgggtggtcaaccagattcaccgtgattagtttcaccctagtttagtctaatgaaattggatagtttaggtggatggttgggcctgttgcaacgtggagtagcgttggacagtggatgattaatattgattagttaatacaactgtttacttctttcaacttctgtttataaatgctcgctttatgcaaatgaaccactctagctctcctttgataattccctgcatcatacccctattccggtatgacttgctgagtacagtgggtagtactcagtcttgctctattttccccaaccccaaagtatgagtatgtgtccgatggtggtttctccgaggagtaggcttcgtccgtgccgtcgaggatgcctgtggagtggtgttcccgctgcagttcaagtcaaggcttagctcctgttatctctcatttttccgctgcatttatgtaagacttttatgatgtttgtaagacgtggatctgaatgtcagcattgtcgtttgtgtaccccggccggtcctggacggggatcttaatgcacattctgcttggaattctattcgggaatttctgggcgtgacatgtacgaacccttcctatcgatgacaaaaaacgtggtaggaatagtcttgctgccgactgtcaactccacatttagaacacctatggtttccgatggattaccaccaaagtctttgagcaccatatttgtcttgatgagatcctcggcgttcctaccaagcttcctgaatgtagcataaggcatcaaattcaccgcggccccaccatcgaccatcatcttagacatcggcttcccattgacgtagccgtttatatacaatggtttaagatgccgattctctgtcccctcgggtttatcgaatactgcctgctctggtgacggaaccaacttagccgattcctcttccacttcatcgacatcggcctgatcgatcccgaattcagctggcaatgtaaagaccatgttaattggtgccgctacaacactctttccttttgccaacctcttcgcctcatcggctgcagcatcatcggctacgggaacttgattcttaacacgccactcctgtcttggctttggtttcctcagacgatggttgatttcctcttcaacctcctgaaaacgctccctgttcctcaatctctggacccttcttttctgattcttcgtgaaaataccagaaggacaccattgattctttctaattacctcatcctcttggccacgatcttgattcatcggacccaatctttgatgaacgggaagtcttgcctgtcttagccgattacctctactatatgaccggctcgagctctcgacgacatcactgcacctagggcagttttcgatggatggcaacctcatcccttcattccagcataatctaaagaactcacaaccccaatgaggatcaaaaccatcgtcgtattcttcataatgcatctcctgctgcttatcatacttcctttgatacttgttgataattttagccgaatttacttgaaaaccctttgcacggaccctatcggctgcttgaccagctgtatgcaacatattaacaggaaaaggattaccatcgactttcatcggttttttggaatcatcaaacctaatcttgcccccctcaatggcaacctgaatttgctgtctaaaaaccttgcaatcgttagtagaatgagatccagaattatgccatttgcaatatctctttttgcctaattcctcagccgatgggattgtatgaccagcaggaagctgaatttgcttttctcggagtagtaaatcaaaaatcttgtcagctttggtaataccaaagtcatacttttcctcttttccaggacttttcacccattggcatggtatgacctttttgctcctcacccattcggctgcagctattcagaatcatcctcctcgtcatccgacccatacatgtatgggcaaacatgattaactttcttggagcttttcctgacttctgccaacctatgctcatgcaaggttaccttctatatcagatgcgataagctatcaaagtcttcggatgagaatttctccctgattggaggaatcataccctagaaggccaaatcggctaactgagcatcagttaaacttaagctaaagcatttgttcctcatctccctgaacctctgaatatactcgtgcacgggttcatcatgccgctgcttaatcgctgtcaagtcagacaacttcatctcatgaactccactgtagaaatagctgtgaaattgcttctccaaatcggcccaactattgatcgacccatatggcaaagaagaaaaccaagtaaaagctgatccggacagagataaccggaataacctaactttcaaagcgtctacagccgatgcttcaccacactgagcaaggaatcggctgatgtgctcataagtcgacatgccctcttgtcccgaaaacttggagaaatctggaactttaaaccgattggggagagggactctttcaaaccactcaggataaggctgccgatacaagcttccagtctcttttagtttaagcccaaattgttctctcattacattggcaatcacatcggcccacggtcgttgctgagctgctccttgtggctgttgttgcatggaccattctgagatgcgaactggggctgagccaatccccctggctgatattgggcttgtggggaaggaggctgatattgatagctcaagttacccccttggtaattatgaagattcggctggatgttgcgcaccaagtgctcaggaaccatctgaggcatcactattaggggtggaaacgagccgagccgagccaggctcggctcggctcgtggaagctcgcgaaatgccaggctcggcttggctcggctcggttctccaaccgagctgtacattaggctcggctcggctcgtggtctggctcgagccggctcgagctggctcgtgagctttgcaatagcagcagttgtattgccagcagcagttgtgttgctttgcaatgacttggttattcagataataactctcaagtccctacaaagataattaggtatattgtatgcagccaacatataacaaattgatgggcttttttggttttcggccagaagtctttctattcaaaccgagcctactaagctcgtgagctgctcgcgagctggctcgggctcggctcggttcacaaacgagctaaaacccaggctcgggctcggctcgttcaggattcgagccgagccgagccaggcgagcccgagccgagcttgagccgagttcacgagcccgagctatttgtccagccctaatcactatgctgtctggctgtgcatgatgcaccaaatgctctaggatgacctaatttacaaactgctgtacaggctgaccagcaggtactgcgaacccggccaatgcatttactgaccccgggtgctgaatcagctgaacgatctgctgtctcaacggagcctgttggatcagctggtgaggctgctgccttggtggcgtctgctgaatcggttgcagaggctgctgccttggtggtgtttgctgagctggttgtacaaccggctggattggtggtgtctgctgaatcggctgctgctgcactcgatcaacaataggtggaggtggcagaaacatggcagcaacttgatcttgggttagccgattcatagcctgcccgccgtgctgtggctgttccctcgttaacaaccgagggttcaccggctgtcctggcgtcatagctagtgtggcaggcaaaggagtcgacgctggcgtcgtcggctgagttgtgggtgcaacagaggaaactgcttgaacagatggctgaacatcagtgatcaaagatcgataatttgggaagacaccttgcaagtaaactgggcctgcagcctgatgctcagctatcgaaccatcggctatcgtcttcatcatgtttgacaaggtattgactaatactgtcacaccctaaaaatcctaaatatataaattgttgtttaattagaattattagaaataattgtaaaagactagaagagaagctctaattttaaataataaattccaatataaaagtgggccggataaaattttattaaatacttcacttgattatatagttcctagatttttctggaattatttgagccaaggaagtatttttcataaatggaattgcatttcatgaataatttaaattgaaaaaggttttaaaatccctcttttggctttgggccgaaagtcggcccaaaaccctttctctctctctccctcggcccagtcggaccgccgcccgcgcgtgctctcccgctcgctgacaggtggggcccacctgtcggactcgtcgtcctcctcgcgcccgaaccctagctgagccgcgccgccgccgcccttccaattccgtcgctcctttccttctccggcgaaatcaattgaggggaaatgatccccgggatcccctctatcttttctcttttggaatcgtcgcctaattcggtttggaaatcggtggattcgatttcaaatcggattcgttttctctctcccgaaccctaactttccttctcgccgccggccgccatgggccttcgtcgccgccccctaaccgctataaaaggacccacggtacctcctctactcgccgccaccctcgccttagctcatcgccgcttgtagcgccgtctccgcgttcacccgtgcgccaccgtcgccgtcgcgagttcagccgagcaccgccgtcgctccggtcattgtcgtcgctcgggaaggtcgccatcgggattgccaagccgtcgccgacctcgttcacccctccgtcatcgccaaggatcgccggaagaccgccgtcgtcgtcaacccgaccgtcgccgctgcttcttcctcgtcgccatcgtcgtccggtgtcacgcccagaaattcactagtaatttctgaactcatttgtgcataaaatcctcgtccagaaatcagccgaggtacacaaactgacaatttaatatacagattcatcaataactaaagcgaataaatacttacataagaggcacttagtcctcaccatgaagaaaactgcagcggaaaaataaaacctagcgagcttcagctccactcccacaggcagctcaactggggtataagccaaaggtcttctccttcagaatcctttttcttcaactgaggtttgatgattattgcaaggtgagcatatgacatactcagcaagccacatagcatatatgcaagtgcacaaggataccaaagaatagcataatatagggcttatttacaaaagcagcatttagcaaacttttgagaattgtaaaacagtagagcaattaatcattaatattaatcaacactgtacaacatacccatgctgcacaggcccaaccatcctgaacaaccatacccggctgtacaaatctatctctaaaccaggaatgtaccattccaaaccaggagctaatcaaattattaccagttatagcatcttttattatggtgagaagtgtgagactaatcacgaaagacattgttagacccgcccataaccgcgggcacggctattcgaatagttttactctggctagaggtgtaccactgtacccacaaggcacagccccacgacatgtcaccatgcacctcaataccaccacggtacctcggaaaggagctgtgacagtacccctcgcacaacacaatccaccacagcgcaccattcctggatcataatcaccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatgtgctcataacccaccattatcaagttttagttggcaatttaattaattaaccaatcacgattgaccatcgtgagcttccattaaatatccataagtgatagtgaagcatgatttatcccattaatgagctaatgtttctaagcacagctaagcaactataaataacatctagctgaaccaatccaatatataaggtccatgctagtcaaattataacccataggaaaataaagtcatcttcggccataattaaatgggaaaggctcaccacccaatgacattcgaaaacaatgcataagttgaaataaatcaatagctttaaacaggttcaacatgctcaaagggttgtttgagggatctgtgtgacttgccttacaaacaagcgtcttcaattcgtcttcaggaacttctccaacgaacggacgatcctccgaaacaacgggaagtctaaacctaaaacgcaaaacaaggaaaaacactaataaaaaccaaatgaccagtacaattaaagttcatatgggtagagcttgaatttagatgaattatgagacttgaacgacctcattccgagttcgtaagaattagatatgaattttacaagattcaattccaattaaacctattaaagaaaagactattccaaattgattaaacaatttacaaatgatttataactgagacagaagattaaaacatcattcggaaaaagattagatcatatttggtagatgacatatattaaaaaggaataatatgtcattgaaaagagatgacaaatttatattaattttggatggccaagatggcgctgatatcagtgatgacatggctaccacgcaggatcgacgaccgcaagcacgggaacggcagttaccagcgaaccacggtacaatgatgcgaacggagggcaccgggagagagagaggagatcaaggcgacccttaccaccacttacgcgacgacagacggcgagggagatggcaggcgacaagctccaaaggcggcgaccttgggttgacgttggcgacggctttccggcgatgagaggcagcaaccgaggggcggacggtcttcacctcgctcctgcgatcccgagggtggcgacggtgaacgaaggcggcgatggacggcgacgaacggcgcgggctgaagatggaacagatcggcttcacggtgacgacgggcttcccggggtcttcgacgacggggaagtggaggccggtcttcttctcctcctcgcgaacccaacggcggcagcggcgaccgaaggcgacgaccacagcgacggcgcggggctgctggagcggcagccggaggtggagagagaaggcgagcgcggggagagcgattccggcgagattcggcgcaagggaacgggtggccggggtagctctcacccttgcgaagccgagggaggcgacggcgcaggtcggggtcgaccgaggaggcggcgcgacgcggctggagggtcactggcgtcggtggcggctagggcaaggcggcggcggcgctacaagcgacggctcggcttgggacttgaggcaaacggaagaggaggccgaggggatgctatttatagccggaagagggagagatcggctcgggaacggatggaatcggcgacggattaggtagggttcgccggaaaaaggaaggatttgatccgcgaaattggaaagaatttccatataaacttttggggatttcttgggggaaaggaagtggagattgagaggattccattcccacgactaatttggaaagaggagcaacggagagcacgaatttggtggggaggcggcgctgtacacgggcacggcagggaggagatcggccggctggaggttaggggcgacactgtagtagaggggggcaaaacagacttctttccgggcttcatttcctcggcccgattgaaggagggaggcaaatagaacttcggcagagagaggaagagaggatgcaggctcgggttgggccggcggaagagagaggaagggaatgggccggattcggcccgagacaaagaagaggattttgattgactttttaatttaaataattgctgaaatgatgtttcatttattaaaaatacttataatgctcaaataattccgggaaaaatccagaaaatatttggacactaaaaatatttaataaagttttatctatatcaatttaatgttcaaaattttcatatattttattcaaacacttactttaattattaaataaattctaaaaattccttttttacaacaatttataatttagcgattttcagggtgtgacaaatccacccccttatagaaatctcgtcccgagatttggaacggctagcaagaaattgggtatggcaatccttcactgaccactctgtcaaactgactagccaatctaacatacctttctctgactcttctttttccaatagaacataacacttaacttaatccttctgtagatattgataggtcaattttattaaaaaaaacattatcctctcgacccttagaatattgactgagaggtctcaaatcacaaagtcttgtgtgaatacgatagtgtttgttctatattcttctctgagcacccttgactctatcaagtccatagaaacctcacgcatcactggagttgaattagttcccatgatttcacttttctgagaaaaataacatttaacattcgaccgaatccaacctttcgtggtaaaacgatttcctcatgtcttatggaaacaagtctcttaaccattaagtatatctacgaagtatctgagcttcaaagtattttaaattaatagcggatcttgaagcatcttctccgtctgaccttcatcttttgcagtgtaaaacaattattgtttatatctcaaatattcttgaattatttcatgtaacggtgtctccttaacctttctgattctagtttccaatggagcttcttgattagcttgaccatcaactacctgaacagactatcaagactttacttccaacattgatgtaaaccactttgcaaccgtgttttatggtctctttctatgtatccttctccttattatcatctgcataattcagattaaaatagtcgtgatgtctacgctcaactttgtctcattggtgtatgtgtaacttgtagaatgacccatatgctatgttacagaacctttgtagagattcgtcaagtctcacaccagtggtgtgtcgccaagcaagccattcttgtcctcgtaccatattagtagagtataaaccttctttagtgctttcaagtaacttctggtgtagtgatganctacttgcggtcgncggnagtgcaaaatcaaccnntgncacaca

SEQ ID NO: 60461 - DNA, 1136 bp, Oryza sativa
gacttatccctaggaacccaatcggtaataccaagttttccctcttttaaagatcgaacccaatcaagttcaacccgaaaccaaaacttcgtcgaaccaaaattaaacaaaaaagggtgccaatgcgccgaaattatattgaacgtgtgttgttaaaaattacatagggctcagggtctatttatacccgagaattacaatatatgcccataccggacacgactattatctctaccaaactctaagataccataagtctttgcggcagacttttgcccatatttatctataaggaatctacacaaaatatcctaattaatagatacaattgccttcccaggactttatccgtgcgtggcaatcatcttgaagtacatcaacttgaacccaatatcgcgtacaagtcgtattgtcggaatcggctgtatcggcttacttagcccgactcaaacccagccgatcctagccgtagccgatctggacctccagccgattcctgctctgtttccgaactcgatctccgcctccgacttcgctttgatccaatcctctttcctgacacagatgttaccaaatttggttgttaacacgagccaagtggacaagtcctttcaggcgaaagaggaaggaatgaagaggtatcttcgcattcgataggaaaagtgttacaccgggataacggtcgaacacctacctcgggatcagaacaaagaagctgacaccttgccgagatctgctgcttgtggtggactgcatgcgataggaatctttttcaaagtcctgtacgcaccaagtgtgcccgctgagagcctggatgtcatggcaatcgaccaagttgaactatgtcgacgtttgatgtcgcgattccggtatttgcatagtatagggatcggtggtactagggtatatgcgagattgaggtaaaagagatggagacagggagttttatacaggttcaggcccctgaattatcaggtaatagccctacatcctgttggccgaagcccgtattgctcttattcatcataatcacaccagtacaatatttggggtagcctatctaactgttgtcgacatggcggtctgaagttctgactcgtagtcgacaacagggtagtcttccttctcgaatccgg

SEQ ID NO: 60462 - DNA, 11965 bp, Oryza sativa
aacgccaatgggtaaggcttaaggcaaagagccaacaaaaaccgcagaagagaagactgcattaagatcacaaacttcgtattgaaactaagcagcagaggaggtgcaaatcgacagggagctgcggcaatgccgcgacgatgcaaccttcggtctcctttggcgtgcagactgcttgacaaacctgtaatccccttcagtcgcctccacagaaactgcacaaattggagatttgatgttgagccgtagattttggtgtaggcttcaccgggctcaaccagaattcaccatggagttcgccgttgaatctgaggagcttgagctcaacccgaacaacaaaccctgcatggaagctgctacaaaaagaaactacgagaatgaaggaacccaaatctagccactcaaaggaagttaaaagttcaactaatggcgaaagaactattgtcttcttgggtcaacgggcaaggttggggaagaggagacctgcaaaagagggcttgaggaatatggcttgggagggctatcaaccactgaatcttgaggagatgggtggtggaggttgagctttgggtgtatcagaggtggggtcaacaatgacatcgtcacagcagagggcgacccgagccacaatggcatcgtcacagggggcggcgagctgcaagaacgccgccgccgtcccaatctacccgaaccacaagcggatcaaacctcctccacacgggcctcctctagcttggcctccttctcattctccacgctagtctttgaggtatgcaagagattgaatatccggcagctgtaacgccccgattttcgttcgggattaaaatcatttaataatgcattttctagaatttaaataaaaattaaatcaatttaatcaagtgaattattgaggaaattaaaatttcctttaaaaatcattggctgggaatattttgtaatattctttgtgccctaatatactctctgaaattttccgcgaattttcgcagctcaagaagtaattttaatagcacaaagttcatttaatcaattaaaatataaaaaaaaccaaataaatctctccttcctcccttgggcaattttcagctcaagccctccttctctctcccgcggcccgcgtgcttccttctctcgggtcggcccagctcgctccaccctccaaatctattccccccctctcaaaccggcctctgctcttctcaggacgacaggtgggacccgtgggccccacctgtcatccccaatccccagccatcccaagcccaaccacgccatgccgccataccgcccacgacgccgccgttttcacgacctctcgcttgcgcgctcgcatccaaaccgagagcaaccgcaacccctccacctcctccacactctccccacatttcccccaaaaatcgcaccgggcgagctccatttcacccacaatttcgcccacgtcgccggccgttgccgccccaaaaccgccactcctcgacctccctgttgctccctcgcgccataaagagcctccccgtgctctcctctcgcatttcccgtcttccccgcgccctctcccgctctcccctcgccaagccgagccgccgccgcccgccggagctccccagcatcgcgtcgtcgccgcttccgccgcctctgcgttgcgccaaagtcacctctggcttcaccactccacgccgcacaccggctgccccaccgcctccctacaccatcctcgcagcaccgtttccaccgtgcacccaaggccgccgccgcgttcgttgcctctagccgcgcgactccgcctctccggttgaccccactccgcgccgccgccacctatagcgtcgcagcgcctcaccacagctcagcgtccccctcactcgagctcccatcgccagtgcctcttatgtatgtatttacgctttatttatgtttggatctgtttatcacttgttgtattgtgtaccctggttggttctggacagggatttaatacatataatagtcttgaaatatgggttaaatttctgggcgtgacagcagcgtcagcaggactgctcctcctgccactcctcttcagacttcggatctaacttgtcaacctcgtcctcaaggttcaggccgacgctgacgtcagccgaaacctggccccaaccagcaccgtcaccatcaccaactccggcaaccatgggacctagccggcaaaaacttaacatgggaaaaaccctacttgcaggaagaacctgacaacaaggaactaatctaacaacactatactagtaggtaaaggtggatggacccctcctccaagcttcgccggtggcgaactgccggaatcgaaggtggaagaggggacagaggggaggattttggagatttactgtagcaaggggaaaggggaaaggggagaagatcaaccgttgttcctctcctccaatcctctctctcttcccagaggacacgggacacgaaattgtgtgggcctagagcagtagttttgacgaggaacaagtagcatattttggctttccgtgtttggtgaatcaaccaaatgtgctgaggtggaggggaatctacgagttggccggttgaggctgaatgatacctcagtgcactgtgaatggcctaacagcaaagagagaacatatgcaacatgaaagagagaagcacgctagctagcgcacgctgcacgtgttgttacagagaaaaagagactagagagtagagtaggagagcgttcgagtttttttcaacttgcattggatcagttgaaccgatctgaagtattctcctaagtgcacaggttacttggcaagtttttttttttaaaaaaaaaggcaattacatgataaagtgacaatatgagaatgtgcactcagcactcgatcagcagctcttgtaagaaccaagcatgcgtgcgtgcttgcttacgagatattgtcgaagtgctggtcatgcatggctcattgtattgtgtcccaactcagtcgatcgtgacaagcataacactcaccctgctaccctggaatcagcagtggtgcctcatcacagtcatagcgattgcccgccgccggcgcactggaggcgtcttcctctgtcgttgatgccaaagtagtgttgacgacgatcaagctgttaaggtcaggcaacggtccgtcacgctccaggacatccatagcttgccgcatagaaggtcggtgttgagtctgcaaagcagagcaccagagccccaatacgatgacacgctctatctccctcatatcaaggccaccacccatggttaaccttgtatccgccgcctcgacaacattgccaccgcttcggtataggtcccagatttgctccctgtgcctccttgcacaggcgatctcgagaagggcaatgccgaagctgtacacgtctgagctacgcttgaatgggaccttaccatgtttcagacactgtggatcaaggtacccttccgagcctatggcagttgtcagcaacgtcgcattgtcttggtttgccatcctcgataggccaaagtcggcgagcttggcgttgaaattttcatccaggagtacattgcatggtttgatgtctctatgcaggatatgtgggtcgcactcgtgatgtaggtagagcaggcccgatccaatgtccttggctattttgtacctgtttgatcatagttagatagctacatagattggccataaacattcttagttagttaatttaatgccaacagaaaccatactttcgaagcaacatattgtagttgattttaatgttgtatttgtcgattttttaagacaagccatggtaggattgtaatttatgatttgttaataaatttgttgagtggaagctgcattatttaactttgacaaatcggtgtgtatcctatttggaaaaaaaaagaaaaagatatgattacctaaaaagttttgcatatgatttacctagacattgtaatgttagcaaaaacacacaagataattgataaacgaacaaactgagtacaactccatacatattaatttagaactttaaaaattattatattatgaggcatacttaaatatgagtggttcctaaaatcttgcatgcattaagaagtgttcctctttaataaagaagagggcacgaaaagaaaaaagtcattagcacgtgattaattaaattttaatttctataaaattgaaaaatatatttatcttacattttaaaacaatttctatacatatataatattttcacacgaaacacgtttagtaatatgacaaacgtgctaacagaatgtaaggtgcagtatgtatttgaggaaaagaacaccaatcttaggtggctggtaataagatataagggacctaagtgaacttattcctatacttattacactagaaaaacggtttttacgaacacctctaattgattgcaggtaggctaatagaacttttgtttgtaataagatttggatggtgtctagtaacaattcatcagtgaaaatgaacctatttttcacatacaggtctctagtcaggtctagtaagagatccgtaggtgaaaaccatttcagagcacacgtcctttgccatttttttcttttttaggtcctcctcactcactccctttctccctcggcttctcgtcctactccctccacctccgcctcctctctcagcccctctcctctcctccatctatccctcctaatggccaaagcgaggcgagtagtaggcggatgcagggcaacgccaagattgaagcaccggtgggtgcagggcgtgccgtgataggagaactgggtcggcgtggggtgtgccgcgacgggagcaactggccggcgagggtcaacagcttgtcaagcggatccgtcacctccggccctgtcagggtagatccatcgctgacagcgaagggttggggtggcaagggcggagggcaaccacgaggatgatggagggctcaggggcggtggggtggtgcagtccaccgcagccagatccgacgccgacagcatagaggtgggggcgatggggcgtagggcgaccaggatgacggcggagggttgtgggatggaggggcggtccttcaaagctagatccaccactgccgatggagcggcgggaatgatagggtgccccaaagatcccatgcaggcggcctcgcgatggctggatcccatggctccagcacttggactggttgatccgcgtggcaccaatgatggcatctttggggcagtgttgtatttttcttattactagagatgggatatagggtttgttggaaatgggagctagggtttgtgcattatttttttttttgaaatttattttgccaatttaagttttgcagacgggcagcataatgtactcgcgtgcgaaaatccctttttcgcacacggttgtgtaaaaaagaaaaccttttctgctaacacaagcagttgctttgcccacgtgaaaaaatgtgttcggcacgcgtggaaaaattgtttctctagtagtgttaatttcaaatgtgaaaaataatagtttaaaaagggaacttaaagcaaagacgatttgaaaagatgaaaacaacagaatatatgttaggatgaatatagtatattttctaaaatgcgccgatgtcaccttgtttgccaagaaagtacttctgatgactcgcttttgtacaagtagtcgttgaggttgccgttcgtcatcaattcatagacaaggaagagctcattgttcttcttactccagaaacagctgcacatgaaacggagaatgttccagctgtgtccccgggagcaccaaccaaaaaacttgacgagattcttgtgcttggcttcgctgatagtgcggacttcggcgaagaagtccttgtgtccttcgctggactccctcacaattttcttcacagcaacttgatggtccagcagcttcaggtgtccgctgtacactgccccaaaggcgccctgcccaagcttgcgatcctccgagaaatggtcggtcgcagctgccaaattgcggtattcgaacctcctggcgccgcctgttcccttgtcgaagacatttcgaatccttttctgctcccaacaagagagtaagaaccacaaaactagcgcaaacactagagctcctccaatgatcagttcaaccagcaaccgtgctatattgtgtgtatctgcacatgcaaatcaatagcagtatataaatttcaatcaagctaaacatattggtaagtccaaaatttcagtgctatgtttatgtgcaatttcagttttcatttgatctgcaattctgttattgtctatggttttattttgttttattataagcttgattacaactacatcatcatctaattgtttatcaattgtaaatttatttcatgcttaagttagaataatttatgctcaactttaacctaagaagaatagagtttgtttatgaagagaatgtaggatatgattagagttatttgattttgatccaatggatgagaaaaaactagtgcaattttcaaaattttcattgaacaaaaatgtggataagaaataaacattaattcaaaaataggaaataaaggggaagcagaaaaagagtaagagataagaaaatgcacattgaaaaaaaaggagaaaaaaattctagctatatagcacaaggatcccatctaaatcaactaaaaccaccaataacttagagtaccaattaattgtttccccaaaaagaactaggacttctcatcaataccacaaaactgtgtattttttctctgaattcctcatttgcccttacctcatgttcctatttgtctttcttatcccagaatggagaaagtattttggtcctcgagtgaatattctgtcgcgggatcaaaaaccgttccaacatcattataaaaaattccaaaacaatttggcaacattcattcatggtcattttaagcctaaactcaattcactcattgagattaaaaaaaaggacaattccattttatctacagtactgcgcgcgcctctctatgataggccgatgcacccccatatacaaccaccatctcactgttgatctgggcgactccgtggttgggcgtgcgtggagctcacggtcggcatgctgcttaatagtggtcacacgcacgacaatagcggcatgctggtacaagcaggatttgaaattttgaaatcagcttttctgccgaggggaggggagagggggggggggcaaaagaaccgaaatttcgaaaatttcggatttttttcgtccaaaattttttgaaattttgactggttttaaatgaatttgaataagatttgataaaattcacaaaaaaatgcaaaaaaccgaaagtttcgggcgagatgtgagcattttttggggggggggggggtgccgaaattaccgaaatttcggaaattacagaaatttcaaaccctgtgtacaagtccagtagctatccgaggcctcatggccgggcaaccatgcagtggcgctgggctcggttgacatctcttcatgcagaaattataagctgcttaatagtcgccatagaagtctccatggatctagcatggatgtaatctggtggagaataggcttagttgctttttctattttgtaagtccttccaagaaatttagccatcttaaaggagcctcattgcaaaactgcctgtacttgtacttgatatgtatctaattatttacgatcaataaaatgtagttctaaaagaagacctggtggaaacctggactagaacgaaaaaacaaaaaacaatcgatttgttgtcaagtcaaaaaaaaaaggggctgaatttagaattttcgtaatattagtcaggatttcgtcggtttatcagcggtttccgtgaaattcgttcgtgagtggtttttgattcaatatcggaattatgaaccctgagcacgatgaagaaccaaacgaggatgcttgcggctagtccaagattaatgtcatcatgtcatattttttgtgttcttggattgaggtgaaatatctgttacccatggaattctctcgacaagaaattgagcctatatattactacctccatattttaatgtatgacgccgttggttttttatccaacgtttgatcattcgtcttattcaaaaaatttatgtaattatcatttattttattataacttgattcgtcgtcaaatgttctttaagcatgacataaatattttcatatttgcacaaaaattttgaataaaacgaatggtcaaacgttggtcgaaaagtcaacggcgtcatacattaaaatacggagggagaattatcacgtaccttggtgtattagcggaaggcttgaattgaaagaccaggacagtatctggcagatctccacgcatccggcggtggctgcagaaaaccccacagcaacctgcgggccgggcggaggtgtgcccttgagatgttctgtcaggtttgcactcaccacctgagcgtgggccgcggatgatggatggtcaagaaaccgaaggtaggcgaccagcatccctgtgctgctgttgaagacgatgtcggctatcattgtcccattaagggttacgttctttggcaagtatgtggtaatggcagaatccttgacagagttgatgtcgatggcgatgtggtcggtcttttccttcgggtcattgtcaaatccgatgccgatgtcgaactcgacggcgatgaaccgatcatccggggcgatattgctagtggtcgtcttatcagtgatgagtccgaggttgcccccggccgacctgtacggcactttagaagggaaactggcgaggaagaaagccatgccatcacctctgcatgtaccgttgccttcgatgggcctgatggcgaaggtgaagctcgtggagaagctggccaccttgctaatgcggccgttggctgctaattggtaaagctgcaccggatgagcatacgacatccggccaccgcgcctgcaaacctggtcgttccaggtgcaggtgagttctaccggcgccccagctttctgcggctcgatcgcgtcgtcctggaatacgagatcttggcggtacgtggatgggtggtcggctgagaagttgaagctgaacacaggtggcgctgctgctgctccagcgatgaggtgatcagaagcatcaagcagcatggagagtaagaagaggaggaggccgaggtagccagggcggaggagctgcgacattgctacagctagcaacaagagtacgaattcggcattaatgtgattgatggtctaattagctatggcggcttggccgagggtacgtacttttataaccatagacagatggaatcccacctactctcctgtcctaaaattagttaacttggtacaaaacgtgatacactctattattatggatctgaacaggtctagtagtattagaattaacgttatatcatatactccatccgtctcaaaaaatgagcatttttataactagaaagatagcccgcgcacatgcatgggcttttaatataatgttgtttgaatttttgttaagaatatttgcacgcgggtgatttttttttcttgaaatattctttgattctattctaaacctgtttgacgtagaacttgcgcccatctaggatttatgcatctgtggcatgcactctgcatttctactatattattagcacaaaggtttaatgcatgccatagtggatgccagcgtgatcaaaccttttcaatcatccgccttattctaagttacaaggatatactagctaggtacgcactgcatgcatgtgctttaatttgtagccatgtaatagaaataaactatgggaattaattaaaggtaacgcactctcatctataattgttttgtacaactatatctgagcaccacatgagcatcactaccattccagggaatgggatagatccccagttgcttctgctacatctggatttactaaaagtgctatagctcttccacatgctccaaatgaatgtaggtagttactccttccggttcaggttataagatagtttgactttggtcaaaatcaaactgtttcaagttgattaagtttatatataaatatagtaatattcataatactaaattagtttcatcaaatcaataattgaatatattttcataataaatttgtcttggccaaacttaaagtagtttgactttgaccaaaatcaaaacgtcctataacctaaaacggagggagtaatttccattgaaagatgccatcttcataagatggcctaatagcagagaaaacacaagtataagaaaatattgttattgatttcatatacattgttttattaattatctcgtagtattttaagttatgtcatcttaattgaccccaggctgtattcagtattaaaaaaaaattgaaaacattacaagggggtcaagaaatagaactgaactttccacatacacaaaaaaagaagaaatctgaacatattttactccctccattccaaaatatgaggcacaaccacccttaacccaaagacaaaaaaataattattatcatcttgtagtttggatcatcctactaaatataatgcatgcgtccaatagaattaaataacatgagagtggaggattttaaaaaagtaataatttaatggagaaaatgtcatagttaattgcatgcttgcatgcatgccttatactatggaacatttagaaaaagtggttgtggcttatattatggaatgaggaagtataattttgtagaaatctgaaatagggagccgttataaattaggttaattagatctatgccattaaattttttttggttttgaaatataccactactatttgcgtatttgtaacgatgccactgctgcttttttttaatttgagtggtgccactaagatacgtattttacatgtattgaacaaaaataccctcatcttctacctctcttctctatcttgtccctctctctcttcccgttgcttcttgctccgccgctcgctgctgctaccgccgccacttgccaccaagccgctcgctccgccgcttgccaccgagccgctcgcttcgccgctgctgcctgctgccgctcgccgccgccgccgctgccgctgtgccgcttctgccgccgcccgctgccgcgctgctgctccacagttgccatcgaacaggaagaagggagaagaaggggagaaagaagaagatgggcaattacgttttttttatccattgcaattacgttgtttttttaagccaacattcacctcccgtgcgttgaatgaaaaaaataaacacgggaacactcattctatttcgcgccaacggtaaaatgggatgcgccaaattgagctggacgtgcctcaaagatatccgttcgtgccaatgagaaaaataatattcgtggcaacagagttcgacgcgcacagacagaacgtaggtggatttcggtgtaaccgtgagtcctctctaagacacggtatgcgcttgatgattcccgagtttattgctctacgcacggtaaattacagtgtgacacccggtattcgcatgcacacgggagccttcccttcaccattagtgttggttgcaagccgcatggcatttccaagggctcgctttacataattttgcttaaagaccggctttacgctccccttctaagccaggatttcgtctagtctaccaggatagccattggcatcgcccgcatggttcgacaatgtcttgtaagttcgcctgtaatatacttgtgaaggtcgatgccaggaaccatcgttgggtgtttcaccatgaggaacaggaggtagttgtgttggatcgtaatgggctagccaaccttgcgtgaaacgatggtgccgccggggaggagatagtcatggaattgccaatgcggagagctccttcttcggagaagaagcctatgcggctaggtggccacaccactccctgactcctctttgccagaagccttcatggcagctgttgagagaggtgctcatgcacctc

SEQ ID NO: 60463 - DNA, 6824 bp, Oryza sativa
cttcccctccccctcccctccggcggcgccgccccctctccccctccccccagccggcggcttcccccgccaccggcgccgcttcccttcccatctccctcctttctcgccggctcggcgcggcaacggcggggttcggcggagacggcgccgtcccaacggcggcgacgacggcgtccgcggcggccgcgctccctctcccccctccttcccgtctcgtcggcttggcgcagcgacggcggggtgcggcggagacggcggcgacggccgtccctccccccctctctctccccgtcggcctcgacggcgacggcgccctcccaacggctgcgatggcgtcggcttcatccgcgtgcggattcggcagcggcggctccctccggcggcagtggtggcgtcggcggccgccctttttttttttttgcaattttttccatggctattgctaaccgaataggattgtgcatggacaaaagatggacgaaaattagatgtcatatagattttttttctagatcggacttctttttttttcgcacttttttacgtccggttattttggatcggaaaaacctggtttttttcgcccggtttttttttttcaccttttttgttggatcggactttttttcgtccggtttttttgatcggacaaacttggttttttctacccggttttttttcacccggtttttttgacggacgatggaagcacctcttattttttaagtagtagtagagtagatatagatatatatatatatatatatatatatatatatatatatatatatatatataactactatatggcgctataggcgccacgtattagatggcaccacacacacaaccaaccaccctgtcccacccccacgcgcactcaatttaaacagaccatgtagttaatttttaactcagtgacccaccaccccacccatccccacgccagttattttttaactgttagcgagatagccaatgtgtgtcttgtgatccaacggtgtttgcacaatgagttattttttaactcaacgtacagactttatatagtatatatattacggatttccatcgtagaaaccgtccacccactttttcctctccgtctccacattttatggatcgttgatggcttggcgacgaggaggagcggcggtggcggcggttcggggacaagcagaaccggcgtcgtggaggagcggcggtggcacgtcaggcctgatggcgtcgcatccatggcgggcgcggcatctgcgggcggggggtggatccggcacggcacggctgcgacaaatattcaagaacagcacataccattttgcttcagctatggaatgaaacaaaaatgagaaggaagtcagagataagtgcaagattgaactagctagttctgaatatttgttctgcttcaagcacaacatctccatgtgttctgaacttaaatactgagattcctgaagaacagattctggaagacgagtgcattccatctgaatacgcggtttgcagacgtcggctcggtgacgacacatgagtcagaagcaaatcaggattcgataacgttcatgctttccttgacttgacctataaagtaacgtccttattactcccgtcaatgaatatgtatatcgtcgtattaagaagatagtgcgctgcatcatgcacctaaccggcctgatgttctttttcaatacgggtgaatccgaagagaatgatgactctctgaatagtggatgaattattagatcggagggattgtggttagggaatcttttaaaacatagacactattttacaggatttttatagaaattaggaagcaatcactacttaaaaaaagcatttttgccaacgttgggtctctttttccgcagacgggtatgaccctcggagccaaatatctgttagaaatttaatcataattcggcatattttaatccaaaataacaagataataagcatgttatttacaatgagcatgcttaacatagcatgtaatcaacatgagcatgcttaacatagcataaccatcaacaatcacataataacgcaatgttgacattgcgatgaatattaacggtacaacttctaattgaaataatgtaagatggttataccccaaaaaaggtcctccgctggagtttaaggcagtattgcctctgttggtgttgacaggagcatccttctccttgtctccagcgttgtcgttgtctttagtgttcgatatgttagtgaagacaaagtagacgttgacgaacagtcagtagtcgcaccttgcgctccccaaaaacctgatcgcccacccgtccatgcaaacgtcgtagcagtgcgtggtttcggaggcctattctctcaaagcgtgtgcacacactcgtcgggatgggattaccgtagcagcaaaagccttggaaatggatgaaagtgtgtctcacttctccttaggaagataaaatccattctcattttataggaggaatggaagatgaagagtaagagtcatggaataggaagagaaatagagtaactaattctcatcaattacccatcaaccatcctctattacacaaccatcaaccaaccatcaattaggagtaattgatgtaggttaccaacggaataggaagagcaatagaccaactaattgtcatcaactagcaactagccatgaaccattcttcactccacaagtatcaaccatccatcaatcaggagtaattgatataagttaccaattcaccaatcaaatggattaattatcaaaactcttcatcccattgatatcccattaagagaatgaatacacatgaattcctagcataatgagccttggaattaatgatttaaatgaatcaattactcaattaaatctaacaatattcacttatgaaaatgtaaaccgaggtggattttcatcattcgattgcgaaaataaatttttccaagcgaaccgcttaagaggtccgcctgcgaaaatacctttatttctatgatttttgcaggcggaaacttatgtgctccgcctaaaaaaaatcatgcctacatgaaaaaaaaaactaagtcctatcttatcttctcatcttccatcttatcctctccccaccactcattccatcaactctctctctctctcgcggttccctccggctccctcccctccgcttccttccttccggtggaggcgcaagcgaagggcgtcaccattgccggatccaccgcccccatgccaccccactgctgccgacgccaccctcctctctaggcgcaccactgtcgatgcccatccactccatcggatctaggagggaagcaagaggagagggaggggagaggtcgtgctgcctcgtccgcgctctgccggcggtccccctccggccatgcagggagggcaggaaggggaggggaggggagatagaaggagagggaggggagtggccgcgcacgctgccgtcgagagggaggcagccatcaggtttataccatgttcgctaacggtatgtaaataggttcacctaatttgtcattgtttatagaatcaactgattaaaaagatagatcaggttagcttcgaacgtgagctataagcctgttgagctaatgaaatgtaaagcacatgcatagacgctgattaaatgtaaagcacatgcataaactacactaccactaagttcagatcttgtcccgtgttgttctttcagttgtagcttccaagctgtgcatatctcaggcctagtgtccgtcagtgatcaactgcaaggcgctgcatactagccagcagattccaagagcgttcggtacgccctgtctatttcacgtactatctggttttgtgtagtttttttcattgatattaattcttgctcaactaacacacatgtgttagcatcagacgatgcctggatggatggttcgcacggtgttcttgctcaattcgtgggtaatccggacgttggtagtattcagcttcgcagcgcatgtcaccatcgtcttcttggcaggagtccgccgtcataaggctatcggcttgccgatagccatcctgtgggcggcgaaccagctgggccggtcggccgcgacgtacgcgctcagcaagctcgccctcggcagcacgccgcaggagctgcagctggtgacgctctggggggcgttcctgctgctccatgccgctggtccggacaacatcaccgcctactccttggaggacaatgttctgtcgacgcgccagaaggtagaaatgatcttgcaggtatcaggagcagcatttgccatgtacaagaatatagtcatcagaagcgggtccggtacgatggtctgggtctcctctttcatgttcatcatgggcatttttaagtattgggagagggcgaaagctatgcagctcgccaacctagaaaacttgcgaagctcaatcaagaagaagaaggagacaaggagacgacgaagcttgagaaatattaggcgtccaagcagttcaaagcatgataatgacaaggaggcactgctggttgctcatggcctgctcgacatcaccaaaggcaccttcgtcgattcttcagtcaacgagttggtatcagagcgagttctcacccccttcctgatgagctctcttctgctcattactagtgacattgccagaacgattcttctgcgcagtagtaatttggagctcaacctccatccctcgagcctcctcaactgcattgaggtatatagtaggcgggtttcttcccatcacttctctataccgagcattgagccctcgaaagaacttcctagccttctcacgctcatcacttgccacgctaggcacaaagcgtacaatactgctgaactcccgttcatactcatcaacagtcttgctcccctgttggatattgtttaactcatcactcatcttgtccctaaatgaatctggataatacttagctctgaactgctgaagaaaaacttcccaaaaaatagcaccacgatcagggttccacgcttcaacaactccatcccaccaaatgtccgcctgaccagtcaactgaaaaggcatgaaagtaaccttctcctcaggagtcattcttgatcccctcatatacttctccatcttgcgtaaccagtctgcagcattaacgggagtaccagacccatcaaatgtgtctaagcgcatggatgtccatctagtgagtgtcatcccccgaacagctcgaggagcatcatcagagacagcagctgagtggctaccaccctcctcctcttccatgtgctcatcctccatctggttcgaggatgctgcctcattatggcgacctctaccacgacctcttccacggcctccagcacggcccctaccacgacctccacgattcggaataggggattcagcaaccgagttgttcccaacctcttcattatcctgagtattttcaacttcttcattatggtggcccctaccacgacctctacctccgcttctcccgcggcctctgttagccaaccaaacactcactctaggcggcatagctatatcaaacacaagcatttagacgtcattagtttaacaataggttagacaatggcatgcaaggaaacacaatcatacacatatatatgcagcagaaacataaatgctaggaatgaaccatgctcccattcctattgtgcaccagtgtgtcaagttcttttagatgtttatatataacccaagttctactcttattatttcctaccctaagagaaagtattttttttaattggttaggaactctagttcaaaattttatgttgatttatatatctcattacccagtcaattcccatggacctaccgcccgctctgataccaactgtaacaccccaggtaaccacgtacatagaatgccacaccaaaatacactcaaaaactaagtcctaaaattattagaaatttcggcagagtctcccctaaaaatacggacatcacgacaggcagttataagaaaggtcaataccgatataaaccacacaatccaaaccatcctagtgtagacccccgattttggaaatcggaaatcttctgtgtttatccgtaccaatccctggatcagtagttggtacacacatacatagttggatcacaacatatcacgaatgaatttagactaaaagagttaaatacttacattagggccaggtaggccaacaactatcagagaacaacagcggaagacaaaataatataagggcccggttaacatgccacaggcagtcgactggggaacgagacctagaacaagaccgcactccgatcatcttgtgggatacgcaagcgtaccgacaagggcttctcttcaacactctcctaaaagatatataaatagcaagggtgagtaccaaccgtactcagcaagccaccacaacaacaatgcatatgatagagggtatttcaaggaatggcttcaggttcttttggataaagctaattttacaattcttttcacaagcctaaaacctagcatagactgatcaaattttagtaccagtgttcactttaaacaacgacggttctgtccaccatccattgtgatcccaaggatagcttcccgccattgaatcgtcatggttttctgaggatgtccaccttccctcctctcgggaagtggctccatcagcataaaattcatcatgcaatatcccattccccacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtccca

SEQ ID NO: 60464 - DNA, 1284 bp, Oryza sativa
ttttccatcacatcgttttaattttaaccaaacttccgattttagcgtgaactaaacacaacctatattggtttgctggtagcgttctgcaggctgctccagtcaatcccagcaatgccaatccgcaacatcctctcccaaacgatcttctttgacctccgtagttctgtagtttagagcataattaatattgtcaactcagatgtgttgcattctaaagtccaaaacctgaaacatacctgaaaacttacttttctctgttgatcttttatatgtttggagctagtactcaatgtgtcaaaggttgataactttttattgtaaaactaggatcgtggtgagcgtcagggtccaagaataacatcccagttgtgcgacatcatgcccccattgaacactagggccagaagaaaaaagatccaagtattactgcaatatagtaatagttataatgggtaaatttgatccatgtcattgagaaattgtcgtattgaaaaaaatggcattactatttgtgaaatgtaccgaatgcccctgaaatatcctaaaatttgaaccgtgccattatcaccaagattttccaaacccattccatcatgatctcaccgaagcatctcgttgtcttcttcgtcaagcctaacgagcagcaggccagcagccggagcatttcgtcatggataaactcgtcagcgaggcgcgggtgggcggcctcgacggcaaggcagcagcgaccaaacaacacgtgcattttgaaagtgaacaaacaattacacagttatgtgtttcacaatattttttggcttgattaatatgtagcaaaaattttaaattattttgtttattatggaattaaaaaaatgtaatttcataatatgtagcatattaaaaaaaaactctctggtgccctcgcgtcgccctcgcgcggcggctcgggggcgaaaccctagccaccgccgcccctccccctccctcctccttgcttcgccgccgccggagctcgtcgccggcaattccgggcgacgcgctgggatggcggcggcggggccatctctcttggctccatctcgccctggcgcgggcgtggcgacaatggcggctgggcggcgaggtcgcggcggcgggacggtgatgtcgcggcgacggcgtggtggtggggctctctgcggcatcggcggcgcggcggtggggctccgcgcggctccggcgatggcgtcgccagttccggtcgccccgccagatctggccggggtgactacgcgcggccagtgacgggctcggtcgatg

SEQ ID NO: 60465 - DNA, 3668 bp, Oryza sativa
ctgcttccagtcgatgccggggagctccttggtagaggtggcgtgcggattttcggtgtcctgttcgctggtcgtcggccgcgctgttagtttgctgcagctgggttcctgggtgtgaggtggtctctggtcgagctgcagggtgattggctgttgaggcggagtcggagctgcttgtcttgcaagctcggcaacgatgaccctcaatgaacgtcccggcaacgcggcgagggtttggaagtggagcattttgagagagcctcgggtgaaaaccttgcctagtgctatcctaggttgatgatatcgacgcttgcgggcgccgtttcctccttggaggtattgtcatgctggctctctcttccttcaggtgaaaaccgggttcctttcggaatgggcgttaacagcatccttgatgttgctcccttgttgaaggcttcgctcagaaggtttatgctcaactagaggatgtttggtggttctggagacctcgtttgcattatgttgttgaagctgcttgccttttggtaagcttggtaacgacgacttttgtgaggtctctttagttgtttcttttccttttctgtataggtttttgctggttttctgtttaattaaccgtgcttgtttggtcttcgggcccggtttctcttattaactgggccaatcctcttcttctataaattccagcaggagaaactcctgtcgtcggttccttaaaaaataatatgtagcatattgatcaagataatttcacttcaatttgccactacacctaaaacaaaattacaaatgggacgcacaaaactacatttttttgaaaaaaaaataaaagtgacaaaaacaaaatacaaaactacaaaatacaaaatatgaactacttcattaatatgtagcaaaatttggccatcactgcactggcaagcaaataactatagtagctttttgcagaaacaagaaagaggaacaccttgagccttggcacgacggtgcgcccctgctatcgaagagctcctacagcgtgactgcgacgtctcgctgccctccaaaaacgtcgcaccgtgctcgtcgaggtcccttgtcatccaaccatacagctccacccgccgcgacgacacggagccacctaaaacaaacaaacatgaccaaataaaaaacttcagcgtttgttgtaattttttaaaataaaatttaaaaaattgacaaaattaaaaaacaataataatttcacattaatttgccagtacacctaaaacaaaattacaaaatggacgcaaaaaaccactagttttgaaaaaaaaaattaaaaactgacaaaaacacacacaaatatgacaaaaacaaaaggaacaaactaaattacaaaaaatataaaaactaacaaaaaaacaaaatacagattacaaaaattttaaaactgattaatatatagcaaaattttaaaaactaacaaaaacaaatatgaaatacaatgacaaaatacaaaatcatagttgctatcaagaagatagcgcatcgacttgatatgtagtaaaattataaaactgacaaaaacacctaaaaattcgctaacaaaattacaaatgggacacataaaaatatttcttaataaaaattacaaaaactgatagaagaacaaacaccattttgctaatacccagtaaaatttcctgacaaaactagcctctgttgactgagaaaggtgaaaccattttgcaggcaaaacaaaactaatgcccacagctagaattctactcacaaaactaacctctattgactgataaggtggtaccattttgaagacaaaacaatactaagattagatacttgattgcaaaactaacaaaacataacatttatggattattgcaataaagctccagtgaactatttgtaaacaaaatagttaaacatatctgtaaacaaaataatgtccccaatatgctagtgattgcatcaatttttcaaaacagatattatagatttgttcatgtccaccagatttaataaaaaattccactaattttatcatctaaagcgacaaagattaattcccaaaaggataaaatgctgaaataaaagatgtgcatatacatcggtccaaaccatgggattgtaaaaaaaaaagataatttatatcaggtcgaactgtgcctagggagacaaagcagcatggggaaaaggtacgcacaatccctaattaaattccatttgcatatgaaaattgagagcacaggcattcaagaaatagaggatatactataggaaaaaaagtacaaattactccaccgaactatcgtggtccactaaattaccccctaaaccataaaaccggatattcttcacccctaactatataagccggacgaattacccctcgacccaatctgcggtggttttggtttacgtggcgtatgcgtggcagtctagtcatcattctatttataaaaagaatgtgggacccacctgtcatccactattcctctctctcactcttccctctctcactctctgtctcactctttctttctctcttacgcgcacggcgccacggcggcgaggacggcggcacgcacggcagagcacccgcagcacgcggcggtgcgcggcctcggcgcgggcgaaggcgcggctcacgagcctgcacgccttccggtcgcgcggctccctcacccggtcgagcacctggccaagcaaatctagcgacagcgccgatgtatcgaggaggctccgacgacgacgacgacgacgactccaccggctggcaatccttgcacgcggcggcgcacgatccacctcgtcgccgcactggcagatcggtgggagagacctgttgcagatggcgttgtcgcagcaatcttcccacggcctcggggtgcagaaggggcccgggtcggctccccagtagacgtcgctgcagatgagcaggcccgacggcgacgacgcctcctcgacgtcgttgcagcactcccacggcctcttcttcgtcggcatcttgggcgactttgctccgtcgctggggaggtgtatcgatttcattgtaaccactattggatattgcattgcattatagatcaggccgatcaaatgtcactcaaattacggcgccggatgataatcatgagaacaacccggtgctctatcgttggatcgctgcaatggatgggaaaatcgtttgtaccttggagatcggggatagactgggaatgccggaagagaagcaactgctagtcgtcggtggcggaggcggtggagcggaggaaaccgaggaggctgcggagcccccgcgcgcggaggaagaagaagtcggccttggcatcgcgcagccccgtgcgcagcgccagcgtcacctctgacctcccggtacagacgccgccgcgccagcgcctccgcgagctccccgccgccgccgctgcctcccgcagacgaagatccctccgctcccgatttcgcacccgtgctacctccagccgccgccgccgccaccaccatctccttccggctcatccccgctggagacaccgacgacgacgcggaactcggcgtggatggggcggcgcgtcgaggacaagagcgcgcgcggcggagggaggtcgaggccttgagcctgcgaccgcgtgcgtgccgccatcctcgccgccgcctccggcccttgtccgcgtgcgtgcgcg

SEQ ID NO: 60466 - DNA, 7417 bp, Oryza sativa
  unsure (1)..(7417): unsure at all n locations
atctctgcctgatggttggactgaatccaccaggattctttttcaaattcctgtacgcaccaagtgtgcccgctaagagcttggatgtcatgccattcgaccaagttgaactatgtcaacgtttgaatgtcacaatttccggtatttgcatagtatagggatcgttggtactaggggaaattataaaaaatatgggggggcccccgaaaaaaaaggtaaattttttgaaagggtaaaaaagaagatggaagacagggagttttatacaggttcaggcccctgaattatcaggtaatagccctacatcctgttggccgaagccggtattgctcttattcatcataatcacaccagtacaatatttggggtagcctatctaactgttgtcgacatggcggtctgaagttctgactcgtagtcgacaacagggtagtcttcctcctcgaatccgtgcccggcgagatcagagatagcgctttcgtctctgatgacagtatccggagacaccatagggtactagccgtgcttatcactgaagtcgatatccggcggcttgtcttggcatatgttggcttgtatgttgatcttgtgtcttgatctattgttccgtgtcccctctcctcctagggggccttgtatttatacccataggtgtccccttgtcaaagtagaagtaggaaaaccaatatggatacaatctgagtagtccttgtcgttttcatgtagaactctggttgtctttccttatccagaactccctcgaggtcagtttccgtataagacatggtatgtggtgggtcctgccgagatttagtcgaccactattaggtatgtggtatccataaccctgacaaactaggcaaagacccagaagattggcgaactccattcgtgaagtacctcagggatggttggctctcggaggacgaagcagaagcaaaacacttacagctccgagttgccaagtacaaactagtctccgggcaattatatcgcatcggcgtgctacaacctatgcttcgctgcatctctttcgctgaaggtgaggagatggtgaaagaaatacaccaagggatgtgcggtgctcatcaggctgcaagaacagtctcttctaaaatattttgccaaggcatatactggccaactgtgctgaaagtatgtgtggaacaaatcaagaagtgcgaaggctgccaatggcatggccgaagccagacagtgccacagtgtgagctacagctgatcgcaccagtctggttgttcgcaagatagggactggacatcatcggcccgtttccaatggctcggaatgggtacaagttcgttatcatggcgattgagttcttttctcgttggattgaagccgatccactcggcgcgattacttcggcggtagttcaaaagtttgtttgggctgtcaccacctctacacctacctcaacgtactgtgggatacgcagcaattactggataataattacctaaacaccacgtctaagcaattaatatctactttagtgtttataactcaccaaagcaatcactatattttagttgattatagtgaacaataatcccgtatgctatttacgaactaaccaagatataattctcacaagataaatccaaattactcaagaagaatattatattgaattcagagtaataaacagaataaaagaaataggagaagatcaccgacaactccagaattcttccgactcctactcttctctcttcctattctagtatacaatatagtacaatagagcctcttataattcagctcaagcttggaagtgtgtgtatgaagtgaggaagtgaagcctttatatagaggtaggtatgacggttggcgaaggggaaatgtccgaaatgccccgcaaccgccatcagggagtgatctagagcgtccacgccaaaccccacatccaacggtggaggtggtggttcggccgaaccagagggttcgatcgaacctgggctgggtccatctggcctggcctttggcccaagtcctctgtcacgaccggaaataacccaacgggcgtttcttacgtgcgtgcattattccttgtcccaggaggcaaggtacaccaaaagttgatacaattcagagtttaacaagcggaagcgcaattaattaatttattacatgggcggcgaaggcccagcacaccagaagacaaacgaaaaacagcggaagactagggcgacgaccacaggcgcttgacggcaggcacgagctagacaccaaagccttcatcttccaggggctcctcttctgggtttgggaaaaattgagcaagactgagtacaaccaccatactcaacaagacacacccacaagtgcagaataaatgcaagggagtacaagggggttataatataaagggttagggtttgcagtaaacagcattaaaagacacttagttgctcaaagctattttgtaaacacgattctagagctatacaatattattaaacaaggccgtgaacccacacgaacctgccttaacccaaggcttacgatgattcagaccgaactggcaacccgaccctgagtcccagctcgtcccaagccaacccaggccaaccattccatattttagttgttaagcaggttttaagaattaaaaaaacactaacttgggtacattgctcggcttgcccataaccgagggcgcggctattcgaatagattatactctgatcagaggtgtacatttttacccacaagacacatcttcctcacatgtaaccacgtgccacataccactacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatctgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagggggaggtgtgaatccaattccacaataatccatccattccatagtgtccaggtgatgagaatattcccaaagtctagagttgtaaaaccacctaatgttgcctaattaaccagcgaagcatctatctaaaatcatactagtggtaccatgagtagagtgcccactagttggggttttgtttaatctagggtgaacaaggtaataatatcaataacaataataataaggtcataacaaaggtaaataggtgtcgcgtcccaaaacgactctaaaatacatccccgaaattatgcctagaataattaaaatccgtgtggaagcctccaacaattaaaatgtgcaaagttaaaagtcaaataaggcttggaggatttttgtatatttcctaaaagcctaaaatgcgtaaataaattttagtggaatttttagagcacaaataataattaagaagaaataaacaaagttaaaaaggttttataaaaagaaaaaccctaaaaagtacttttccccctcctccccctcttgggccggctcggcccatctctctccctctctctcctctcccccgcggcccattcggccttctccccgcgcgcgtgccgctgacgggcgggcccgcccgccaccctcgctgacgggtggggcccacccgtcatcccctttcttccggcgctcccgccgccttgcccgtgccctagcgccgccgccgccgcgaatcccggcgtcttccgccgtccacgcgcgcaataaagtggggggaaatattccccgtgattccctccctctttccccccatttttccctccctctctccctcggattcgtttggaaacctctcccctaacctcgccggcgccatcaatggtgaccggatcttccacgcccgtttccccctcgtccggcagctccctccccctcccaatcctatataaaccttccccgtgcctccctccaccgtttccgccactcgccgccctttctccccgtcggaatcgagctcgcgccgtcgctctctctctccgccgtcaccgccgagctccggtccgccgccgtcgtcgccccggaccacctaccgcatcggagtcgccactttcggcttcaccgcatccccggagacctcgtccacccaaccgtttcgctcgccgaccgccggagcaccgtcgaccccgtccacccgagccgcgccgccgccttcatatgctccggtcgccgtttccgtcgtcgccgtcgacccggggtgagccgtggaccgccgcttcttttcccccttcccttcccctctctcggccgccgttccgccgtgcctatggccgccgccggtgaccataggggcgcgggcgcgccgcctcccgccgctgcgccggcgtggccgccttcgggcgcaccgtgcggctgccgcgtggggcccggctgtcagccgcccgcgtcctcgggtgcggctgacgcgtgggacccacggcgccggccggtgtgagcccgggtgcgcccggtccaccgtggaccgtggggctgccgcgtgggccccacccccgtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaattttttcttaagaagtcaagaacctatttttgtgctttgttcctgctggttatatggagtttattagagtaaaagccttttcttttccgttggtcgtgtagacgctgtagcttcggaagatccgctcttcgtggaggttgaagccgacgtttgggaaagcgagcaaggcaagtcacatcatccttgaacatattgaatcccagtttataaaattattttgatttaaattaatgcattatcgctttatttaaattcccgcgttatcactgttttatttagccatgcctattgtcacgaccggaaataacccaacgggcgttccttacgtgagtgcattattccttgtcccaggaggtaaggtacaccaaaagttgatacagttcagagttcaacaagcagaagcgtaaatagttaatttattacatgggcagtgaaggcccagcacacacaaagacaaacgagaaacagcggaagactagggcgacgaccacaggcgcttgacggcaggcacgagctagacaccaaaaccttcatcttccagagactcctcttctgggtttgggaaaaaattgagcaagactgagtacaaccaccgtactcaacaagacacacccacaagtgcataataaatgcaagggagtacaagggagttataatataaagggttagggttgcagtaaacagcatttaaagatacttagttgctcaaagctgttttgtaaacacgattctagaactatacaatattatttatcaaggccgtgaacccacacgaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatggattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggtaggtaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaatactccaacaattccaaagtgtccaggtgatatgaatatcccaaagtctagagttgtaaaaccgcctaatgttacctaattaaatagcgaagaatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataattttaaagcaacataattttataaactgggattcaatatgttcaaggatgatgtgacttgccttgctcgctttcccaaacgccggcttcaacttccacgaagagcggatcttccgaagctgcagcgtctacacgaccaacggaaaagaaaaggcttttactctaataaactccatataacaagcaggaacaaagcataaaaataggttcttgacttcttaagaaaaaattagagacttgaacggtccaattccgagttcaaatggccaagttatggccatttgaagtttatatgctctttaaatgaatatttgcgaatttcttcatttaaattttgatttaaaaagagtttattgcgtcagccgagaaggaggggcgcgcggaccgggtccacgggagtggggcccacacggcgaccaccggcgcggcggagcggcggccgagagaggggagggaagggggaaaggaggcgacggtccacggctcaccccggggcgacggcggcgacggagggggcggtcggagcggagggaggcggcggcgcggctcgagtcgacggggtcgacggcgttccggcggtcggcgaccgaaacggagaggtggacgaggttggcgaggatgcggcgaagccgaaggaggcggcgccgaggtgggagttggtccggggcgacgacggcggcggaccggagctcggcggcgaccgcggagagagagagcgacgtcgcgggtgatgngctnctgaaccgtctgtcaatccattnngccag

SEQ ID NO: 60467 - DNA, 1490 bp, Oryza sativa
  unsure (1)..(1490): unsure at all n locations
ttagtaattaaattgccacttaaaccctgataatggtgggttgtgagcacatggttttgatggtcgtgctcatgacaattaaggaccggttcacgattttcagttgtgaaacattaaccgtgccaaccacaagccagcgtgggcaacgactttactttccgtatagtatggttcattgtagagcaccagactatgaagtggcggagataagcccacgggggtcgctggggagtccatgcgttgtttacaagggggtgattatgatccgggaacggtgcattgctttgaattatgttatgcagagggtattgtcacaatctctattcgggtacttgttaactatcgcgacgcatggttgacatgatgttgaggttgtgtcttgtgtgtacagtggtacacctctggccagagttaaactattcgaatagccgtgccagcggttatgggcgggtctaacaatatctttcgtgattagtttcacagttctcaccatattaaatgatgttgttagtaacctgttagctcctggtttggaatggtatattcctggtttggagatagaactgtgcagccgggattggttgttcagaatggttgggcctatgcaacagggtatgttgtatagcgttggattaatactgtttaattaatactctactgttttattaaattctgaaatatttattaaatgctatttatgcaaatgagactatactatgccatcctttgttatcctatgcacttgcatatttgctgcgtggcttgctgagaatgtcatatactcaccttacaatcattcattagaggagttctacagtgatgctgatggtgtggaagattaggcgtagccctggtcaagttgcctgtggagtggagtcgtctgcgctgcttaccttattttttccgctgcttagaactttattgtttgagaggaactatctacctctgtaatgacattttattcgcttattaattagagtaataattgtactctattatcaaattgttattgtgtgcctcggctgattcctggacgagggtttacacacatgtaagcgtttggaattttggatagaaattccgggcgtgacaaatatggagcacaaaaagttagccgatctcccgaagtctattgaagaacagaaagcaagactcaaatcggctatcaagcacgttgctgatctgaccaagtctctgaaagttatccctgtaaccgacgctcaagatgctcaagccatagaaaaagtaaaacagattaggcagaaggctatatcggccatccagcgatacttatctcaataatctttgtgtaataggacttagaaattttgtaattggctaagacattctgatactttactgtcttaacaatccttcgtgctgattaatatgactttgaaatttgctcaaaaaattttgcactacattttgatatatatgtgccccctagtttttgatgnnctnctacggtaaagcactcacggggccaa

SEQ ID NO: 60468 - DNA, 1523 bp, Oryza sativa
  unsure (1)..(1523): unsure at all n locations
cccgaacagacatgttgacaagattatccatatnaannnctcaaaaaaannnnnnngtgatggttaaaannnnnnnnttgtaancaacgcatggactccccagggaccncngtgggcttatctccgccacttcacagtctggtgctctacagtgaaccatactatacagaagggggggtttttaaaaaaaaaaaaaaaaggggccccccgggggtttttggcccacacgctgagcttgtgagttggcacggtaaatgtttcacaaccgaaaatcgtgaacccgtccttaattgtcatgagcacgaccatcaaaaccatgtgctcacaacccaccattatcaggttttagttggcaatttaattaattaaccaatcacgattgaccatcgtgagctatcattaagccatcattaaataatagtgaatcataaactatcccatttatatgagctagtgcctctaagcatggctaagcatcctattcactttaactaaaaccatataatgttctagctaatcaaattattaaccaagtgacaaagaatagggaatcaatagcaaaagggctataacaaggcaataggttatttccacccaatgacattcaaaaataaatgcaatagttgaatagaaacaatagctttaaacgggatcaacatgctcaaagggttgttttgggatctgtgcgacttgccttgctggccttggaactcttcaaaatcttctcctgcgaaatcggactctccgggaacgtcagaatctaaggaaaaaagagcaaaaacaccaaaacagcacataaacaagcatgaacagtacatatgtatatttttaacatgtagatctcaattttagaaaaatttagagacttgaaccaactaaatccaagctaagatgaattagttatgaattttcaaagattaaatcggatgaaatcatttatatagattttaattgaattatgacgcaataatgaattatttttgaaaaggaaaagaggattattgcgtcagcgggctcgggttcacggtggaccgggtgcacagcggcggtctacggaacggacggccgagatctactcgatccaaaacgaacggccgaggtcgacttgatctaccgccggtctatgggaaacggcgacgatgacgtcagcggtgatgtcaccaccggcggcggcttgggcacgcatgctcgccggttgcttttgttaaggactggttgctcgcaaccgaggaggtcgtggagcacgagggagagccacacacagaggaggcgtacgaagcctacctacgctggtaccaagccacgccaaccccggttaacccttttaaaggggaaaggggttttttccccaaaaaccctttgttcctttgacaacagccacgtgggagcactaaaacctttaccccaggcaccgcgaccaggacttcgctcggcttgtgagtaccctgcattgcaccatttctttaactttaatcctttctcttcggcaaatgtggggaattttacccacacattaccatgcg

SEQ ID NO: 60469 - DNA, 1210 bp, Oryza sativa
  unsure (1)..(1210): unsure at all n locations
tcaattttcagaaaatgtntaataaaaaaataccatcttagaacaacccgaaatacttgtatttaagaacccccatatttcgattgttcccacgtttcatcattnnnncaagtgttgtgaagctgtttcccttttggttaactttgtttcttgcttgttcttcgattgcttgtaggttcaagtttgttcttcgggaccccacaaaaccgcgggggggggggccccaaaaaaaaagggaaatacccaaaacaaacaaaccgtggaagtcttgtgtaccggttgctaaggcgcagcacccctgtggtagttgtagtcggaccgccaatgtcgtgtcctcccccaaatcaaagtttattgtagggtcccgaaactaatgattcggtaactgatgtatcaagccctggatcagtaaattgatacagattcaacaatctggatcttcattgcatacatttggacaagatttcaaaggaaatttctttacataaaataatagggtatttataaaattgtggctaactattacaacagaagctatagaatgacctaacaaaacctagcttctaaatcctcataagctagataacaatcaagtgcttctcaaaatcttaggccatgtttggggagctgttaacgaccaaatttggtaaattaagcatcggagatggagttaaaaccgaagcggaatcaaaaggattgacggtttcggaaacagagtgcgcatcggcagagttcgaatcggataaggtggccagaacagccgatgaagccgattccgacaagaaaaagatcaaagtcattatcagattgggttgatatgcttaatgagtattgccacacatggattgagtccgaagaaggcaattgtatctattaattaggatattttatgcaatttccttatattttgagttggtaagagttcacctaagggacttgttcgtatctagaattgtaatagagatagggagtcgtgttcttgacaaaggaacaattaaatttttttaaaatttgggggttttaaaacacccccttttttttttggtaaaaagcaaccaaacccatgaatcagatacaattagttcaacaacactttcggggcattgccacccttttacttttcgtttgtttcgacgagttcttgctttcgagtttggctgcattagtctagatcttcgacgggaggtaaaacttgccatgacgggttgcg

SEQ ID NO: 60470 - DNA, 2071 bp, Oryza sativa
tctgagaaaaataggtttaccattggcccgaatccaacctttcgtggtaaacgatttcctcatgtcttatggaaacaagtctcttaccattaagtatatctacaagtatctgagctcaaagtattttaattaaacggatcttaacatctttccgtctacctgaaaaattttttaccccttttttttttttttgggcccccaaggttggtaaaaacaaattattgtttaatatctcaaatattcttgaattatttcatgtaacggtgtctccttaacctttctgattctagtttccaatggagcttcttgattagcttgaccatcaactacctgaacagactatcaagactttacttccaacattgatgtaaaccactttgcaaccgtgttttatggtctctttctatgtatccttctccttattatcatctgcataattcagattaaaatagtcgtgatgtctacgctcaactttgtctcattggtgtatgtgtaacttgtagaatgacccatatgctatcttacagaaactttgtagagattcgtcaagtctcataccagtggtgtgtcgacaagcaaaccattcttgtcctcgtaccatattagtagagtataaaccttctttagtgctttcaagtaacctctggtgtaggggacttccactacgacattatatatccttgattaattatcacttcgtctttattctcattttcctgagttactataaacatccatttcacagtggtacacctctggctagagtaaaactattcgaatagccgtgcccgcggttatgggtgggtctaacaatgtctttcgtgattagtctcacacttctcaccataataaaagatgctataactggtaataatttgattagctcctggtttggaatggtacattcctggtttgaagatagatctgtacagccgggtatggttgttcaggatgattgggcctgtgcagcatgggtatgttgtacagtgttgattaatattgatgattaattgctctactgttttacaattctcaaaagtttgctaaatgctgcttttgcaaataagccctatattatgctattctttggtatccttgtgcacttgcatatttgctgtgtggcttgttgagtatgtcatatgctcagcttgcaataatcatcaaacctcagttgaagaaaaaggattctgaaggagaagacgtttggcttataccccagttgagctgcctgtgggagtggagctgaagctcgctaggttttatttttccactgcagttttcttcatggtgaggactaagtgcctcttatgtaagtatttattcgctttagttattgatgaatctgtatattaaattgtcagtttgtgtacctcggctgattcctggacgaggattttatgcacaaatgagttcggaaattactagtgaatttctgggcgtgacatccggtcgccgtccgctgccgttcgtgcctcggtaaggatcgccgcgtcgcccgcaacccgttggtgccctccgtttgcgccgccgcgccgtcgtttgccggcgagcgtgcgttgccgagctgcagccgagccgcagccggtgataacgtcattgctgacgttagcgctgacgctagccgtagacccgcgatggattagattgatctcggccgtccgttttggatagggttaatctagaccgttcgttttcgtagaccgccgccgtgcacccggtccaccgtgaacccgagccgctgacgcaataatcctcttttccttttcaaaaataattcattattgcgtcataattcaattaaaatctatataaaggatttaatccgatttaatctttgaaaattcataactaattcatcttagctcggatttagttggttcaagtctctaaatttttctaaaattgagatctacatgttaaaaatatccacatgtactgttcatgcttgtttatgtgctgttttggtgattttgctcttttctcctgagattccgacgttctcggagcgtccgaatttgcaggagaagatttcgaagagttccaaggccagcaaggcaagtcacacagatct

SEQ ID NO: 60471 - DNA, 23839 bp, Oryza sativa
gcggattgggttgaggggggtaattcgtccggtttacatggttaggggtgaagaatgttcggttttgtggttcaggaggggtaattcgatcgaccacggtagttcgggggggtaattcgtactttttcctatattataaatcacatactgcatctccattctatgcgccaaataggatgtattataaaaccatcgatatagctaaatcacttatatcattgcacggaaccagtagaaaaaacacagatctaataacaaggtgcgataatcacatcaacggttctgtcaaaaaaggattcacaccaacggcagcggtggaggagaccttgcttgcctcgtccctgccattggaaaatgccttgcctacctctgttgctgctgtaatcttgctgcggcggcgaggctccagacgccgccgtcgatggcaccgcggcgacgccgacgataatcgccgtctctcttctctgcgtgagtgggggagaaaaatggggactccaattttgaacagttactgggtgtttggctttggacttggacccgcgcagcatcgcagcatgtcagtccgaggcctatcttggattcagatctaacaaaagaaaaccggttcaagtccggttgcctggcgggcccgaaaccccagcaccaatcttgaagattcctacattcctacgatctcaaattcggctgataaaacacaaaaaatcagcaggccgttatatagcaaattcgtaagtttgtttttttaagtatctctacatatgtacttatccggttgcaggttccatctctaccacgtccgcatccgtacacacaatcatcacgtagtttgtgacgatcgacagctcaccgacgcgtcactagttaacactaaatcatacgtgcacactaattagattttgtgcctccaaataccgggtcgacatatcttcagacggataaaattaccacaagtgtttctactgttgatggaataatacgtcgcctagcagttagaactcgggacttaatctagaccaggtcccagggccctccttaccatcctaggtcttatattcctccttgggaagagtgtagagacctacaaaatttacatcgccgacctatataagaagagtaggaagccctcagagggcataaccacaatcagatcaatagatcaatacaccaggaggatacaatccaccaaaataaaagtaaggtatttcctctaatcaatggggcttgaacctgtctaaacctttgtctctgcgcatgtattcacttttagatctcgtgcatagctctataaattaacattgatagttggcattctaggtaggggttgtgtcaaagtatctcgtcgacaagcgcaatggaatcaacttcaagagtcgctggatatttcttccctcgaggcaagcttttcgcttcagtgacttcgatttctttgccgatgactacgtacagcaagctttctctcgccgactcggatccaaaaggcgagttctatgaaccactaccatcttcaaacccaattctcacatttggttattgttgacagtcgttagcaatcagtttcgaccgtcaatattaccaaaatagaggagaactagtgatgcttgcaatgcatatatctattagaataataatattccactagtattgggtatactaaccttttgcagggaatgacaataaagtgaaggagaatcgacatcaactcaaacgataaatcaatcggacgatgtcgagaaccagacttatgcatgaatgggccaagaacttagaattgacacgataaactgggccaaaattcacaagtctgcgaagagaagcaacagaggaggccggcagccgaaatttggctggatcgggccggccccaggtttggccgaaccagggggttcggctgaaccctccttagcgccacccgatccagggcttcgcctggacggtgtggattagcccccaatgacggttggagggcatttccgaccattccaaccgccacaaccgtcattgggaggctataaaaggagttgccattctcacttcactcacacacctcaagcaatagctctttcatttctctcaagtttagtttagtagtatctagctggtggaatagaaatagaataggagtcaggagtccggaagccttcgggaagagttcgggtaaggctctagcagctttcctttcctcttttgtaagctttgtacttttattagaatactcttctttatacatttatggtattgaaatattttccgagtatatgagtacctactttacattatgttcatgttatactgaatatacggctagcttatctgggagatgctttggtgcgggtataatgtttgcttatgcaattactctatcatgacgatgatattagagtatggtgtctagattacgagataacattatttggggttatatattgcggatgagaggtgggccgctgatggtgacagctcagtacgggtattcctccgtgcctatatataatcctaagttaattcccttggaagggtattcctccgtatttagccccggttgtatggtcgtgatgggctgtcgtaagaaactcggcagtcaggggtggcttctcgaagtaccaggagggcatcggatagagggtattagctagtataccagttaactagaatgtatgtatactatgtataattgtagtataggaatagatttcctttctcttttctttccacttagtttagatgacatattatgaggatgagtagttatgcttgtgtgtcactctacccttggattatcttaacccctgctagaatatgattatcacaagtaatatataaattattagctgagttctctctacatgatcttcccacgggataaaataaatacgatacccttgtaatactctcaggtgaaatgttacaatggtatatccgtgcgcttgcggataatctctgtaatcataatatactagaagtatttctgcgccattgctgggaattatatttctagtaatgtcgttaagaaataccaacaattatgaactcctccctagctttatagccatggtttgggaccaatccttctccagacttgaccatgaaaaatctataccaccatctgcgagagtttgagcaaccgtgctcgtgcatgatgatttcaggcatgacacaagaaactctaaataggaagttgttcccgttctctcatagagcgcaaaacaatggtatattatttccatagttagtacaaatggtaattgggaggagctaagagacaaatttttatcttggttttttccctttgtcccatgtcttcccctagagaagagagattctttactttcgacaaaatgagaaggagtctattggtatagcttgggctaggttctcgcttttagtgcgatctaacctagacttgtccattcctgatcatgtgttgctacaacacttctgtttgggtttagacaaggagtttgaccattatcttgacattacggctgaaggatcttttgcccatgaaacactagctagccgaaggaagggaaaccttatatcacatcttagaaaacacttccttcgttgccatatatgagcccctccaagaggtaagcacgtccagcaatgaggtgtccaagcctatacaaattgcatattactctgcgcatccataatacattttgcacatttgcccgtttctagtctaaaattcccattcttgctccttccttttcccatctcctcaacaactccaaaccagagtccccattccatagttcccatttgctcccaatcctaaggttaatgtgagaagtgatgtgagtgagggtgagctagcttggggcttctagctacgtcgtcttccttgtcgcggagacggccacaacggcgacgcctcccatgacccatcaggggcggctgctgtgtcgctgtcggcaacagctgctacaccgccctcaaggttttcgacaagactcagctactgtcgcacgcactgggagctgtctgtgctctactgcctcgcatgcccacaagcacagctgcaggcttgcaatgaggaagaagaaatttgttggttgtttgacttgtttccttgaaataaggtacatacactactagaaaatcgatttttcatggcgtttggaaaatatttttcatggcggccatgtggaaaaaccgccagcgcagaaaatcgtgggggtggggggtcaagggccgccagcggaaacacatcttcgccagcggtctacttaagaaggccgccagcgaagattggatatcttctctggcgtctctcttaagctcatgccaatgaaggtattgtatcttcgctggcggtaaggggatgcggcccgccagcgaagatgtaggtgtctttgctggcggccctcttaacataacgccagcgaagataccatatctccgctggcggtgtggtgacgtggaccgccagcgaagatacctatatcttcgctggcggcgtccttaagcctccgccacctcaaatcattttcaatggcagttcaaacgaaccgacatatgatgaccgccagggaaaatgcgctgaactatatgaaccagctacagtaacctcgagcaccattaggagcatgattttctctctcttaagaacacatatataggggggaaggttttgatcttgaatcttttgaaagatttattgtaccagaggttagttataatttgtcctactctttttgtcaactttttttttcatttttattggttgtatgttgagatttttcatcgcaaaaaatacttgacatggagaaagaaaattattttatatttgttatttggagctcaaaatggcaaactttgcaagaaatattgtgtatgatcgatgttccatatatatatatatatatctagttttcgataggtttatttttagcagatttatatattagttaactgcaaaagaatgagctagctaggaagagaagaagagaaagaagggtagtttggtaattcgtccgagggatgtatgttttatatatgcagatttttggctagctttaattatcttgttcaaaatatttaaactaactaaagttgtattattttttctgcaattaattaattaatgcatagatggtggatagggcatggatgaataaagagagatatcgtgcgtcgtacattgaaggagtcgacatatttatgaaaacagctaagaagaatgctgcatctaagaagaccaaagatattagatgtccatgcgtgcactgcaaaaatcagaaaagttggaacgatccatctgtaattgagcaacacttggtgacgcatggatttgttgaaagctacacaaactggtcacatcatggagagatcccagcaagcaagtgccgaactaggctacagtacgcgacgaagtgttgagctgggacgaggatgtcattgtagtagctgaagaagaagaagaagaagaagtgcatgcagtagaacccgttgatgattatgatgaacttgttggtggcaatggtcagcacaatacagttgatgatgccgatgatggtaatgtcagcgtagatgatggtaattttgcagatttggaagagatgttacgtcatgttgaacctgaggttgttgctgggtccgctcgtgggttggataactttgatgcattgaaaaaggcagcgaatgatcttttgtacgatgagacaaagggctgtgagaaggatttcacattgttgcggacggtgcttgagcttatgagattgaaggccagaaatggttggtccgacagtagttttaatgacttgttggttctgttgaagaaactttttccgcaacccaactccctgccaacaagcacatatgaagcgaagaagcttatatgccctttgtcactgggtgtgcgaaagatacacgcgtgtgttaaccactgtatcctatttcgtaaagagtacgaggatttggatagatgcccaacatgcaagagtagtcgatacaaaacaagccgtagccagtccgagggtctggatgttgcccttgacgatgtagaagagtttgatccatgcaaagacagtaacaaaaagaagattccccagcttgtcatgtggtaccttctggtgaaagatcgtctaaagcgtttgttctcaaacccgagggatgccgaattgatgcgctggcatcacgaaaagcgaaaaaaaggatgggatgattcgacatcctgcagatgcaagacagtggaaggaatttgacagaaagtatcataagtttgcagaggatccaagaaacgtaaggtttgcattgagcaccgatggaatgaatccattcggtgacttgagcagctcacacagcacgtggccagtactcctaaccatgtacaacctcccaacatggctgtgtcagaaaaggaagtatatcttgttgaccatccttgtacagggaccacgacaacctggcaatgacatggatgtttttggagcctttgctggaggatatgcgcgatttgtgggaacacgagatccaagtttgggacgaattcctgcgggagtacttcacgctacatgcaattatctttgtcactgtcaacgacttgcccgcactattttccctattgggacagatcaagggaaagacgggttgcgttatttgtgtggatggtaccgtgtacaggtatcttaagggatcgaagaagctagtgtacatgcggcaccgccgtttcttgagaaagaatcactcgtaccgctcccaagcagaatattttgacggtattgttgaggaaggtgatgccccagaaccatggaagggtgataaagtgttcagaatgacaaaaaacctgaaggttgtttttgggaaggtaaaaaagagggaaacaaataagcggaagagaaatgatgccgaagtgccagcaagccctagcgtgccattcaagaagcactccattttctttaagtaccttccgtactggaaagatttagacatacgccattctatcgatatcatgcacctagagaaaaatgtcttcgatagcaccattgggactatactggacataccaactaagaccaaggatgggctgaaatcacgtaaggacctcgtggatatgcaaataaggaaagagcttcatcatgtggatgaaggtaataatggaaaagtgtaccttccgcctgcttgctacaccttgacaagagaggagaaaattgcatagtgcaaatccctacatggggtgagagtgcctactggcttctcctcgaacattaagcgactagtgtcgatgaaggatctgtcgctttcaggctacaattcccatgactgtcatgtaatgctcacagtattcctcgccattgcaattagagtagttgaaccagttcacgtaaagctggtcatcactaagctgtgttatttcttcaattgcatatctcagaaagtaattgatcttgaagagttaggtcctctctgggctttcgctatacagacagtgtgcgagcttgagatgtgtttccctccatcatttttcgatatgatgcaacacctcatagttcatatcatgcctcaaataattgcacttgggcccctgtacctgcatcagatgtggtcttttgaacgatacatgtccattctaaaaggctacgtatggaaccgcgcccacccagagggatccatgatagagggttacacaaccgaggaggtcgttgagtgttgcattgattacctaaaagatgggaaagcaattggtttaccggtacctcgacatgaagcaagattatctgggaaaggaacaaaagggaagaaaagaatccacgacaatgactacaaaaaagtgaaagatgctcatttcactgtgctgcagcaactcgcaatagtggagccgtacatagagcaacacttgcatgaattacaagcaacaaatgtggggcgatctaatgcatggatcatgaagaaacacaagcatcactttactgaatggttcaagaacctcgatctaccagatggccataccatggaagaaagaacaattaaaatgctgactgacgggccatcaagtgtgtataccttgtggcaagcatatgatctgaatggatacacgttttacacaaaagcaaaagacaaaaggagtgcatgccaaaacagtggcattcgagtagaagcaatcgacacaactgggcaaaagagcacatactatggattcatagaaaaaatctgcgaactagactacgggccaaatatgcagattccactgttttggtgccaatgggtgaaacacccagctggcgtgtctgtggacaattttgggctgacaatagttgactttgacaacgtaggccacaaggatgacccatgggtgcttgccgatcgggtcgctcaagttttctatgtgacatacccatctcatttgaagaaagacatagttatttcgggaaaacaaaagattttaggagttgatgatgtcgaagatgtcgaggcatacaatcaatatgagaacatgacactattcacagatttttgaaacaagatattacgcgtcgaagaatcaattggtgaatcgccgaagccatacataagaaatgaaggtgtagggaaaagtgttagatgctaattcataatatatgtatatcttgttggacgtatcgatgaattttaatgtattataatgcgtgacaatgatggatgataaaattttgtatatggaatatggtgacatgataattgtaggatcaagaaatagtttggtataaatttatttgtatgcatgcattaaaaaaatatcaggcgcaaacattaaaaaaagtaatattttttttgataaattaatcatatatgtgtagaaataaataaaattattttttcagttgagaatgacatgtggggccaaagggttttcgctggcggccggctttgcccaccgccagcgaaaactgttttcgctagcggcccacataagctaccgccagcgaaaactgttttcgctagcggcccacataagcttgctgccagcgaaaacccttttcgctagcggcccacagaatcctccgccagcgaaaatgttttcgctagcggtcggtgcgttcctccaccagcgaagatgtcttcgcctataagtagctagcgcacgcggctgaaaatttcctatgtcacggagtcgcgcgaaccctaaaatttgtgccgccaggctgccaaaatttcgagcgccgccgccagcgataaaactagcaccggccaccgccgccgcttcctcctccattcgcaccatccacttttcggacatagctcctccattctctccacctcctcctctccgctgtctccaccgccgccgcaccagatcctcctcctctccaccggctcctcctactcgggccgccgtctccaccaccgccgccgccgccgccagatccaccttcacctctaacccgccgccaccaccgccaccaaatccagctacctctcctctgccgcctcgtcgacaccgctggtcttctctccgccaccgccaggaccgtcgtcgccgcctctgggacctcctctcggtcgccgcgccagtaccgtcatcgccgccaccgagatctcctcttcgctgcctcctcctctcgaccgggacctccacagtgagcccacgccccctgcctcctctcgtttactattggtcaccgattaaccccctctcctcctcctcagcgccgccgtgccaagaaaccgccgccgcgccgccgtgccgagaagccgtgcgccatgtgccggccgggactcgtcgtcgccgtgcgccgcctcctctgctcatcgtctcctctccaggtacccctctctctctgacgtcgatgaatggaatagtgcagtggatggatgaatgaatgaatggaatggatgaatgaatgatgaactttggatgaacgatgaattttggaatgggtggatgaatgatgaactttggatgaatgatgaattttggtatgattatgaatgaatgatgcagcagcagtccatggaattttggatgaacttttggatgaaatttttgatgaattctatgtgaattgaaaatgcatatgtataattgtgcgctttttttgtcattccgttcagattgttgcaactgttatttaaaacttgaatgtgtagctagtttgaaacttgaatgtggatttaagtgccattttgacatgtaaccattcatggagtgtatactgctttatatgttgttttgttcccttttgctagaactattgaattttgggggataatgtttacatttagctgaaaaaggatggattgatagattggcaacagtgtggttagctaggtagggtagctagctagaaatagtttgtctagctagctagttaggggttatgttcccttttcctataaataaagcatatacagggtttgaagtttagttcaaatggaagaattgaaagattggccgcatatttaatgtagttccgaggttatcaaaccatcacagaatacaaaatgcatggggaattttggtggatttgtcagtgtagtccaaggacggaaccaacctagacaccaaaattttccatgcattttgtattctgtcattctttgataattaaggaactttaggtttagggtttgaaatttagttcaaatggaagaattgatagattggccgcagatttaatgtagttctgaggttatcaaaccatcacagaatacaaaatgcatggggaattatggtggattggtcagtgtagtccatggacggaaccgacctagacaccataattctccatgcattttgtattctgtcattctttgataattaatgatctcaattaggtagtttgaaatggtcagggttggtggattgtaatattgatgtcgttaccaatctcattgattgctttaagcgatcaaggagtttgctagcgataaaaatatttatagttgtagtacaaaattagtatctaaattttgccttctttttggatttacaataataaaatgattccattttgcaactaacataaattcaccttcaagcgatatcaatggacaaacccacccaagagcaacccacgggtgacaagggcaaggaaactcagctagtcatggaggaagatatttgcatgcaagtagtcgcggaggaatcttcgttgtctagctcaagtgaaccaggcagtggatcgtatcactcgtcgagtgacccccatccttctcctgcaaagaagagaaagggcggtagcgacaatgaagttgactccgactacgttcctcccgaaccggtggtacgtagcatataatatatgtttagttccaatcatattaactgcgaactatggattttaattaaagtcacatgaattgcaaacaatagttgaatgctccacgtcgctccaaaaggaaagaccaagccgcaactaaacctgaagctgaagctacagctgtcgtgcgcacaacagcttcaagcaaacccaagaaaaggagggtcgagcgagggaagaacatgctgttgaaggaagtaagcgttctgacgcggatgagtgagataggggaacccctgtcaccggaatactcatgttcgaagtatagcaaccaatgtggggcggtggtcagggatatcgtggagatcacatggaaggattggaagaaagttccagagagtagaaagaacagctgttggacgtcgctgcaaagcaagtttgaatatccagaggggacagatgacgataaagccaaggattatgcgttgtagacaatggggaagctgtggcgaaactagaaaacggacctgaataagaaatatgtccagaagggactcacgccatttaaggctacggaaggataacacaggcccagtgggatgagttcgttgcccttaagacatcggcggaagaaaaggagaagagccagaagatggctgagctagcaagaaggaatgaatatccacatcatttgggctcgaccggttaccggcaagcggtgaagaaatgggcaaaacaagatgaagagatggagaaggctgggaaaccagttcctacgaaaaatcacaacccatgaagcaggaactgggtgcgtgcaagaacaccggtcttcacccctgagggggatgtagtattcaaggatcagaagctcaaggaagtagctgtcaagatgaagaacatcgtcatgcagcaacaggccgggacgttcgtgccagatagagaccgggacgagctgatctatgccttgggcaaaccggagcactctggctatgtacggggagtttcctcaaagactagctggaaggatggattcaaacaggatgcttatacctacaagaagtgtgatcgctacaaggaagagattgactctcaggctagggcagcagctcgtgacgaatgcaatatatactggagtcagaatatgatgcacggtgctgctgttttagagcctgagctgagctatcctttcgatgatgtaacggaggatactccgtgctagctcttgattccggtcggcagggcgggaaagaaaatactcgttgcaactgggaggttcataccaggccgcaggtttcattgccaagacattccggatgactacgtcaaggtagtggtccggacggtcattaggcttaccggatgcacgagctcgactttccaactactgagcagattgtgtaccttggagatgccgtcgaccaattcatactatggcacaagaatgatattgaactagggtcaacggatggaattgatcgtccaccaaggatatcggtgtcaccgtcgcgtccaccagtcgtagccagtccgagggatagtcctattgcttcacgccctagaccagagccactagttgcatcaccttcaggaccagagccaccagttgcatcacctcctagaccagagcctcctgttgcatcacctcggaatgaaaaggatgcagaagaacaatcggtgcttgcaaagcaacaatcacagctagcaatacaggaaatgtctcccgcacaaccatcagagcctgtacaagcagagcctacaaagctagcggcgggtgaaatagaagcggtgcctgagcagccaatgcccgaccaaccagagcaatcgcaatcagagccatcgcaaccagaggaacctaagggtgccgatgtgccagtgatggtaaggacgcacaagcacaaagcaaaaagtgcgtccaagaaacattatatggtaacggcattccgaggaagggacaaagatatcgtaaatgccgaatttgataacagaaaattaaaagggttcaagcagacctttgatgactatctcaactatatcaattccccagacgtgccacacgagtttgagaatggcaaaccattcatttacgactggcaactaagagaaggaccgtagcaactaagaagttggtacgattggtacattagggcaagcaccatgaaaggcatcgattcattcacagttgccgtgggggagaacatcttctggagcggtccttgtctactccaagcccatttctccgatatgcattccctctaccgtaggaagaggccggacgccaatttgattgccatctggtgtctgttgtcacgaccggaattgacccaacgggcgttccttacgtgcgtgtattattccttgtcccaggaggcaaggtacaccaaaagttgatacatttcagagtttatcaagcggaagcgtaaatagttaatttattacatgggcagcgaaggcccagcacatacaaagacaaacgagaaacagcggaagactagggcgacgaccacaggcgcttgacggcaggcacgagctagacaccaaagccttcatcttccagggactcctcttctgggtttggaaaaattgagcaagactgagtacaaccaccgtactcaacaagacacacccacaagtgcaggataaatgtaaaggagtacaagggggttatgatataaagggttagggtttgcagtaaacagcattaaaagacacttagttgctcaaagctattttgtaaacacgtttccagagctatacaatattattaatcaaggccgtgaacccaaacgagcctgccttaacccaaggcctctgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgaggtgtacatctttacccataagacacatcttcctcacgtgtagccacgtgccacataccaccacggtatacggacggaagacgtgacatactttccgacccatcctagccatagacaagagtaccgacccaaccccacctatggccggaacccctgggacaggtaggcaggactgagcccctagcagcaggacactggccctgtgccatgacatctcgactaccgggccgcagctcgtgtagccttcatttgtcctagagatgtccatcgacctccgacttcgtccatctccatccgtgtacttttgtttataaccagactgagccacaaactaagccttacccactagacatgtggaagtacggtagtgctttgcaatagaggcccgaagaccggtccttatatggccgaggtgctactatcaaaaccatgcaccccgagcccagcctaaaaccattttggggattttgaatagagggggcggtgtgaatccaattccacaataatcaaaccattccataatgtccaggtgatgagaaaatcccacagtctagagttgtaaaaccacttaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacacgggaatttaaataaagcgataatgcaataatttaaatcaaaataattttataaactgggattcaatatgttcaaggatgatgtgacttgccctgctcgctttcccaaacgtcggcttcaacctccacgaagagcggatcttccgaagctgcagcgtctacacgaccaacggaaaagaaaatgcttttactctaaaaaactccacataacaagctgaaacaaagcacaaaaatgggttcttgacttcataaggaaaaattagagacatgaacggtccaattccgagttcaaatggccaagttatggccatttgaagtttatatgctctttaaatgaatatttgcgaatttattcatttaaattttaattaaaaaaaggtttattgcgtcagccgaggggaggggcgcgcggaccgggtccacaggagtggggcccacgcggcagccccacggtccacggtggaccgggcacacccgggctcacaccggccggcgccgtgggtcccacgcgtcagctggacccgagggcgcgggcggctgacggccgggccccacgcggcagccgctcggtgcgcccgaaggcggccacgctggcgcagcgacgggaggcggcgcgcccgcgcccctatggtcgccggcggtggccataggcacggcggagcggcggccgagagaggggagggaaagggggaaacgaagcggctgtccacggctcaccccgggtcgacggcgacgacggaaacggcgaccggagcggaggaaggcggcggcgcggctcgggtggacggggtcgacggtgctccggcggtcggcgaccgaaacggagaggtggacgaggtcggcgaggatgcggctaagccgaaggaggcggcgccgaggtgggaggtggtcggggcgacgacggcggcggaccggagctcggcggcgacggcggagagagagagcgacggcgcgagctcgattccggcggggagagagggcggtgagtggcggaaacggtggtggggagctcggggagggtttatatagggttgggagtgagagagggcggccggagaggtggggaacgggcgtgggagacccggccgccattaatggcgccggcgaggttaggggagaggtttccaaacgaatccgagggagagagggagggaaaatggggggaaagggggaggggatcccggggaataattccccccactttattgcgcgcggggacggcgggaggtggcgggattcgcggcggcggcggcgctagggcgcgggcgaggcggcgggagcggcgggaggaaggggatgacgggtgggccccacccgtcagcgagggtggcgggcgggcccgcccgtcagcggcgcgcgcgcggggaggaggccgaatgggccgcggggagaggagagggagggggaaggagatgggccgagccggcccaagagggagagggagggaaaagggactttttagagcttttctttttataaaaccattttaactttgtttatttcttaataattattatttgtgctctgaaaattccactaaaatttatttacgcattttagacttttaggaaatatacaaaaatcctccaagccttatttgacttttaaccttgcacattttaattgttggaggctttcacacggattttaattattctaggcataatttagaggatgtattttagagtcgttttgggacgtgacatctgtaagtgctacacttgaacgtgttaatagatcactacacctatatgcgtagctcatttgatatccattgttggcaggatgaattacgtggaagccgaagcgatgaaaaagcctgtcgcctacctaaacccgtgcaggataagtaagccgaaccacacatacacggtagacgggaagaagctaccggaacacatcaaggcgatgactcccgaagagaggaaagcttacgtagcacaaaggcatcatgaaaaggtgctcgatgtcgctacgtacgtagctattgcgcttgaatctacgcaggacaaggagtgtgtttatgccccatgtgcctttgagtaagttgtaatatatatgcactgagagtatatacatataatcatggctcgactaacaatttcgtttgcagcgaccattggatagtctttcttctctatccaaagtacaatgaagtcatcatcttggattccctcgacaatgatagcaacacctatcaggaatttctaagaattcttgatctgtaagtaagatattagcatgacgtgttttaacctctgacgaatgtaaattaattatatctgcaaacagtgcttttaaaaggtattaccagcgaggcggacaacgcaaaaactcaagagaacgcatattcgtccgcaataagtggccggtaagtacatatggatgccaaacagtactagttaattttcataaatgcttgtgtgtttccatttaataacctaatataccttataatcattttgatgttgaaagtgtcacaagcaaccggtgggaacagtattatgcggatattactgctgtgagttcctaagggttaatgggaaatattgtgcgaattacaacgaggtaagtaattacttgttaaattagtcgctaacttgtattataatacacacttgttaaattagtcgctaacttgtattattgttaataattaatttccttaattctgtcatgatctgatgcagcttccaaaattccccaagtctgaaagacagctcgatgatacttccattcagaacattcaggcagacatgtgctacttcatccaccttgagtgcgcacatcagcttaggcgatttttcgacaatgaaggagtcttagccctgccggagaatgaatccctgtctaactggaccaggcgtataatatagctaggattttgtaattcattcaaaatacttgtaaatgttatgtcgtcggtcaaaattaatttatcaatgtacatatatatatatatatatatatatatatatatatataggtgtttccgaattactatatgtatattattctacttcatactcaatgtgtggctctaacatacgtgaaagagaacatactctatcgatagctcgattagttatatcaaccacgtgtgactctgaaacacgcgcacgaacaaaagaaaaaaagtatatataataatgttttaaatttttttaaaaaaatttgcatcttcactggtgggccacatgtcagaactaggacggtccatatcttcgttgtcgggccacgtgtccatccacataagccttagtttatttttcctagcgtgccacgtggcctaaaatactgtgagccgccagcaaagaattatcttcgctggaggccgtcctaaggctactgccagcgaagagttctctttgctggcgggcgttcctttcttgcctgccaacgaagatgcgttttttctggcggtaaataaccgctagcgaagatcgacatttttattggcctttgctttgtggcggctgcgattttcaccagcggaaatccaaaatggccaccacaaaaaatggttttcgtattagtgatagtgacaagtatcgatgtgttctcaaatcacaccataaagtttcaaatccgtcgaatcatagtcgaagttgtcaaaatcgagttccaaatctatatatagagaaattaattaagtattagcctaattttttttttaaaatcaattaatatgatttcttaaagcaactttcctatagaaaacttttaaaaaaacgcaccgtttaatggtttgaaaaacatgtgcgcgaaaaaagaggaaggtgggttaggaaagaaggggaagaacagtcttacatacgtaacaatcctttctctaatctaatctgttcctcatctacatgctataatgcattcaaactctgttgcagctgtactagtacacaaagcccttatggcagataaatttggaactctttgcttcgaataaaaaaaaatctgagaacactaacacagattgcacatcaccgatcgaaaataataataataataataatacaagggaactatttcaattcccatcctatattgctgccttatggaaagacctcgataatggatcgaatgcctaacacaggactaatcttgtactcagtgaacccggcctcgttgaatatcttgaaccactctttctcatccctctccatgcctggtgttagcatagaaatggttagatcaaacagcagttgggttccatagcacattgcttgggaggaggatccaaccacaacatcaatgataatgactttccctcctttatctttagaaggaattgcctccttgcatcgttttaatatctttacgcagtcctcatcactccagtcgtgtaggacaaactgtaatcaagaatatttgttaccatctaaatcactgtactaagttcctactgcctaatatatactatacactactacaaaacccctcgtagcactagtgaagaaacaatcttttaacaccggttgaaaaccccctttagtaccagatatagcaacagtgataagcaaattaggactaaagatcttgatctttactgaataccaagtaaaaaaaatgagtggtatatgggattcgaactcaagatctcccacctcagccctcacgcgtgttaccatccaccaactacacacatctaacatagatagagatgctttcttttcaaactaacctggaggcatttttagtaccggttagtaacaaccggtactaaaaatttctttagtccgggttggtgttaccaaccgtaactaaatttaaatttttaattcgggttactattaccaactgggactaaagatcctccagcattcatctcggttggtaacaccaaccggtacttgagtagtaccagttgttaacatcaactggtacttgtttagtaccggttgttaacaccaccaaccaggactaaaaatgttttcagggactgggacttttagaactggtactaaagtatttttagtactggttcttaatataaccaagatattttttattttgtctaccacaacgaaagatcagttcttcagtagtgtaggtatcgactcataggtgtcagtttatttagaaccgacacctatgaacctttcccacctccacgcgatcacatatgggttggtttttagaaaaccaactgagccgagccatccttatccggccacccatccttatccacactgatacaagcatatcccacctctcggtttcttcctttccatctgccgccactcccctcttcctcctccctttctattcgctgccactcttccttctcctcctctccctggtggcgcccgtccaagctgcgctgcccctcctccacctcaccgcctccgagccgcgccacgtcggatctggccgcctgtaggtcaggagccgctagatccagcttcctttaggtcggtgcttgccggatccagccacctgcgacctcaccgtcgtggatcaactcgtctagctccaccgcgtccatgttatagttgattcgagcatcaatacaatctttttttttaaagattataggtgtcggttgaactggcaccacgcggatgggcaaaggtgccctaaattggtattggttgggcaagcggctcctataaagggtttaccagggtttctaaaccagcacctatggggccttttgtagtagtgataaaaaatgttgtcaaagcaacaggagggcatcacagatagtatgttgcatttgcattgcatattgctaagacactgaccttaagcaggagggcatctgcttgggggataaaatccatcatatcgcctgcgacaaactgaacaacgtcgccatgatcacaggaatggaatcgatcacgtgaggaaggtccagcaccgtgcacttgatatgcgggaacgcagcagccaccgccctcgccgccgcgccagtgccgcctgcgacatccacaagggaggtgatcttgtcgaacacctggcgtgcgccacggatggccgcgtccatgatgaacgccgagtcggccgccatggcatcgttgaagaaatcgccgagctccggggcgcgcctgcaggcgccccacaatccagcgccgtgcgccatctcgaacgccgtctcctcctcgccggtcttgagccactcggccatgctcgtggcgggcgtcacgcagagcggcgagtgctggaggagcacgaacggcagaagcgtcctgccggcggtgacgagcagggacgacacgggcgtgaggcggtagtggtcctcctcctccttgacctgcgcgaagacgcccgaggcgaccagcacgcgcatgacgcggcgcaggaaggggagcttggtcgggtggagggacagcgcggcgtgcaggtcgtggagggtggcgcggccgccggcgcggtggatggcgtcggcgacgccgagcttggcggcgcacccgagggccatggacctgacgtagcccaggctgtggtgcatcagctccgtgctggcttgcactagctgctcgtgctccatgatagactaggcttgggtgagctagctgattcactggtaagtgaaggctcgttcgttgtatatggttggtacgtggcctcgcattgctatcgatgtcacactacaaaattccttgtctgggccaggactgtatgagcgactgcttatcaggcatccttcctaggatcgaccttagcctcacattactatcggtatcagattatcaaaaagacaaaactccttgtttgaacaggaatatgtatgagcgaataatttggggcctttcatttttttaggtcccgttcgatcgcccggtcacttcacaattcttgtgggtaatgttccgatcacccacttaggattgcctcgttgatgggcctggcgagatgtaattaaacttctcttgatgtttttttttctctcctttgttttgtggctaggagagccagcgctctacgtcgtattttcttctacgttgtaattcttttgtatgttaggaaaaaaagtatgagcagaagggtattatactcatttctgtaaagaatatatctgtcaaagcaagaccaactacatatatagaggacaatagtgatgggcagtgaatttgccactccatccgagcatgctaactcactccagtcattgggaggtgatcttgtacgtccacgtggaagctgaggatcaatgactcagattggggtttggccgaaccttagctgtcacctcagcccgtgggcttcctcgttcgtctatcccgtcactacctgttaatgtacattgggagttactccctccatcccagaatataagccctctcgaaattcttcatggggattaaggagataggatggaattaaatgggatggttgtaattggttgagatgagtagtagtaggtgaagaaataaaattagagatgacgtggttgattgagataagcaagtgagtagaaaagtagctacattttgagacaaaatttaacacttctcatttgtcatatcttcttttgataaagctaatgcccactcaacacttaaatctcaacatgcaagcatagtattattagcactcctaaaacttacatgcaagcatgccacatcaacttattaagcacacaaagctcaacgtgcaagcatatagtaattatatctacaatttattttattttaaaactaaacatacacatgctaaatcgtcattctcaaatcattttcataatatttcaatgcaaatcatttcatcatttctccattatcaaatatatatcctgcagcaaagcgcggggcatcatctagctacatgtatagatgatgttggttgacatgtcaatttttggttgtgatgaatgtgtagatgctgaagtgacagtttgctggacttggttttattttgtgcacaaaataaatagtatatactttgtgtgattgtctttttcatagagtaaggaagcaaacagttggcgttatttttttaagaagaaatcttatgttcgtgtggctaggaacaaccttttcttgtattggtgaaattgtggctgcactatctcgaaggtctcgtaagccaatatccacacatctgaatatgtgagtttatttttcgtagagattttttatggttcaggattttattgatatcatcccctctcgagcctttgttaaaagagggcacactttactctccaccttttggctgagttaaacttatggagaacataaaatggacttgtcatgtgacccaatttcttcatatttatttccttggacacatggattgatcctccaccaagaagattggtccaatatcttgatatctgtttccttagtcatatggattggtcatccaccaagattgacccacttggcctagagtattttctggcttacttcttacttgcttctagtcacctttcatacgtgcatcaaatacaaattagtacccttgaataccacgtacatctcatttatggattttacttccaacattttatcatcttgatgaggagtatatttatcagtctcataatgtgtgttgatatttcttaatgacattactagaaatataattccaagcaattgcgccaaaatattattgatatatttatggttacatatatgatccgcaagtgcacagatataccattgtagcattttacccgggatcaatccaaggtattttatgtacttaatcccaaggaaagatatgataagagagtactaagctaataattcatatattacttgtataaaccaaagtctaagcaggggttagtcaattcattagtaggataaggttgacacacagaagaaagaaccaatgtattcttcactaaaatataatctaggctaagtggaggaagaataaaaaaagaatcattcctatacttcctgtatataggtaatttagtttacacttgctagtatacaatcatgcaaccaataccccgtaattatgctctcctagtgtttcaacagaccacccctgat

SEQ ID NO: 60472 - DNA, 10872 bp, Oryza sativa
caaaaacatgtttttctcaaaaactccaaaaattatgtttctcccaaaattcatctcttctcccaaaactcatctcttctcccccttttgacaatgatttcatcaagcatagaaattatgttcattaaagtataagagcttatcatacatatggcatatcatgtcatgtgttgcaataaaaagaagatgaaccaatctataacataacaagcatgcattaaagtataatcataaaccaaagattttataattaagcttgaatcaacaatcaaaattcatgatttcgtacgatttataatgcaacatcttaacaagcacataggttgaaaaataaacactaaacacatatacctattgcatttatcactctttctcaaattagctctagcacaaaataagagaattttttaaccttttttttcaagcctttttgctcatatttttctctcttattccgggtacgtccctgtcgtcaagactatttccagggattcggcacccattattttgctcacatcgaatacgtcattgtcgtcaagactgtttccaaggattcggtattcatttttttcatattttttattctcttttcacaatgagcaattaaagctatttgaggaataacaattcaataaagcatagatatagagcatttacaaataaaaccatatgctagcatcaacattgcatatttacttaattcaagtatagaatttaagtgtcatgcatcatctcccttaaaagtaaaatctaaatctcatgaaaagactagaatatatacaagctatgctagagacaaataaaccttcaaagtattgctagcatgcacaagaaaataccatatgtatagaacaaagctctcttttctcaattttttcattgtcatattattgcttgataaaaccatgaggtacatactccccctcaaaccatgccaaaagaattcacgaataagaactaactccccctcaaaataacctccaattctcttcgagcaaaaatcaagaagaaatcaaagattttgaaacaaacatccaatagccaaagatatcaccaatactttcaaaattgacatacatccattagtattaaccaaagctactatctcaaatactagcatatgaaaaagctaataaactagagagtagaacaaaattatgtcaatccaaaagtaaagtgatgttacctttcaacgcaatcgtcatctcaaaattgaacgcacatggggagtatgccaccaaaatacctacgaacgagaagatgtcgaggcctccgtgttggggttagaaataagaaattttggaatccaacactgagtcacacgaccagtagaaccagtaggtacaaatgcactaacaaaatcagaatcagacttacctgaaaacttaccttgacgcttcacaaaagtctgatttgaattatgcgataacttgccccgaggctggtctgaccgccgctgagactgcgatatgacctggcctggtaattggtctgaccgcccgttcacctgcggtttgaccgctggccggtctgaccgactggacaatgtcggtctaaccgtgctcctcgaattaaaacctgatttttgccaacgtcgttttgcaaaagcaatttctcttttctttttctatttatgggcagatctaaaacaaaaaccaaccaaatgtccatcttttccacaataagaacaagtgtacttctcacgacaagtttgtgaagtagatggttttgaaattgatggttttgcaacacaagtattaacagaaggttttgcaagcacaacatttgatttcgaagaagatgcattcaaagaagacatgatgccggcagatttaaacacaatattcttaggctcagattcaatcaaaatttcacctctcctagcaacacccaaaacagtaggaggatgtctagtatgatgatcataagaatcaaaacctaaaccacggttgtgcgtgctaactttggattgatcaagaatcatattgaggttctttttaccatcagaaaatctttccaaagaacttttcaaataagaaacctcttgtgtaagaacaacacaatttttgcatgcatccaaaagacctttttgttttctacaagttgagcaagaaaacacctcatcttgtttaacaatttcttccatgtgattaacacgctctaaagcatctttcaacttcaactcattcaaaccacactttgaacaatattgagaaatcaaagcaccattgttttgttttgccttatttgcacatgaaacattgaccaaagaacttgcacaaaaagcaactttgtatttttccaaaacgttctttgtcaaaatcaactcatcaacaacacgagcatgtaaagcaaatccaagagcaaaagaagactccaaccttttagatttttcaatctcaaattccaatttcttgcaactaatagaattgacatctcgcaaagcattaatttcagaaaataaaacttcacaagattgacaattattagcattaggaatcaaagattttaatctagcaatttcagcattaagaatctcaatagtatgatccttctcatcaagcacaatagaacatgtttgaagtttcttagcaaatttataagcagcatattctaattgatcataactaagcttttcttcattatcatcatcagattcatcaacaccagaacttgcattacgagcaataaaagctagatcaacaacttgcttacctttgctctcatcttcatcttccggttcatcaaaaacttttattaattcttgaattagccactgcatgcaatgcttcttcttctccttctccttcatgttcttcttcttgttcaagtcatcttctttgactcttacatcatcttccttcttgcctctcccaagcttaggacaatgcgagcgaagatgatcaagtgcaccacacttaaaacaacgattcggtccacctcttttcctgttcctaacattattcatagctcgagaaaatttgttagatagcaaaaccaagtcctcctcgaactgttcaagttgatcgtcgaacatggcattaaataaagcaagaacagaagacttcgatgaagaagcatcaacatccaaagaagttgtagacgaaaccaaagcactatacttagaatcacctttacgagaaagaatattcatctcatgagttttcagtttagtgtaaagcgaatccaaagtcaaagtagacatgttaacagactcctgaatagatgtaactttcatctcccaaatagacatgtcaaaaccattcaaaaagtgacgagaaatctcagattgtggataattagcatcataagaagaatcaacagatctaagatcactcaaaattttattaaacctagaaagatagtcatccaaagcttctccaagtttcatttcaaatttaatgtactcctttttgaaaagatcacgacgaagttctttaatgttatttgtaccttgatgaaaatttctcaaagcaatccaaatctcatgagcagtttgaagatgagcaacacgatcataatccgaacgagaaatcccactcaaaagaatattgcgagctttgcaatttagttcaaaagcagttttttcagcagcagtattaatagcttcaggaatcacataaggaagagaaacttttctccaaatatcataattctcagccataatgtaagattgcatcctactacaccaatgagaaaaaccgttctatcgaaaacatgaggcttagttgtaaacttattagaagcagccatagcaaaaactttagatcgattaaaatccaaagaagcaaacaaggctctgataccacttgtaggatcgaatcacaagaactaagccaaccagagggggggtgaatggttgatatacccaaaaaccgaaaacttttagcggaaataaaagttaccctcaaaatcgatggatcgtggtctgaccgaagtagatgcaccggtctgaccacctggttgccgtcggtctgaccgagattcaatctccggtttgacctccaagatcagctgccgcttgctgtcgccaccgccggtctgaccgcccgtataccgccggtctgaccaccgcttgtcgccggtcggaccatcgttgagtcgccggtcggaccgccgcacccgatgaaacacacatcgaagaactctcaaagtagatgacaactttattacttctctctgtgtttacaaagtgcaacaacagcactccttacaaaaatctcaactactcgaaaccctaactaaactagcaactcaattgctctaaaaaacgatacaaaagcgataccgtgaagccccacgctccccctctatttatacatgaggtaggcagcctaaagccacgaaccaaactcatactaagagtcctaatccccataggaaacctcctagtacaagaaacaaactctacataaccaatcataccaaatttggactccttccaaattcgactccgcatcccatacgcacacaatacctccatcgtatgccatatggaatctccataaaccacgtgcatcaactctagccttagtatcccgcatgatatctgaccaccacggacatcgtcttaccaccaagccgactcccggtccatcaccgcaaatactctcccgaggcatcgagtcacctacacatgaaacaaacaaagaaaccatattccgagaccaagctatcaccaacttgactcattgtattgttagcaaacaacagtattacatacgtatagtatccatctagaagccataaccatgaaacaaccacagatatccaaagaaacaacccgaaaccgaaaccgacacagcgtcggccggtcagaccgcgggccggccggtctgaccggcaaccaccgcccggtctgatcggtcccgacacacctgaaaatcaattatctccaaaaccacttcaacagtaatctccaaatatcaaaaccaataatcacagatgctaattgttcgtcaccgaataagaatcaaaacacacgttgatcttacagtaccagcaactctacattcttgaaattcacatcacttcattgccaatatctatactccttttaaaagagggcaatggtggtgacagtgaatctgccaccccactaacttttgtatagagtttttttaaccaactactccttcatgttttttaccaattactacttcatgtgctttaatattacaaaaaatttcttcacaattattcgtataatacaagtttattatacaaagacattaacaaggacaaaattgtgcaaaaacatcacaattaatttgttccaaacaatattagcacacgcataatttattttaatccgtagcaaaacacaggtacttagctagtaacattatatatttctttgtaaaaaaagcagaaaggacatcctcgcatatatattatagagaaaagagcgatatatagtgcatacatgaagcacaagacaatgataaaagaagacaatcatacccaagactgcgaaaatcgaaactggggtatttgattcccatatactgggaaacctatggaaatactttgataatggatcgaaaacctaacactgggctaatcttgtacttagtgaacatcttgaaccactcttcctcgtccctttccttccctggtgttagaaccgaaatattcagatcaaccaaatgttgggttccttggcatattgcttcagaagaagatccaactacaacatctataatgatgatctttcctcctgcatctttagaaggaataattgcttccttgcaacattttagtatctttatgcagtcctcatcactccaatcatgtagcacagactataatcatcaagaattaatgttatcatctaaaatgtgttaaattttgtactagcttagcttgctatccaatacacaaaaatttgttaacaacactacattatatatattggatatatataactgaccttaagcaggacggcatctgctttgaggttgaaatccatcatatcacctgcaacaaactgagcaacgtcgctatgatcagacgcgatggaattgatcacatgtggaaggtccagcatggtgcatgcaccatgtctcctctggttaccaatcgtgcattgtccagttgaccttgccgagaaggctaacccctgcatgcgaattgaagaacacaaacaagaacaaggtagactataactcaatttgcagatgaatgattaagatctcacaattggggttccacaaaccgaactaatggtgaaactgcaattacataaataatctaagcaaaacccaactctaaattatgatgactactgagtaaatatgattaggggtgttctagggttagccctaggacgtccagctattgggtttagcccacaacacaattacaaagtccaaggcctaaatcagactcgaactggatgtgatacgtggcttgttttacagattcccaatagttgagatggaattttaacgtgggaccaaaagcatcaaaaagtagactacatcagttttccaacaagtactcatgagccctgaaattccttctaaatcaacgacggtccgtttgaatttgatgttgttaggatatccgaatccgaataaaaaacgtgttgaacttcatcttttgccttgtatggaccaaaagtgacgcggtaatgatggagtacacttggagaaggtcttgtattggtccccaatcaattttattgatcatccgagcacttcgtgagtccgttgttcattccttgacccatgcaattatttttgcgaacgagaagatgcaaaactcatagcgcaataatgtttgttcaaatatatagcacgtaaatctcacatagaaagcatgcacctttggtcgatgcatacataaggtagtcatgatcatatctgagctagctagtgatgtcctcatcaacaatgaaagctctcctccaacaccgccaacgctgagggacactctccagcgaatcccctcatcctcccctgccaagctcgctctaaaactagtggtcagttattcctcccacccaccaccgtaccaccacaacacctcgccaatgacgaaaggcattaatgtagtgctaccaccccacgcggtcaatctcctcactctcccattcatcttgctttgtctatgtcaccaacaatagcacaccgctcgttgtcgactcctcccccaccctacccccaaaactataaacctaaccctaaccctaaaccacacccctaaccggcctaaccggtgcttgtcgtcacgccctagggaccatgcgcatgacctagcgttgatgcaccgatagacccccgtataattacttatgatactcttcgattccaccttactcttatcccttatcctctcccacatctatacattattagttcttatagatagctcaacttactctaccatagcatttactgaatctgcatgcctaaaatcgaatactgaagatcatttcagatctttcagaaccatatcttttttgacaattattccaaggactcgctaaatcttccttactgatctgtttatgttctatatctaactacaaccatacgttctgcagatacaatcatggattcaccaatattctatgtgatcatgttggacgcaacaaatcaagactatctggtaaatttaggtccaaataccttatcaccctgtacagtctcctgccaaacacccataataatacactactcggtttgtacagccggtgcctcttacaattagaacatgtcacctataggcatgcacacattctaagcttagtcacatcacatggcttgaagataaaaaccaaagtgagagaagcatccaacatgctctacatgacaacaggatggaagcaattcataaggcaactggattaaaaatcggagaaaaggttgttttcagactgttatcatagtcaaagctgcatgttatgatacttaacaaaaaaagaacccactagatgtccagtcacaggttaccccaacagcccaccgccggtgaagaagggattagttcctagaacaaatcattctgtccaggggcggagctaggtaggagaggggggccagggtgcccaagaatctggtcaagaaaatttttagctatagttcatctattttcaccatatgtgcacccctctcaatccaatttcaagcactcatatcagcctaaatttaatctaaagtagagtaaagcaagcgagtagcacccttctccattccattttagctccacccctgattctatcgaaagaggcacatctcgtatctcactagacagtgacataggtaaacatcttacattttcaaatttattcacttcacctataactttcattatccgttcatcattgtttcgcttacagatacaacctgcagattaaaccgcgcatgcaccaccacatccacacaagacaaaacacaatattgaatcagctcctataaatccaggtacttcaattactgtttttgatgatattgttaatgccaaaatttggtaagcccctaggagaattatcacatcgccaatagtcagagtcctgctatattcggttaaggaaattaatctatcaaaggaatcttatccagaagtgaccgagttcaagaaggatgcggcatgtcaagttatctattaattaggaatagttgttaagttccttttatatttaagaaagtgtgttcagtgtcctataaggactttatgttttccttttatctttaggaaagtttctttcttctcctacaaggactagtatctacccatgggtataaatatgtacacccggggtcattgtaaaatatctctcgatcaatacaactgctctcggcgcaccgccaccctctttcccgaggttttacttatcaaccggcagaatttggcacctgacgcggggctgcatctgttcagttcgatctccggcgaaggggtaagtcctacattccaccagccccagtgaatctatcggctacattgatgttgttcaaggttgcatcgcttcgatctcttggatcgctctggtttggtcgatatatttgcctacctgatatctcaattctatctctaattgcattgtatttagagacacatcggttttgttggaattgtctcagttaggtccgatcttctgtcttagccgatatatctctacaatcacaatgctgttataaatagatttgctatatccatcacattagacagatctattggctcatcgagtattagattaccacatataatctcatgctgcatcggttaggtctgacctactagattgttgttgataatataaatcttgttaagctgataggttcatgctagtgttttatcggggtgctagccgataagttatctggacgttacatcggtttataaggatatacatataagttggatttagccgatgacaacaaaggtttcattgatctatctaatcttgtggattttatgacatccgatcttcagccgatgtatgctttaacctttggatcaaaacttcttctattatatcatactgctagccgattggtttctactggattatcttgctatactattgttatttatcatcatcagctgatcgcctttatatcattatctacattggacatatagccgatagctcaaaaccctatcactatcggctggtatcggcatcggctggaattgctccatcggcttgtcagccgatcggctcattgatctgctatttgcatatcttgtcagttgcaggatcaaactgactggcacgcttgcatctcaccaaactttggacctgcactggagctaagcagatctcccaggccagtgtgtgttttttgcgtcaacagatatgcatccatatttcctttcatgcacactaaaaatacttatccaccttttttagaaagcaaaaaacaagcacagcctgaaggatatgtgcttttgcagcaagaacgtcaagctttcggttgagctgaaaactatgtcaaagatattgcagaattcctgcaccactcaagcaaattctatattgtcgctatgaacaacacattcatgaaacaagacagagtggtcaaatccttcacctactactaatctatttatagccacaataaacacctaacattcaattttcttgacagtacttcataaaagaattttcgaagaaatatgtagagaatatgggtaccggatacccacacggcctccatattcgactagagataggaggtgggccagattcatatattatgtaatagagtagaactcggttgctatgttatcttgtaccttaaggcagggtatagagccccgacaggtactaccatgtaatagattagaaaactgatgtcgtttctagctaggtttctacttcgtaaccctgccccccaacctatataaggcaggcaggaagccccctccaagggcacgaacacataatcacacttgagatcgtcagatcaataccacaattgacggaatatttccccagacaagagtagggtattacttctcatcgagaaggcctaaacctatataaaccctttctctcataacccatccacttttatatagcttgttcaccaccccctttcaatattgctgaaatctagtttcgacaaaatacatagcaaaatcttgtgcaaagcaagacagagagcattcaagtacaaactgcatgcaggaggcccctcaaccgccatgcttcttcacaaaccaataaatggtttctacaacctcacagcaggatggacacattttgcagcaaccaataacatacaactacagacgatatgtatcttccacttctacaaaacagatcgattgcaggcaacaatatatcttctgtgaaggttatttcgatgccttgtgccataaccatccatctttgccatcaaagtgcaatgccaggct

SEQ ID NO: 60473 - DNA, 8699 bp, Oryza sativa
tgacgggaacgacgaccggagggaggcgaggcgatggggcggcgttccaagagtcttcgggcagcgaggagacgtggtcgatgatgaaggtgacgagatgaagccgacagcagcgacggcgcagtgaggcaatgctccggcgaggagggagggctaccagagagcaaggatgaaggctacatcaccactgctcaccagcgaggacgagtttccggcggtctccaggagaaacggaggtgaggccggggaagaggaggccgctgcgaagccgatggtggcgacgccgggctccgatgaggacccgaccgccggcgaggggcggccggagttgcacgacagcggcggcacgggaagaaggcagcacagcggccagggagagaggaggaggagggctgcggtgtgtggggagagaggaggcggtcagggctcccttttatacgccggggtggaggagggggatggccgggagaggaggggaaagaccagggagctcgctggccggtcatcaatgacggccacaaattttactcttggttgattatccaaaacagggtgtggactgtagatagactccaagcgagacagtggccaaaccaactcctatgccttttatgccgctctgtgccagaaacggcaatccacctactagcccactgtaggttgtcgaagagaatttggagttcaattgaagcctggctgcagtttgatctccacctctctgaatggaccaacttcctcactgtgcacgactggtggtccttcctactaaaaattccaagcagctcgaggaaagcccaaaaatcccttgtcattcttgtttcctgggaactttggaaggagaggaactctagaattttcaaccacttggcaaataccccgaccaatatcattgcaaagattaaggaggaggctaaaatgtaggtgacagcgggggcgaaatggttgacggagatacaactattgggagaataaaaacactgctttcggtcggggaatgacctaaactcccataatgtatatattgttatgtactcccttctctatcaatatataaggcaaatttcttgccttcttttcaaaaaaaaatgacggcagttcatcggagggtaaattcggcgaatcaaggccgaattaagaggggagaacgtgggggaattgatgatgaggaggagaggaaccgatttttggtagaggagaacgagtggggagggagatcaagaggggccgcggcgcttctgttctttggctgggagaagaacaggcggcggtcagctggaggaggaagacgaccggctgctgggccagctgggccgcagggggaagaggaatggactttgtccgagggagaggaaggagagttgggccgagcaagggaggggaggagatgggccacggagaaggaaaaaggcccaggagggagggagaggaggatttggggccgaaaatggcccaaagagaagaagagaattatttttagcttttcatttttaattaactcttaacttggtttttgttgcatttaaattattttttgtgctctgaaaattcaagtaaaaaattgagggaccaatttagagcatggaggatttaaaaaaaaatactccaagccatattcagatttttgttgtatgcattttaatgtttgcctatttaacttcgaattttaattaattttattattccttttagagaatgatttttaatttaggatggatttatcagggcgtgacaaattcaccccctacaagaatctcgcccttgagattcgaagggttagaaagaaggtgggttcggaaagtctttgatttgccttctcattctttgaacagcttccacttttatcttgaatgatctaaccagatccttcaatagtgaatcatgtaatctttcaataataaatcatgcgttccttttccgttctatgtttctctagtactcgtgtcgatttttgtcatagtcaatagcttggtttcaccctgattcttccatttttagcttttatctgagttgcgagcacttggaggtgttgcttcaattctgagtctgagatctacaacatttgtatatgtctttgatttggacaggggaggaggagatgaattagggttaaggggtctgcacgaatcttaaagcatatctaatggtccaaaatttaaaagataggaggtagaattttttgtaaacaaatatgtagatagtttctttttagtatggcccagcccatatgttccaatgagagatgttggcaacgcatctgcgcggaataggctttctcacttaaaagtgataggagtcagtacaagtaggatagagagtattgtatgccctggattttgcgcacgagctacggtttgcatcatgttcaagttcacatatggtgaacacaatttactctacaaataaattatgataaaaatctgcgaaatgacattgacaagcgtcccaatccatgaaatgcctcgacaaacccaacttcctagaaataccatcgtacaagcgcttgtgtcccagaaataccgtcgctgttaagtttccattagtagacctccgttaagtgttataaaatatcattttacccctacaaattgttgaaagatgattacaacttttactctttctgacaatgtacaataatttagtttaaagagcaaactacaaattagtataagctaatggaaagagtaaaagttttagtcaacttttaacaattcatatgggtaaaatgatctttttatagcacttaacggagggatgctaacggaaacttaatggcgatgtcatttctagaataaaaacgcttgtacgattgcatttctaggaagttggggataacatttctgaattggagcgcttgtcaatgatatttcttggattttctcataaattatttaaaaaacttcacatacaaaatataaattacttttggttacactgttatttttatgaaatttgccactggacccacctatcaaggctcacatgttatatacagcgagtgacaaattcttaattgccacattttaaaagtggcaaatagttaaatgtcgctatttttatacggcaatcagtttttaaaaccgaagcggctgacaaggtgtacaatatttctttcttttataaaactggctaatggaagttcacttttgtttaatttaatgaaaaaacagaattactttaagaaaaaggagattcggtgttcgagcctcagtggctgaactgaactgaacttacaaaaactgaccgttatctcttctccgcctcacctttcccccctctctctctcccacgcactctcgccttctccacacaaagctcgcaaatggcgatctccacctggagcacgcgcctcctcctctccccctccgcctccgcctcgagccatagacctaaccctacccgccgcctcgccttcccctcccccatctccggccccggccgccaggctccccgcgcctacatctccgcgccggcgtccggccccgacgcctacccgtccccggccctcgacgccgcggcggcggcggcggacgtcgccgcggccatcgcctcctcggacgccgtcacgtgggcgggggtctgggccctcctgtcgccgcacagggcccgcatcgcggtctccctcgcggcgctcctcgcgtgcaccacctgcaccctctccatgccgctcttctcaggttggttaggttggggtggttggttcagggcacacacacgcctcttgcgcgctgatgctggtttggttgtgagatgtgtgatgtgatgtgatgtgatgtgggcgtgtggcttggtttggatggcagggaggttcttcgagacgctgataggaaggggctccgaacccctgtggaggctgctgtccaaaatcgccgtgctgtatacgctggagcccatatttacaatcgtattcgtgatcaacatgaccgtgatctgggagaaggtgatggcgaggctccggagccaaatatttcgcaggattctaatccagaaggtaattttgctttagctcattagctgtgtaacggttgcattgcacctacaagtatttacagtagcaattacaattgccagacttggggtaaaaagatgttgggttattccatatgatcgcctaagttctgtttgctcattgggtatgcagctgcttcaatcatgtccaaataactaattttaggcatggttgcgcttacacacgagtcctttgctactactgtatcatttgtatgatgaataagttaaaagctgctaagtgggtagcaacttagttcatatgcttgtttttggattgtttacaaattatgcccacattagttttaataccattatgaaattattcatcccattctattaccaggttgcatcaacacttagtaggttttactagggtgaagttgttcgttgaggtctcctatgctttgcacattgtacattaatgaaatatgaaggactagggacatactgtgtggagttaacgtaggtagtactaatgcatcgtgaaaatatatttttttattgtgcatgattgtgtagccttgaggggcgataatgcactgcttcttcatcttagcaatttggcattcaccaacatggttatatcagttttcattagtcatttcatagtttatgttgataatgaatgatttattctgtttggttgtttgcagatggtattctttgatcgtcacaaggtaccgactaccagcataccacattcatattaaattgtcacaattagttagagaaagataacttcatttgtaagatattgttcctactaaattgaaaatctttgtatttttatgttcagtgtctgtattcaagttttcaaatcatccaacacggattttgctttgtgaaaaatatagttgagcaatgtagataggtagcttggtaagccactttttccttcttccattatggaaggcatgtaattaatgttgggttagggttatgcaaaaaaaaaatgttgggttagggtgtgtggatagtgataacagtgaaagatttacttctaggttaaaaaataactagatctaattcaatttaccaagaaaaatggtggctatgatcagtgtattatgcattatctgaattagtaaagcagtcattgtttagcttggtctgttatacaagttatagagaattttctttcataccaaagtacattttttctgaaaattatgcaaatgaaaggatacactgctgattattccttgcgtgtgttctatgttgcttcaaaaattttacgaataaaagaaccttactatcatttgatggcaggttggcgagttgactggtttgttgacatctgatttgggtactttgaagagtgtcgtaagtgacaacatatcaagggatcgtgggctaagggcactctctgaggcaagaaactttacactatgagaatgtaagcttgatactgctaatggcctagaatttgcgctatacaatcactgaatcacatattctctctgtgctattagcaatgctttcaaaaatactgacatctcgaagcattattgaccagttagtccatttatatcatatacttgattatttggaaatcatgccattacctgtaaggtcaattatctcagcatcttctaaagcagtttttcctcttttctttttctccagatcaccggtacactttgtatacttttcacattatccactgagctagctcctgtactaggactcctaatggtctctgtctccgtgctagttggtaattatccaaatgatgactgatgccatttactattcattattctctatatcacatgtctttaagcgtagaatgactttcaatctttcatcatcctgaggtccatcatatgttctagaaacaagctgatttgtggtaaatatcacacattagttttgtcaggtccttaccgtggaagctggtccctcatgtcttatacgtttctagttagctgttgataatgaattgggcctaaatttaatcaccacacttgattttttatttctctgtgaaatatatgggtgctatgctgaaccatccctggtattttgctaatgcaaaatagaagtcctatttaggaatttgcatgagtggaatgatattgaattattgatttgggagcttttgatgcaaatgtccataatgttattttttagtttgaagtaattgattagacatatttgagatgatacagaactttgcaaataagaaataataccttttttactggctcgtaaagtttcaccttttgctctgcttttatttctttcttagatcattgccgcggatatttccttcatgttattcttgaacttatatatgttcgatgttgtttgattatagtattttacaatttcattgagtgatttgtcttccaaatatatttttgtcttgaaggattaacatagtgtggccttctaaaaagatattatttactgaagtagtgttggcagttgtatgtcaattttcaaaagcatttatgatctgacaagctatttttattaaatcagctcttttcaagaggtcaactgttcccacatttaaatcttatggaattgtccaagcacgtatatcagacactgcatcagaaacattttcagctattcgtactgtgagtattttttcgtcagaattgtatacttccttgtaatacttgcattaatagattttatctctttattctgttaaataccagtccacatacttgggggttatccttattttagtcaaaaatacatttgcaggttaggtcatttgggggtgaaaaacgacaaatttctatgtttgacaatttggtaagtcttatggcctttcacctatgcacttctcgggccatccattagaatattactctcattgttcatttctctattacgtagaaggaaatgtgtcattctaccaatcgttatttatattaactggagatttgtaaaactccacattaatcctaggaggtaaaacgatgataaatccccactatgtaaaataaaagggtagatatgcccacattaattggaaaaagagagagagagaacatcatatccatccaagttattgcacagacatcatgaagcgttaatttgacttatgtgttattgtagtattgtactggtccccatataatgtgttgaaaaatgtccaagtctttatctgatttggatttggcagattctggaatgaaggccacatgtctaacatacactaatagaaaagcatttgtaaagtagctaactatgttattttctttcctacaatttagtctactatatatgttatagacacaatacaagaaagggttacacatttgttcttgagggctaaatttttttatatcaattggtggaaaagagagatttacatcgtcttttgttgtgagcccaaattataactatgcatatttcatgttagattaataataatgaattccatgttttgctcagctaataatactaacctataccaaaaagtcaaatagtttacaacaaaatcagactactttatgtatttgagtagagttatgatgggtggctctaaattctctaaacctgtttggtttgctctccatgcatagtcacatatccacaagcttgataatagtttctttttatgttttttcaacatattttcttcaaatttttaaacaaactcttcaaatacctcttattaaaaataaatcttttggcagctttgctagcaaatgtttacatgctatgaaccatggtgtggcaacagtgacttgccacaccaacgtaagtgctgtgcccaaatccttgccaagccattgttttttaatccttggcattttatgtggccataaggttcagtctggaaataagtttcaagagggttttgacaattacattcaaaaaaagtacaaaaagtaataaaaatttgatgatacttatcagtcatgacctgcacttactacacccatgaatcgatgcacaagctgtagtgccgcaccacgatccagtaaggcatgatgtggcataacttggcatggttgctaagtgcttgctagctgtgttgtctgaccatggtaatgcgtgccgctgccaatttgtgcttactataaaaggatcttgaaactgtagatttaatgccataaaaatttaatgcatcttgtctatcaaatcctgttagacaagataaggtaaaacaactatattacaaaggttcatgcctttgtggatgtgatcttaccctgtgagagcttatatatataattgtatgaacccatgctctaaaatggtggtaagtagtaaccaaactttcaccccacctcttaacacttaaagctatgttaatcatttgagttttgtaaaaaagtgggagcattatattttgaaggaaaagaaggtaatatttgtagcttctacattgccttcgatatcttgttaattcaagtttttgtttggcaggcacttgctttccagaatagtggcacaaaactaggcgtgctgaaatctgccaacgagtcattgactcgggtggtagtctatgtttccctaatggcactttatgttcttggtggaagcaaggttaatgcggtaagcctctgaattgcttggagtgtgatatttacgtgtaacctcattttctaaagctgcaacacatttcatgtagtttggttctgccatagaataagttccatgttatcctgtaaaacatcctgatagtttttacaagtacaaaaccgggggggggggggggg

SEQ ID NO: 60474 - DNA, 3873 bp, Oryza sativa
ttagggaatggatttgcctcgtcgaggcgaaggtagtggcgcgagggcttggtcggaaatgctccgacgagggagatcggccgatggccggcatttggaagagagagagaagagagaagctcggggctcggcttggtgtggggaaaagagaagggctcgccggctatttataggcggcgaggggcggtggatgatggcggttctggaggcggttttagaggagaagaagaagaggagcacgttagcggcgacgtgaggaagaggaagacggcatcgttctcgttctatgattgggcatcgatgtcggtttgcttcagaggctgacgtcggcggcgtgagatggcggtgacgtcggcggcgatgccttggcgacgacggcaggacgttggcggcggcgtgtgaaaccacggcgatggtagcggcatgcgcgggtatgccgtgcgtgcccacgacgcacggtgacggcgcccacaggaggagatggagcggctgcttctgttgggccaaactgggccagtgggccaaaaaggaagaaaaagaagactttggcccagattagaaataaatgtttttctaaattttgacaagggtttgggtgattagaatttaaatttggagaagatttggaaggaatttgaatagggaagtttgaaaggaaattatgtaggagatattttctagtttgagtgcaatattttgagggagaggatataatggaatttatttgttgcactcaaatgagaagaagagaatatatatattggcatgaatagtatgattcctaaaatagaggatataattgagaatatgggaggagatggatggatgaagataaataggatttttagcctcgaaatatatggcatgggtttcaaagaattgtttgaggctaaaaggaaatttggatgacaaagatataatctattttcttagcacaagagcaattattttaatatttataatattgcttattcttgtgccgaataggagatcaagccacagagattaaattagtggctagattaaaaggaggaatttagatatttggatcgggaatcaaagataggtttaagatcaaaggatgggttaacaattaattcaatagaatcagaatttcggtggtttaggttcaagggtaatatgggaagatttattggaccataattcataataataaaaatggttttcaaactaaatttgaataaaagagctttagtcgaaagaaggtttaataaatagaattccaacaggaaataccaaatatgtttttaaatgaaaaacacaaaagagattaaataccagagaggttttatgcgagttagttttaggaggtcccactaattatattttcctaggtttagaaggttattaagaacataagaattaacatgatgcaagattagaaaatagctaattttcagtatgttacattcgaattcggagaatatttgaataagaaggtttgaaaggaaattatatccaaatataatttccagaagagagattttctggtttatttgagtgcaatattttggagtgggagtttgtttgatgcactcaaaataggaattcaaaatattcaacaccataaataatatggctctagatttgaatatttttgagtatgtggagcgaatatggagggagtagaataaatagaattttagcccaaaatatatggcatggattctagagaagtatatgaggctaaaaggaaatttggatcgagaatcaaggataggtttaagatcaaaggacccaattaattccaagaaaattggaattactttggtttaggttcaagggttgtgttggtggatttcttggaccacaattcataaaagtaaaaaggatttttaaactaaatttgaataaaggaaattttggttgaaagaaggtttaagatgcaaaaatcaaagagaatacctcaatttaacaagatcaatttttagaataaaagccacgaaagattttaaataccaaaaagggattttatgcatgttagttttaggaggtccctctaattataatttcttaggtttaggaaggttattaagaacataagaatcgacatgatgcatatttagaaaatagcaaattttcagtatgttacagacgtcgtccggtcgggcaatgattatcctgggcgaggcatgcccgacgctgcgttatccggagcggccagtcttcttcctcttgttcgtcatggtgggattgactccccctttttgtctttcttcctcgatgttcaggacttctacgagatccagatggcgcacctcaccctgaacgccgtgctgacacttgccatcttcgcacatctgtgcgagatgttcatcggggtgaggccgtgcctccgcctcttccgttggttcttaaccatgcaactggtgtcccccgcgacggaagccgacggctgctacttctagccgcgcgccaacacgcaacagcactatttcgggcagacgctacgcaagaagtgggacgactggaagcacgattggttctacaccgtcctccctgacaacgtccacctttggctccctacagcaccgcccgttcagacgtcgagctggcggtcattgtcggtgttgggagacacgtatgacgcagtgatcgactacctcgccggtctgcagtataaggggctgactggtgccatggtcttcagcgactacactcgctgccggattgcgcctctccgggagcgggtccggggtgcatggtcatacaccggctccgacgactccatccggactcatccggggcagacctgggactagaactatgccaacctcaagctagtggtccagtgggtgctcagcctcagggatgtcgagccgtcgctaatcccccacaacatccttcctccatcctggccatcatgcaagcgataggcgcaggcggggaccgcagcggaggtgatggcgctggcggcagccacgttttgggggaccgctacctatccgcccgaggcggccatggaggaatgtccacgggcgggggttcgggcagcagccgcccctctgacccgaaggggaagaggaagcaaagggactcctctccctccccgtcccggccctgcgggggcggcgcagagtgcgccgttggcaggcgcccaatgggcaccgaaccggcgcagccctcaatgaccgcatagctagtggctgggaggaggaagaaatggccgtgcaagacggcggagaccaagccgtgccggggggagtttatcaagtccccggaatggagctcaagcgccaccccctgaggttcggtcttaacgccacatctcgtggttcctcaacctatgcccttcgcttatcttttccatcttgcttgtttttctcttttcttttttttctttttagcgagatccacccttgcggcgcccctgccgacgatccctcctagcggcccaagtcacacaggtcggagaaggctgaggccgaggcgcaaacaaccaagaccggggcgcggggaaccagggtcggtgaggagatggagtggccggacaacggcgcggagtcccaggcctcgggagggggcctggagccaaacgccgcgcccgaggccgagcccgaataggccccaggagggggccaggatccaggcaccgcgcctgaggtagaacccaaggcgaggccctcaggaggagagtaggccctggggaccgacgcgcccccatacaactgctggcagggcgtccccgaccgcgcacagggcggaggccacctggggggcccctgccaccagcgccaccggacacacgcccagtgctggtgggggcgacgcccaaggcgcggaggacggcgtgttccgctcgcccgctggggatggcgtggccttgtgagcgagacgcggtggcccgcatgc

SEQ ID NO: 60475 - DNA, 5172 bp, Oryza sativa
ctcgcgttccgaccgccgacggatatcgaaaatgttgcagcaacacatggtcaggtaaagacgagtatgggccagactgagttaacagtgagaacttggcccaggctgcagcgagagattccttctcgttccgtcaaaaagaaaggatgtctaatcaaagattaattacacgggttaacagaaagaaggcaaggcagaatttgcactttagctcctattcaccgtggaatttcctgacagacagagtgtaccattgctttgcttcatctctaagagaaaaaaggaaacaatttccatttaagagtttcatgtgtcatgcctacgatggataggcacgaacacactagctcaaaatcacgaagatggaggtataggttttcaccaatactaccagagaaggtttgctcttgaatcatggctataaagtcaggactaatttcgtagccatccgaaaggattggttttgaagaacaggatggctcacaaagatcagcccgaggagcaaaaaggttttgaattgtgggttgctccattgttggtatttcttaacctgacagatagaatccataagcgcacggaaaataccgatgtagtacttcaccccaggagtattctcaggtatcgatttccatagggaacgtgtgtgttaactcctagtcaggttcatccaaggacacgaagctaaagataggcaaaggatagagaggattcaccggtgagaaacaatgtctatggaaagcttaactttaatcctaacgcgatacttcgggtactggccagctcgctactcccagatatcgctctactacgtacccggacaggaaggactttagtgatcttgagggctgtcaccacctctacacccactgcacacctactgtgggatacagagcaaacactggaaatcaactacctagacaccatgtctaagcaattaatagctattctagtgtttagaactcactaaagcaatcactattttactgtattatagtgaacgatgatctagcacgctgattaggaaataactaagaggtaattctcaccaagcaaaactaaattactcaaaagatatttctattataatcagagtaattaacagagcagaaagaaataagaagaggattattgataactccggaactcctccgacttcttctactctctctccctaatctaatatataataaagtacaatagagcctcttataatttagctcaagctttggtgtgtgtgaatgagggagaggagagggccgtatttataggtggagagatgccttgggaatgtggagatgctaagcatcctaagagcattttctctcttgtgttgacaagtgtcctctctatgacggtttccaccggtagaaacggtcacaaccgccaatggatgaggattgcaactgccaggtgaaaaatgggcctggatggactagctggtggtttggccgaaccctggccggctctgctagcccagcccttcctcctagagactgatatgtgggccccattgtatattcttctgaagattggctcaaatgattgcatcttattgggtttatgggctcaagactccattagcttggatatgaaagttatattctcatccttcatgtatattttctctcaactttagtaacttgtcacctgcatacaaatatataccaacactcgtggaaattgttagaaataaaccctaccactatgttggatgttttacatttatggttttatgcaggtattgacggcattaatttggtacttaacagccgtcaacaaatccccacacttagctctttactcgtcccaagaaaaggttaaggattaatgtggaataaaatttccgaaaatatgtacaatataagtacacaaattattttaagccatacctgtacctatgaatttttgcactgtctaacttaccatcttgggcaattgatgaatggaacggatgtgactcaagtccttcttgttcctctcgtcaatctcttgggttttcatatattttcacaaagcagatatactcctcaaagggctttctctcaaatcactcatgtggtttgatttgtggatcctcaccaaggcatattatgccgaattgtccctattctaaaaggctgtatatgtggagctctgtagggatcaatcggggcatacctgcatcacatattttgcaaagccaaaagaccggacccaaggagatagcaagtcatactatctgatcaagaatgtgcatgtgtgtgatatgtgtatatgtgtggttattttgtgggttgttgacggtcgttagcgaccagtttcgaccatcaatattaccaaaatagaggagaactagttatgcttgtaatgcatatacatgttagaataataatattccactagtattaggttcactaaccttttgtaaagaataaccataaagtggaggagaatcgatgtcaaatcagacgataagtcaatcggacaatgtcgagaatcagacttatgtatgaatgggccaagaactcagaattaacacgatgaattgggccaaaattcacaagtctaagaagtgaagcaacggagaaggccaccagccaaaacctgggctggttgggccggcccctggttcggctcaaccagggggttcggccgaaccctccctggtgccgttggatgcagggttgcggctggacggtgtagattagcccccaatgacggttggaaggtatttccgaccattccaaccgtcacaactgtcattgggaggctatataaacccctcactctcttcacttcaacacacacctcaagcaagagctctctcatattctatcaagtttagtttagtagtatcaagatagtgaaataggaatagagtagaaatcaggagtccggaagtcttcggaagagttcgggtatggctctagtagctttcctttcctcttttgtaagctttgtacttttattagaatattcttctatatacatttatggtattgaaataatttccgagtatatgaatgcctactttacattatgttcatgttataatgaatatactgctagcttatctgggagatgctttggtgcgggtataatgtttgcatatgcaattactctatgtcatgacgatgatattagagtagtatctaataatttagacgtggtgtctagattacgggatatcattatttggggttatatgctgcagttgagaggtgggccgctgatggtgatagctcagtatgggtattcctgcgcacgtgtatataattccctgggaagggtattcctccgtatttagccccggttgtatggtcatgacgggctatcgtaaggaactcggcagttagggatggcttctcgaattaccaggagggcatcggatagagggtactagctagtatatcggttaactagaatgtatgtatactatgtatattagaagtatatgaatagattatctttctcttttctttccacttagcttagataatatattatgagaatgagtagctgatgcttgtgtgtcactctacccttggattatcttaacccctacttagaatatgattattacaagtaatatataaattattagtcaagttctctctacatgatcttcccacgggataaaataaatacgatacctgtagagatcttcccacgggataaaataaatacgatacccttggaatactctcgggtgaaatgctacaacggtagaccttctctaatcatccacgctttccttacgctcggtctcttttctttcgcccaagcaagtacctctgcaaacgaaaacacataaaactcattgtgtagcaacgtttgttcaaatatataataagtaaacctaatgtagaacatatgcacctttggtttattaatacataaggtagtcatggttatatccgagctagttgtgtcctcatcatcaaacttagcattctgcatatcgtaacctagaggcgattatgcagattttcatcaatttcggatggagattcacaaataggcttcactaattgtggggttttttttgtttaatgttggtggtcattagtttgtgctttgcttcttttttattgggtgtgctattatggacttgttgatatgcgctcgtcattgagcatatttatataataattagctgtagctctttgagcaaagaccaaaaatttattccattatcttagaaaaacagtccaacgccattagaaagggtattttagtgtttttctcattgtcaaatctatccaccaaccccattacaaatgatattttagtatattctatcttattataaagttgatgtccactaactcctaaagcttaacatgcaaatgctgcacatcatcactcactaataattattatatagaatattttaaatataacacaaatatgatatattatttacaacgttgttgtacttttagaattcaatatgcaagaaatatcaaatcattgtcttgacatcatttttaaactatttaaactatacatatatcatttctgtaataatgtataacctgcatttattcacgtatcccacagcaaagcgtggagtataccctaatttttatcactccatctgattcagattataagacgttttgactttggtcaaagtcaaattgcttcaaatttgagcaaatttgtagaaaaaataataaaattttcaacccaagacaaatttattatgaaaatatatttaattattgatttaataaaactaatttgatattgtaaatatttctacatttatctataaacatagtcaaacttgaaattcgactttgataaaagccaaaatgtcttatagtctgaaacggagggagtattgttattaggttgcgctcttttcggctattccagcttagctaaaaagttaaacggcatattttacgtgaaaaatatttatatagtaataaatttattaatcaaaattttatatattatgggccattttggattgatgccaaaatgtgccctactaatttgtttggtagtttgaagccaagtgaatgtaatggtttggtttgaagccaagtgaatggtaatgtccatgattaatttgacataattctagaactttcttgactataatataaaatttggtctccaattggtatcaatccaaatccattcacctaaaatgctaccctaccaaaatattggtagtgc

SEQ ID NO: 60476 - DNA, 683 bp, Oryza sativa
  unsure (1)..(683): unsure at all n locations
gctgtnnccaaggtagaactacttgttgcccacgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttattgccaacataatttattcttatttggatcccctcatctttaaattcagatgtagccttgatgttccctccccatgaagagaagagcgcacatgaaacttaagtacaaaagtcccgacccccaacccataccaattaattcgccaattcttcgggaaattgatccattcaccacttcttcattgatttacaagaaactattggtttaatttaac

SEQ ID NO: 60477 - DNA, 6408 bp, Oryza sativa
gagcaccttggcggcggtgagcgccctgagcagcggggcggagtgcgggtgggcgtgcgtgaacgcggcgaggaggtgggtggcgccgcagaggacgatgaaggcgcagaagtggagcacggcgcacttgacctcggacaggtcggcgcaggtggcgaagtagaagagctcgagcgggatggagaggaaggacgccgcgatgagcaggtcgctcacgcgctggcactgcatcagcgcctccaccccgccgtcctcccgcatgtcgcacgcgccgccgccgccgcagcgccgccgcccgctccccagctccgccgccgacgccaagaactgccgcgccgtcaccatcgccatcgcaaccgagagaggaggaggaggggagtgaggagggcgatggatattggatgggagggcggcgcgtggaggtggtggagaatcgtgcgagcgtgagcgggtgacaagtgtaggcaatgcagcgcctcgtgctgtgtcgagtggtgggagagacaagtgtaagggatacccttgccgctgggcacgcgggcaagggaaggcagaggccggtggactggacagttttgaaaaaaacaaaattggcgcaaaagattttgaaatggtgtttggtttgcctcgtgagatcgtgtcatccgtgtctccgcctctcaggcagcggcgaagccacatgagtattaggggtggaaacgagccgagccggctcgcagtgggtcgtaataaattagatttggcttatcttagctcagttaagaaaacaagctaaaacttaagctcggctcgactcgtttcctggctcgaactaaactcgagccgacttgcatgccttcctattgaaacacctcttcaaatatattttgtaattattaaaaaaaaataagaacaaatcatcaacatataaaatttaagtttatatattcaattcttcaaaatcttaatgataaattttaagttgacaaataataactccataaaaagtaaaataatggatataaacatatgatggcctagctcgtgagccagctcggctcggctcatttaagcaacgagctgaaaaggaggcttggacttggctcgtttggcttacgagccgagccaagccaaccaggctcgagccaagctcgagctttttttccacccctagccacagaacaatgagctaaattaataagggtttaatttttttcataattacataacattttttttaaatatataatgagagttatggggttaacatagggcttcaaccttagctgccctatgcctattaacattcttggtcatagaaagcaaaaccaatggagagtatctacgtgttatttacgagtagtttggaataaattattaactgaactattatagtggactagatgtttgcagatcagatggtttcagactatatccgaacccatggtcctatttggtttcattgctagattgactcgtccactagattgacgagtttctttttataaaataccagacaacattagagcggctacgactattagccagctataaacatattttaatgagataaaagataagaagagaagcgggctacagatctgtagccagctgcagcacggactccaagacaaaatgtgtgtatgacgggtgtgtcgaggagtgatcctctctagcgggagatcgtgagatccccttttgtgagttcggccgagggaaagggttcgcctctcgagatcgtatatccgccctcagggtttctagatcgcgtgccggcgacaagattatacaggttcgggccgctatggagcgtaacaccctactcctgtgtgtgggatttatggttgagtgttacaaaggttcctcaactccgaagagcgctcttggtcttctccttctagagctcaggcctactgagtgtcgtcccttttctcggtgggcaaggtcctccttttatagttcaaggggataccacatgcgccggttctacctactctttcacgggagggggacccactttacctcgaccgggccacgatccgtgccttcgcccggaagctaagcagcagtctgtccttgagcgggacccagcgccaccccccgcttgacacgggggacaaccctgtcattccctcataaatgagtgaagacttgtggcggtcctcctcacgtggagggaactccgaataatactctgatgggacgggacatacctgcctccactccgccggagacagagacggacgtgggggcgcggccgcctgtcgaatcggacgtgaccggcgataggccggtcacagtctggtcacacccgattgacgtgggtcagtcggacggcaccgcacgtctgcccttagcgtattaaatgcggtgagggacagttggggcgccgcgcgcattgatggcggttcagcctgggtctcctccccgctcgctccccccgccacatggcagttgggcgagggcctcagggcaaggcagcgcgagggcccgaggggcgtgacgtggcaccccgaggccccctggctgcttctgagactcgcgaggcgcggggggagggccaggctggagagccacatggctggatgggaaggtaactttccctcacttggcatacccccgggcccatatctccgacaaggtgggaccatatattaatagtagctactattgtatactagtaatcgtgcacatgcaaggcacgttttgacagtatatattagcaaacgaagaagaatctatgcaatcatttctatgcaatgcactccatataaattcttctagcaattaagacaatttcacatagactatactaacatgacaatttggatggttctctataaaaaccactattttgaatcactacttgcttaccaacgaatgtaaaagtatttagtgggacaaacacaatttatactgtgatgctgctaccttttgaaatcaaacaattaatgatcgaactctgaacaattcatggggatagcagtaatttcataaaactgaaggcaatatcatctagctgcagcaatattctaactttaacaccaatcttttcacctttttggaatatgacaagtactgtatcaagaagcaatggatattattaaacctacatataacatgagacttaatgcatacacctgaatagtgaatactaaccaaataattaaattccaaatcgcattgatttgttgtgtgggctaaatcatccatatgttcagaccgatcgatttcatgaggttggtacaggatcaataaagaacatgttgcgctgttaaaattattttgaaataacttaagaattgagtcaccaacataaagtgagcattggcagtcatcaactgctgttgttgctagctgagaaaattgccacccattgaacacttgctggatgaaaagaaagtgaggtttggacgaactcatcagaaacacattataaactttcaatgattttagatcctgtgagttgattaccaacatgcgaggaccgtactgctgaggaatagagagcttgagatcctcaatccaaacagggtcaagttggctttgatcactgtcgccactaagattcctggcattccaacggtccagttcagaggaagaagcctgaaaccagatatagctagctaggtttgtcatttcatctgagcaatgcatatttgtatcaactatggctagcgattattgttgggagaaccaaaaacatacatacatacatacatacatacatacatacatacatacatacatacatatatatatacatatatacatatatatatatatatacatatatatatatattcttggacaacctctcggccgtcagctttaagcttaccacaccacactgcgtggtcggtatgcgaacatatcgtaattaaaacacacaagtattaattcagaactgcaaaaattttcatacaacacactggataaagactgagcagtaatcagataaagccacaaaagaagggtgctgggtccactctctctatctctctctctctcagatttggggataaaaagaaacaaagagaatagtaagagagtatcatcctctaaagaaaaccctcaaaaagtagaataataaatgtggcccttttttaatgcagcactccatataaattcttcacgtaaaaaattgagtttcatagacttgttgaacacaacaaaccttcaattagcaaccagctgatcattagagcatgattaagaatcaagatatgtgtgcagcgtttcagggtaaatatttccaatccacgtaacattgcattgcaactgatggttacataataaattttgtagaactgaaaaaaccaggtcataatctaatacaatcaccttaaggaggtgcagactgcagcctaatcactcctttattttttatgagcactatgctcaataagttttaggacctaggataggaaaaactccccttgctgattcatttgcatccattgccatttgccaacaacagcatatcataatccaagcatttatttgccaataatttaagaactcggcaaagaaagtaagaatcaaattaagcaagaaaggaaatatcgttgactacttggctcatagcacaacaaagtttcagttaataattagtgcatgaagaaaaataaaagaaaaatcaagtgcctgtgcttaccaccatggtgagtgagaccaacaaacagaagggcgcggccacgacggtaattacgaaagccaacagagcaactcggtcatcagaagcaatcggcagaccaccaatcacatgaaggatggaagaagcaaattccatatgtttgtagtcagatttctgaaattttctgttaagttcagtgcagtaaacattttagatactcaaaccttatatatacagatacatatttagttgtttatatattgcttaatatcttaattttacaattcatctgcacctgtggtcagtacgtgtacaaacccagctggtttgcacatgcatctgtagattactatataattcatatagaaaagaaatggattagggaccaacatacctgtcattggctcgagcagtctaaacttcaacagcttttcaggacttctcctagcacaggaattgcttcaacctcagtccctttgattgctctactgatgtttgtatacaagaagaaggacaggataagaaacatcataagtcgtgaccagacccataatagactagagcacatatatgaacaaaatgaagaaggtgtaatatatgttagattgcgattgtgtatatttgtttccctcccttccttatcccctccgatattgtttctataaattggttgcggtagatatggaagtcttgggcctatatgtactctgtcatatcgataatgcaatctatcgtgatgagccaatcacactttcatggtatcatattagtttctttcctctgcttccgcatcttctccaccccagccggccggcgcctcccaccgccgccatggcttctccctcatctctcacagctgactccgtcctcgaagataccatcaagttcatcaccgacgccgtccgctcctccttcaatcccggtcctggcctccaagtcgacgacggcctgaccgatgctgtcaccggcaacgccgccgaccgcgccgcgaacgctgcccggacagccctcgctcttgtgctgctcggcctcttccagtcggcgccggctactgacgacgtcgtctcctccgcggtgccactatcgacgcccttgacggctgcgcccccgacgaccgtcgtcctcgcgtccgcgtcggcaccgccaccggtccctcctccgacttctgcggccgtactcccgcccgagctcctagcgctcctcgcccgactcggcatcaccaccacgtcggccgcccctactcaagacgccgtcgctccaccaccaccaccgccggcactcgacgccgaagccgtcgccactctccacagccaagccgtcgccgtcctcaacgtgaaggccctcgtccccgtcaccctcgatctcaactccgacaactactcccgctggcgaggcctcttcctcgttgcgctcggcaaatacgccctacaggaccatgtcttctccgacgtccctcgcgccgatcaggccgactagacacagatggactgtgtcgtcctcggctggctgtacggttccatctcccatactcttatgcaggaggtgctctctcccacggcgaccgcgtgctctgtgtggcgtgacctcgagctacaattcctcggcaacggcgaatgatgcgccgtcaacctcaccgccgaactccatcatctgcaacaaggtgatctctccatcggcgactactgccagtgcctcaaggtcctcgccgacaacctcgccgacgtcggctagcccgtcaaggaccgctccctcgtcctcaccctcatcgacggcttgaacgacagggtgcagga

SEQ ID NO: 60478 - DNA, 24995 bp, Oryza sativa
  unsure (1)..(24995): unsure at all n locations
cctcactcactcaccaccatcaatcataatcaaccgactgatcgtcacaatcatcgattctcgaatgaccttggtcttatgaacgtcgttngatgaannnnncccccccnccccccagcgccnccggtgatttgcattcgccgnagcncancactcaagcttgcatgctggttctggtaataattatgtactcccctctagcgtggatatggtccgatacagcgattatggttctatcagtgatcctgttatgctctctttggaaatatatactattcaaaaatgttagattgagctaacgggtgatcttttctgggcttgcaggagtttggattccatctttctgtgctggaggttgacaggctttggtgacaacatggtgctgtgtaggtgatatgctaagcagctagtgatcatcagtacaatgggcggtgttcaaatggcattagattggagtctgtttccttttcttctgtaattagaccaacaatatcagtcatgtggtagtagtagtagtggccgaacaaaacagtagcaacgccatgaagtatgaactacccccgtccgtccgtgctaggctggtagttttatggttgttatccactctgttcatgtgtgtttagttcaaagaaaatctgttccgagtcgggatgatcagcaaatgattttgttcttctatgcactgagaatccagatgcatttatcctaattgcttgtctaattctcccttgtgctgcatactatgtttgtgaagttatttgaggttaacgatgtggttactaacatgcttagggcttgttcttttaatcccaaaatggattgaaggagattgggggagaacataggtgtggaattttatcctccaattccctcaatccccttggtctggggattaaacgaacgaggccaagtgtttgggcaaccacacgaggatattattatcttatcaagtgtcgtatcatctggtatgaacaatattgatcaccagggttagcattgcaattcgtacaggaaaccggatctaggttgcattggcatcacaaatcatgcacacaagaccatttgcacgtactcacactttccaaagtataacaagaatagcgattttatgggatgattaattgttattgttaagcatacaaaactgctttcctttttccgtattccttcatacattaagaacacccaaacatctcggggcccacgtcctccagaatggatttcgccgtaatttatgtcaatttgatcatcaatctaccactacaacttaaaaagtgtaccgacaaataactctcttcatcagatctaaacaggtaacaataattccagtgaaaatgggatgtacagataaattcctcagttggagccagaaatgtcgttcagaactaactgcatctcaagaactacagcgcgccgcctccctctcactctgatgagcctcggtatgtatcgatcttgccaactccaggagtaacaactgcaagtatgacaagagcccccaatagcaccagcaacatccccaacgagttcataaacatagcttctgtcgagaaacgcccgatcatttttgcgctctgcatgaagatcgacttctccagaagtcccgaaacgcttgtggcgatggcgagaacgtaaaggaagaggccgaagaagacatgccaggggagcagggaggctcttccactcctagatccaccagggtaccaaaatgtataaaatccagtagcccactgtagagatatcaacgataaagatgagaatatgttggaagcaaacctctttacatatttttatgtttactgaaaagagcatagttcaatatctacctgcaagctgaagaagatgatgcaagaaaggcccaaccaggagtgaagcgtatataagtggtcgatctgtctctcatcgtggaacttccatacagtccagagcccaatcagactcaggagcatggcgaggaactgcaaggcaaggtgtactagcttcttcagtttcttggttcctggcactgtcttgtaggccaaaattgctgcatgcagaaccataagcgatccattaaaaccttattgccatttattataacacactataaaaactatgccttttatgtccagtaaattacatgaggcaccttgatgcatagacactcatttctagactgtttgatacgcatgtatgatcaatatcaaaattcagagtttttcccttcatatacataactcagttcaaactgatttctgttagtttgcactaattgagtttagtttataagtgaccatatatcatgaagctaattcaaactagttaagatgaattcccttttttcccagagtttgatgaatgaacttttttttgtacgacctacatagaagggtattgatttgggtgcatatgtaatataatgcaaataaattataatcacattagtcctcagaacaagggcctggagtggtttctgctaagtcgataaattttctagctacagacaagaactaccaatttgaatgtttcaatcggaaaagagtaatttggtaaccaattcaataggaaatagctagaaagtgacagaaaaagtaaattcagcaactcttttttggttttatatctccaactaagcttttgaagaaaaatatggaactaggtgttgatttgggtaaatcaaatactattcagccaggaccaagtatcattaggtgtaaatatcttacttcggggttgttcactttgatgccaaaataaaccttaccaaattttggcaatgtcaaaattttggcaatattgacaatattaccaaattttggcaggatttcttatgtatttactaaatttgacaacaaactaaatgtagccacttttttggtaactttgccaaaaaatgatatggttgaaaatggcgtcaaagtgaacagccccttcctggttccttggtacttgattttgacatgtatcgagtatcaaggaaactgtatataatctacctaggatgtctcaatgtcattattttttgttcatgctgtactgcatgaaaatacagaggcatgatattttgcatatctgaaaaatgctacagttagatgtatgcataaatcgaaaaaacagtaaactctgtatcctgtttaatgaagcaataaaaatatttatatgcaacaagccaacatgaaggccattccaagatccaattcgattggagttcaatagtggttaacacactaccttccccattcaggactaccaatccaatcagcatcaatactgggtgaacctgaaataacagaaggcagttttaatatcataacaagatgggatttatgtaatcaattcatcaattaacattactatctagcgaacgcaactcaaacccacattttttagccggcaaaacctacaaatcagttgtttacatgaaataaagcacattcgaagtttcaaaattcaaaccacttgaggacatggaaattattattttagattatatgttgattaaatgtataatatatgttgattaaatgtataagtaaaaatattacatagttggctgcttaattcatttcccagccttatttagcaaaatatggaacagaatattacacaaaaactttcaattgcccaagataggacaaaatcatgttcactagctggcagaaaactttactgtttattttctagggccactctgctcttttgtgcgtgaaccgcagtgcacgcacacgtgtgtaaatgctaaccaaagagagtgccatgtactagctactttcaccttcttttcgtaggtatccacataaattaatataaattcccttccctagtaattccacatgtgttattattctacaatcggtaaaaccattatgttcagtgatataaattcccttccctagtaatcatgcccacgtaggaatacaagtagagttacagtatgtatggagtaaaagctccctcaaagtcttcctagacagcaccacaaatggtgattctatttgtgaaagacaggcttactggtgtaaaaccagaaaaagataactcaaaaacaattctcagaacaaagcatgaattgcttcttgttgtctttctcatgtgctataatgctgaaagttgcttcttgtggtgctgcctattaaatgatttaggtggctatccaagtgcatatgcattttcctccctgaactaaaatgatctaactgcaggactcaagtactctgaaataattaattatcctcggtagtcgatgctttttttttgttcatcacttaaatgtcaacaattaagaagccaaaacttcaaaagatttccaggcttgttacaaacttactatccaaccaagccttcaaatcttctctcattttcattctgaaaagggttttctttcccttttcattaaaaatttagaataactttgagccattaacgacaaacttcaggaacatagtccaatggcaatgtacaacgatctcgaacaagggatgtggtgcagtttggtaatcctattaatgtagcccaaaattacaaacttgagcaaatggagtgagaaaaacgaaacaaacaaagcttagcactcactaaaacaaaagacgcctaagatatcacacccatgaagtcatcacacgaacccaaatcatctcaggtctaaaatatccctagaagagagcgctaaactccttcgaaatgcatcaggctcgattgtcagcttcccagaattcaaaattctccccttgtaattaacttcttgcaaaaaagctaaacccttcctccaatccaaattcactacacgcagcagccaaaaaaaaaaactctcctaaacctccgaaatacgcaacaaaagaaagccctcgcattgcatcttcgctgggtcaatacacaagaactcgatcgaaaccttgggaaaacaacagatcagattattcccgcacacagacagagacaccaccaagatcagcgcgcgatccgcgggccaggggggctagagatatatatacagaggcagggatctctcgagaatactccattattattacgttgaagatgaggagcttgtccgtctcggaggagagcgccatcccgccgcggaagtggacggcccagacgacgatggccgccgcggccgccaggcccagcagccgcacgatcccgaacaccgggaacctcgccgccggcgccgccgccatcgccaaaatggtgtgcggcgactcagcgagatcgagcgccggaggggaaggaggaggagggagacgaggagaagcaaagacgccaacaatttttttttcttcctttcgagctgaccaagtgtgaactagtgaatacgtattcctaagggagaagcgtctttcatgtgtacgctttctgcttagttgttgtggagtactaattttacgcaagcgcctgaacacctacgcctccatcaaaaaaaaaaaaaaaaagagttcactctacatatgaatctggataaatacttgtacatgttcgtagctaggcagtgtttgactaatgggataggaaaatgatttcccacccaccaaaagatatctttaaatcttaattattcattctctcttccatttaatcttaacccttcatttatttcctaattccaatcccaccccacatttctcattccaaacacacccctagagtttgcctttttatggaacatagtagtgtgttcttccccccatttttttaacccatttctctcgtttttctcgtgcacgcttttcaaactgctaaacggtgtgatttatgaaatactttctatatgaaagttgtttaaaaaaatcatattaatcaatttttcaaaaaaaatttgttaatacttaattaatcatgcaatgaaatgaacctcgttttgcgtgccagggaggaggggttacagcctaaaaagggctatgaatgtgatagttgttatgtcaaggactggcaagaaatataatgtaattcctctaactcaaaataaataaatctagtacaggatgttggtattaggatatgtcatatctcatattagatttgtttattttgaaatagaaggaatagaagagacacgtcttttttatattggattggctaggctcggcgtacgcatttttatattggattgaaacattaacattaattaacaagcatataaatgcccaaactacatgtttttttgacccgataaaataaaaaaaaacttgttgaacattatgcaatggtaaaagggaaatagaagcgactaacaaaactatgctgttaaaatgacagaaacacgagggtttatttggtaacattgaaatttatacgcttgtaaaaactttatacctgtttcttttttcaccccataaacccaaagcaaaacagagaatttaaagtccccctttatttattttacacacacgtatacctaactcctgttaaattaatgttgtaatttgggtaaattaactatgaagaacaatcctttgaacaatagctctcaacatcttgtactgaaatcattgggcgtgcataatctaaaacaacaaaactaactagctagtcaagccgtccaaccacctcattaagcacggtcatcaacctcaaaattctcaagtgcactagcttccatccatctgtcaggttgccttgttctcaattatactcctatatataatcaccagtgctagtcagtgcggtttcaaattaagtaatattctctcctttccatagggatatctgctccagaatttggagtctccaactgtcataccctatacgataccaaaatttcgtgcaaacataaaagaatataaaatatttttatacaatctttaatgataaatcaagtcacagcaaaataataataataattaaataaaacggatagaaaatatattaaaaaattataggtgtcatatattaaaacccgaacggagtacatttcattaggttttttttatgggcattgtattgggaattaatatgcaagcactgacgagagcgtggtaattcttttcttttttttcttatattttgaagaccatgaccaatatggtgtacatatcgcaggagttagctgcacacaagacaatagagttattttcgccggtcaaatatgacaaagtttagttagaaccagtattgcaaggacacgcataataagatcatcttagcggtggaaactaagaccatggcggttttacctcctaattaccatgggccctctcaaactaaaaccggaaccagcgccattgggtaaatcagcttcattgttgcatctgtaggaggcacctagtagcttgatattggtcgatgagcaacaattaatcttggtcttcatttttcatcttttaaaacaaaatcttcgactactttggcagtctgtaaatctgccaagaacgaaaaaagctcaacatattctccaagtaatttacttttcactcttatactacatccgtattaaaatataaacatttctaattatttaaacaaaaagttaaggttgaatagaaaagaatataattccctcattaaatgagttatggttagggcatgagagaggttaagggtaatatgtgaaaaaaattgaatgatatgtgcttgtaagacacgtggtgttagaaatgattatattttgacattaaaattacttatatattttggaatggagcgagtagtagtttgttttagttctttttcccctgttgtggctgcaaacccgttctattttaattatcttcaaaataacatggttttagtcaagttcagaggatgaagtgaacgactttaagagttatatgttgtatataatcattaatttaattagtttcaaggtttttacaagtgcttaaaacactttttttcttgcactatattgtttttttttaccgatactgatatagccgcgagccacacatagcagggagatatattatttattaaggttttttttaaaaaatatatgagcacacacgttaagcctaatacttagaatctaccaacctgagcagagaccatgattttatttgtttttttagagttgtagatgaggttgaaacttactagtgcatagtttccttcgctttacttgttctctccatcacgaatctttgtggagataaatgtattatcctttctttcatcgtttttgaaccttgtcgcgctctccgtgtctgcatccacttcctctccatatttatacacacacatatacacctgcaaactgcaactactaccaccacaccacattgcacttgctttcttgtttcttgcaacgatcgacgtacgacgccatgggcggcgacggcgagttcttcagcgtgggggagtgcgacggccagaagaccatcgacggcgagcaggtgccgctggtgctgacgccggcgtcgtccggctccggcgagcgaggcggcgaggcgctggcggcggcgctgcgcgcgaggcgcgagtgggtggaggcgaaggtggtgtcgaacagcgccgtgctgctgcgcgggttcggcgtgcgcgacgctgccgagttcgacgccgtggtgggcgccctggggtggccggacatccggtacgtcggcccggcgcctcgcacccacgtccacggccgcgtctggaccgccaacgagggccccctcgacgagttcatctactaccaccacgagatggtcctggtacgtacgtagtactcggccaccgccgccgcgtcgcgtcgccattgacgacaaggtgttcgtccgtgtcgccgccgccattgacacgaaggtgttcgtccgtgtggtgggttaattgcagataaaggagttcccggggaaggtgatactgttctgcgaggtggcgccgccggagggaggggagacgccgttcgtgccgagcttcagggtcacggagagggtgatggaggagttcccggagatggtggaggagctcgacgagaagggcctccggtacacgttcacggcgctgagcaagaacgacaccaagtccatgcgcggccgagggtgggaggacgccttcgccaccaccgacaaggccgaggccgagaagaggtaattgacctacaattctagtgttgcgtgtctttccctgtcagcttaagttttataaattataaccaattaaaccgagcaatatacggttttgttggttgaaattgcatttttcagagttgcaataatctcaatgtaactaaataaattcacatatatacactgttggttgaaattgtaatttaatatatggtcaaaatcgcaccaaatctcaatatggtaataaagccaataattaaaaaaaattgcatgtagatgttataaaagtttagaatatatgtcaaagttcacgtcataggacggacggatgctaaagtatgaatgcaccatctggtgaagatgtttgttaacacgaatgctccatttctcataacttaatcaccaaagccggcaaaattcacctgttatcagaaccaacaaaatcaatgcaagtagcatctgtaataccgaagtggattttaagtcgtactctaggacacgtgctctcatttgttgcatttgatttgaatagttatgatttaaaacggtaacacgagttaaattattgtaacatatggtcaaatcaacctacacacataagaaaaaacgcatgcaaacgcgagtatactttttcatactccaatttaatatgtttttttactttttttagactaaatttaattttgcattaaaaaaggggtgatgaagtcataggcacgtgacgttcactagagttcaactaatcattattccaaccatttataatgcacacatccacacagtttcaatacatttattttaatcattgattttggctctagccttcgtatttttatgggttagagtgcgcattcggaaacgtgccatgtggtatgtgcacgtgtatgttttgttttgcataattggaaacatgactttgctatttatgaaagagatatatgtgatacaattagtatagtttcccagaccaatccataggaaattaggaatattaattcatcaccgtctaagagcaagtttaatagtaaagctgactgtcaattattagtaatcctattgccaatatatataatagattagttgttagattgtgttcaatttttcttctcctaactattctctcacttatgcattcaatgtatttgtcttggagtacgtgcagagtaaatattgcatgagagccaacaccttcttttttctttgttggctctgtcctccacgtaagcatacagttaacttatagcgcacttttatccttgctctaatgggccatgtgtgcgtattcagggctcgggcgctagggatggaggtggagtggctggcgaacggcggggcgaggacgatcctagggccgaggaagctgacgcgagtcttcccggggcggcagggtcggcggatgtggttcaacacggtggtggggatgcacgggaaggcactgagctcggcgacgatggcggacggcgccgagatcccaacggcgttcgtggcgcggtgcggcgagatcatcgaggaggagagcatccagttccggtgggaggtgggcgacgtgctcatcctcgacaacctcgccaccctccacggccgccgcccctcgctgccgccccgccgagtcctcgtcgccacctgcaagtgaaatgtcgtcacatcacttcttattactctctccgtttcaggttataatacgttttgactttggtcaaagtcaaacagtttcaagtttgactaagtttacagataaatatagcaatatttataatactaaattagttttatcaaaacaataattgaatatattttcataataaatttgtcttgagttaaaaatgttactagttttttctacaaacttagtaaaacttaaagcagtttgactttgaccaaaatcaaaacgttttataacctgaaacggagggagtatcaattaagctggttaattaaattattattcctcctcggtgatgctacatttggctctcttccatggtgcgttaaaagtttgatacgtgtatatatgtgtgtgcaattatatatattttatatatataataaaagcttcaaggttggagtaagtcaacgggattagttagatttgtgatggtaattagaagtagcaacaagtggggagatggttgtggttaatgatgtattagtagctgtgcttttgtcagcttgtgccagtatcagtgtgttgtatgacatgtgtgatcatgtctttgtgtgtggactgtttaactgttatcttctttaatttaataaaataatcgatgtgatatcactgatatatggaggccctgctttctcagttttcatgtgctatttggcatcttttctgtaatgcaagccttggtttcatgcacggttatggtgattagctatgatgttgaacttgaattttgcagtaaccaaaacttatggaagtagtggactgcttcattgccttggctaattcacaatttacatggttaaaccgttaaaacacaagagggcgcattcagagcaagtttaatggtatagccaactactagctccaaatcatctatagtcaatgtaatagccaattcatacaatagttgcttattacttcctccgtttcacaatgtaagttattctagtatttttcacattcatattgatgttaataattcatacaatagttgcttactactacctctgtttcacaatataagttattctagcatttcccacattcatatagatgttaatgaatatatgttaatgaatatagacatatgtctacattcattaacatctatatgaatgtgggaaatgctagaatgacttatattatgaaacggagggagtatagtattaatacttggtattctctctctttttatctctttaagatatgtttatagttagcttatagcctactattgtacctgctctcatagcgtcttcctgaaacttgggtgttagactacagtgtaatgcagcttcagatgtattgcccacaaaaacagatgcagcaataagattgccagaatagcttagggttctccgaaatataagaaaggtgtacagtcaattcagtgagacaaatggcaccttgcaattaacaagtcactgaaatcaccatcgccatcggcaaaagtcaagttacactgctaatggagtcccttttgacaaggcatcatacatgccatgatactactacagtcatagagtcagagaaagggtgtttggaaaagtaataacatcagtgactagagagagcttcagattattagcaacatggtaactgaaatcacactggatttacattgtacatgaagcatggaaacctaaaactatcaaggggcacacagagtcctagtaaatgccagcggaagtacaccaacttttccttatactgaggctacacaacatggaatctgaatcatgaactgtccaagccatgttctgtttgtggttgtgactgtgattgcagctctgcctgcggctgcggttgctgatggagctgaggttgcggctgcagctgtgggggctgctgcggttgtgggtggagctgagattgcagctgcagctgtgggggctgctgcggttgtggggggagctgagattgcggctgcagctgttggggcagctgcggttgctggagaagctgaggttgcggttgcagctgtggaggctgctgtggttgagggtggacctgaggttgaggctgcggagtttgctgcgattgaggatgcagcagctgttgaggatgtagctgtgagggctgttgttgtggttgaggatggagctgaagttgaggctgcaggggttgctgtggttgagggtgcagctgaggctgtggtggctgttgtgtttgttgctgcgcttcaggttctggctccttcggtttggcggcaccattgttcatccttgctcgggcctcagcaaacatcctctgttgctcagctacagcttgttcctctgtcatctccacaccagtgaatttgcttgcttttggagaatcctgctcgatgaaaaaatagtgtcaatgtatcctgcatagatgatggatactatgcatatctctgtgggaaaaaaatagtacaaaccagggtatcatgcttatggtgttcgtaggccgcttgaacctcttcaatgtactccctaaagccaagatcctgccaaaatgaaaaaaaaaactgaaataagtctggagatttcacatattggcgagtaccaactactagttggaaaacaattatttcaaaggtagatcagccagaaataggtttacactgcagggttccggaacctggagcctgagtgtttggttaaaacaaggttctcagctggttctatacatattttttcatttacaaaaaaaaaaaattcgagcttttcaagacttgatgtttgaatcatgtagaagcaaaagtacatctcccaggaagaaagcacaacactccatgaaggaagacaagggagcaaggagaatgttgaggtcctatgaaccgtagccaatgctaagccactgcttagcattgcaatgcgatgaggcaacaacatccaccataaaaatttccatcatgtggttatcgccgagtgaatgtggctgtcaacaacttctgaacttcatggtgtgttttaacattggacatcaaatgttgaggctcaactcctgcccaagaagtattttactattgaaatgtttccattgaaatgtttccattggaccttgttcaatacatatccatgatctaaccgaaaaaagtccaccagggcccaaaatggagtacgagtttaagaccacactcaattgggtagtccaagcccaattctactttcagccccctaaaatcatgttaacaaatgaacacatatgtgcagatcagttttagctgtgtagtaatagcattccatggcatatagatatctgaactgccatcagacaaattcagcattttagtttcagactttagtcaatagtcataaccaatttgcactcagaaaaagagctctaagatactcaaatccttcattttcaaaaaagaaacattcatatattccccttttactctgttccaggcattctgttatttttatctttattttgcagtatactgaaacaatatagataaggtccataatcataaggaaaaaatattgacaatatactacaaaactacgaccatgataaaacaggtaggacagcatcataagtgataaaaaataatgttaatattcaggaaatgaaaggcaaacctgcagagctctaagaacatgctcaggagcaatagttttcttgtcctctcggctgcaaacttcattggattcagaagataggaggttgatgaactctgatatataaaaaatatgcatattgtgattagatccagaaagggagaaatttcagctattttttacaaccaatatcccttaggttgaaataaggttgaaagttgcaagagacatcttgcaagagacatccaagaaaatatccaaactgtttggggaataacttattttaatgtttaaggaactcacaacatggagggattataacatgaataaatttggtgagagtatggattttatgctccaggcaggaaaatacggtatgtgattaacaatactatacacaaatcagatatcgaccctaccattttttttacgggccacaatagattttgcattagaatcgtaaatacatccagtcagacttgactaaacatagaacacttaaaatcgtaaatacccttaattctcttttacattaatgattaaacatagaaaacttagaattgtaaatacatccagtcagatttgactaaattttaccagataataacgtcacaatggtccaccagactgtttttaaaacggataactttgtaagattaaaaatacactgttcatattcttgattaaaaatagtaccaacttctcttacctacacagcattccacaagaagatcttgtgcatctcttgccactcgaacatcagggggcaacatctcctttataatcttaaacattgttgctgaaatgtaacagaaaacggctaacttaaatcagctacaatttattacagaaaaatgctactacctccgccctaaaataaagcaacttttggctatgaatttcgattcacagttgtccaaattcatagctagaaatactacatcaggcccagagaaatatttatggatcacaattataattcgctaaaacagctgcgctgtgctgtcaaacgtcaaagcagtaaacattactggacttcatagtaagcatcaaagaccatttatcacaaggtttataattgaaatgcattaattttcgatctgaaggaaacaactactcaaggaaaggtatgtggctatgtgctataaccacaaaagaaacaaatcgtcaacttggagcatgaaatcaatgtacacaaaaggagtaccatatttacaacaccaatcagattatcagaacccgacaaatgtagtgccaacttcaagcaacatactcctaagaaataagcagcacaatctagattttccatgaaagttaacattctattccatgtctgctgtcatcgataatatctgaaacatggaccgatcacatacaatctcactatgcatcaaataagaaaacccctaaaataatcagcgcaatcttcaagtccacatttaccacaaattcacacaacctaggcatacagaatctattcaccaaaagtgaattcaacctccctaacaacggattagcacagcagaacaccccctccctccctctgtaagagcatgtaaataaaatcacatacaaaaaaaaaagaaaccctaaattcttgtctcaacaagtcgcctgcctgagacaacacacataatgtaacctgacgggagtatcaactctaaaaagaaatagaactgacgcaaattaaattaaattaaattaccctaaccagataattcgcagattaaccatggcccggtcgcagacaagcacaattgcatcaaaatttctaggcacgaagagaaagcatgaaaaaaaaacgcataatcagaatcaagggagttcagctcacatttggggagggagacgtcctccttggacttccccacgatatccatcggatccatctccgcgtctccaggcgcgacacctaacgtcgggggggcatgcgccgttcacctgaaacccctccccaaaaaaaatttggtcagaaaaacaaaaccaaatgttagcgctagggttacggcaaggggaggagaaaagcttccagatctagaagagaggcctgagaaagaggaggagggattgctcaccggcgagggtgaggcgggggcagcaggccgcgcgagcggcgctgctcgcgtggcgggggtgggggggatcggccggcggtgctccggcgagctcacgcggaggagacggggaatcgaggaggggaggggaacgaacgatgatgggcaagggaggaaggagtcagagtcagaggagagagaggctaaccgattacgatgggcttctgcttgctgctatgggctttttgaataggcggacagaatagactacggcccggctgaaagacgagaaactaattcgcgaacgcgcgtcaaacacattttcgaccattaataagtgaggaatccatcttaggacctctttaagctcaaagggcctgttcctaatacgccaccattaataagtgaggaatccatcttagaacctctttaagctcaaagggcctgttcctaatacgccaccattaataagtgaggaatccatcttaggacctctttaatctcaaaaggcctgttcctaatacgccactagtcgggcgcgcggtcagtactaatagtactagtactactacagtactactattactactgctgctgctgttgttatactactattattattactactataacatatatatatatatatatatatatatatatatatatatatatattgatgtataaaaaaatatgcacgtatacaaactttgtatatgatatatacaaactttatatacgtacgtattaaaaaataaaataaaaactagaaaatacatcacgtatacaaagtacaaactttgcatacgcgtatacaaactacgatgtgtataaactttatatacgatatatacaaactttatatacgtacatattaaaaaataaaataaaaactagaaaatacatcacgtatacaaagtacaaactttgcatacacgtatacagactttgcatacgcatatacaaactttgtatacgtacgaatacaaactttatattcatgcatctttaaaaaaacaaaaaagaaacagaagagaaaccggaaaaaaaaatgaaaaaaccaaacaaaaagaaacgagaaaaacggagaaaaaaaagaaaaaaaagaaaaaaacaaccgaacagaaacgacaaaaaacaaagggaaaaacggaaaactcgctactccctcctcctctcgtgcggcgcgtccgccgtccctctccgcgcgcgggaaggggcgcgcgcgactgatcgcccgttagctttttcgtgtttagggagcttctaattactacagctttttccgtgatcagaagctcccctaaacagtctactttttggtccagatactgagaaactgtagttgtagaatccagaaaataaactagaaactagaagctaggaaccagctagcttctcaccagctgcttctcagaatcttaagctcccgttgatgtgaaaaacacacactggcctgagagatctgaactctagtgcaggacctaaatcttgcttttaggttcaaggacgtgccagttggtttgatcctgtaaccaacaagaaacatggaaacaaagttaaatcctcaaacgatagccgatcggctatggccaatgacgtatcgtttataacctagccgatgttgcgtaaagtagatcgacagtgagatataaagcaaaaagaaagttaaatctattcgatcggctgtagatatcaacaatacataaattaagtcttgaaaatatgtttaaactaagtgattgggatagatcggatagtgtgccgagatagtataaatcatttaaaagtactccaaaacagagattatatatgcttatagcatagccgatgttatagatttaacgtgtatcggctaatactccgataccactttatactaagatatcaatataagcaaaatatattaaacataaatcaatcaagtgctaagatagcttaacagattaataacaagcttaatatattttaccacagtgagatcttgatataaagggcagatttagcatatcaagtacataaaataatgaacaagatcaggtaagaacggctgaaactccgatactatctctaatagcaataataaaacaagctagatattataattctagatattacttaataggtcggacctaaccgatgcagcattaagcataaagagaagtataagatctaaacaagtcaatgaaagtctttcgagatggtagatacactatataatctaagtcaacgttgatatctaaccttatcggctggaatccactagtagatgttagccgattcaaggttagatagcaataatgatctagattatatagaatatatgataactcgacgaattacatcaacaagattagagtgtcataaaaatggaagcactaatcccgagaacgcaagccgtcataacaagttttacctcttgtcggagatctagactgatgcagccaaactcgaaagcaagaactcgtcgaaacaaaacgaaagtaaaagggtggcaatgcgccgaaagtgttgttgaactgattgttatctgattacatgggtttgggtttgcttttataccaaaagtacataatatgtccttgtcagacacgactcctatctctattacaattctagatacgaacaagtcccttaggtgaactcttaccgactcaaaatataaggaaattgcataaaatatcctaattaatagatacaattgccttcttcggactcaatccatgtgtggcaatactcattaagcatatcaacccaatctgataatgactttgatctttttcttgtcggaatcggcttcatcggctgttctggccaccttatccgattcgaactctgccgatgcgcactctgtttccgaaaccgtcaatccttttgattccgcttcggttttaactccatctccgatgcttaatttaccaaatttggtcgttaacagctccccaaacatggcctaagattttgagaagcacttgattgttatctagcttatgaggatttagaagctaggttttgttaggtcattctatagcttctgttgtaatagttagccacaattttataaataccctattattttatgtaaagaaatttcctttgaaatcttgtccaaatgtatgcaatgaagatccagattgttgaatctgtatcaatttactgatccagggcttgatacatcagttaccgaatcattagtttcgggaccctacaataaactttgatttgggggaggacacgacattggcggtccgactacaactaccacaggggtgctgcgccttagcaaccggtacacagactccacgttgttgttgttcttgccgtgccaagaacaaccttgaacctacaagcaatcgaagaacaagcaagaacaagttaacaaaaggaaacagctcacaacacttgtcaaatgatgaaactgaaacaatcgaatatggggttctgaatacaagtatccgggtggtctagctgacacacgcgagtacaagtagctgaaactaaacttgcatctaaacaaaacccaaaaaatgcaaaatggtggctgctagggtttatatgggtggagggatgaccaggagaggaggtggaagaaaaccctagtttttgtggacctctaatgggctgtaaagatacaaggcccaagcccaagtttctaatgcgaaaactattttagccattctgagcagcttgggcggaatctgatgctgaggccacacatagttgaaagtagacgacgagatctttccaacaagtactcatttgccccatcgcacttcggagtgaagagcattgacttcaccaaatcaacgctgcttatgctgtttgcgatctggttcctctctcatattcctaacaagtagatcacaacaaccacttagtagcacccaattttgataagcacttgtatgattagctaggaacgactttacctaataattaagttcacgagctcgagctctagtgattggtccttactgtgcaataggcatggttgtatcgttggaaaggatgtcctcatcagccaggattacaatgtacagaccttgttccttacggactagaccttatagatatattacaatagtaaccaactaggattacaggatattttcttgatataagttaacataattcccgaatccttttctaaacatattctacccatatagactatcccttgtaaatatccatgctgtgtgggtatgtggtacccataatgtccacggtatcgcgcatagcataggtgcgagaccaaagcgctctcgcgcctttggagcacgagaccgcgtgattagcggtgccgctttttgattagcgatagtgttattgccttcgcgccgccgttaagcgagatcgccgtctcactaaacaaaagagagaaggctgtatatttacgtaaatctttcccaaatcagtatattcttgtgatttcggtaaaaaaaacatttttttcaattttttttcgttgttgcgcgcatgtgcgatcggcacagcgaggagcaacaaggcacggggtcgaggcgggtccggtgcaccgcggtgctcgggagcactttgcggctcacgggagaagaaaggagctgtatggcgcttgtcctggcccgctgtgtccgtcaggcttgcccgcggacggttgcggcgcacgagagcgacaaggccgacacggcgctgaagtgaggcggcgcacgggacggaggctgctcgcgcgaacaaatcctggcgtggttgacacggcgcaggacacgcgcgctgtgccaggacacgaaataaaggcggcaacgcaatcatgtgtgcgtgcgtggctaaacgagtcggttggctaggcctggaaggctcggctagcggctcacgggttttggtatttcttgacgacattagtagaaatataattccaagcaatgacgcagaaatacttctggttctggtatattatggttacagagttcatccgcaagcacacggatataccattgtagcatttaacccgagagtattccaagggtatcgtatttattttatcccgtgggaagatcatgtaaagagagattgactaataatttatatattacttgtgataatcatattctaagcaggggttaagataatccaagggtagagtgacacacaagcattaacaactcattctcataataaataatctaagctaggtggaaagaaaagagaaaggaaatctattcctatacttaatagtatacatagtatagtatacatacattctagttaactgatatactagctaataccctctatccgatgccctcttggtacttcgagaagccacccctgactgccgagtttctttcgacagcccgtcatgatcatacaaccggggctaaatacgaaggaataccctccccaggaaattaactgtcggagatatgggtccgggggtatgtgaagtagaggggagttaccttccctccagccacgtggctctgcaagctggctgtcacgcccggaaattcactagtaatttccgaactaatttgtgcataaaatcctcgtctaggaatcagccgaggtacacaaactgacaatttaatatacaaatccatcataataataacgttacatacttacaaaagaaaagaaaaacagcagcggaataacagtctagcgatggcttcagctccactcccacaggcagctcaactggggtataagccaaacgtcttctccttctggatcctttttcttcaactgaggtttaatgattattgcaagaatgagcatatgacatactcaacaagccacacagcaaatatgcaagtacacaaggataccaaaggatggcataatatagtctcatttgcgaaagcagcatttagtaaagatttaagagtagtgaaacagtagagtaattaatcatcaattttaatcaacactgaacagcaccccaatgctgcacagggccaaccatcctgaacaaccgtacccggctgtacagatctaactccaaaccaggagctaaacaaattattaccagttattgcatcaataattatttgtgagagttgtgagactaatcaaaaaaacattgctcaacccgcccataaccgcgggcacggctattcgaatagttttactctggccagaggtgtaccactgtacctacaagacacgattccacacatgttgccatgccccgaagtaccaccacggcactgcaaagggggaaatcgtgacaatacccttcgcacaacacaactcaccacagtgcaccattcatggatcataatcaccccctcaaaaaccagaggcatggactccccagcgacccccacggacttctcgccgcttctcagtctggcaccccgtaatgaaccatgctatacaaaagataaagccgttgcccccgttgcccacgctggcttgtgattggtacggttaatgtttcacaacagtagctcgcgaaccggtccttaattgccatgagcacgaccttcaaaaccatgtgctcacaacccaccattgacaagttttaattatcaattaattatcataacacgattaaccatcgtgagctacatttaaatctaaccataagtaataatgtaatatgattcaccccattaatgagctaatgtttctaagcatggctaagcaattatatatatatagcatttagctgaactaaaccaatatataaggttctagctaatcgaattataacccgtaggaaaataaattcatcttcggccaataattaattgggaaaggctcaccacccgatgacattcgaaaataatgtataagttgaaataaaacattagctttaaacgggttcaacatgctcagggtcgtttgggatccgtgtgacttgccttgagcttctgcaaaggcttccgaacctttctcaacgaaaacgctctcctccggaacgtcggaaactaaagcaaatgaataaaatcaacaaaacagtacaaaaacaatcataaacagtacatgtggatatttttaacatgtagatctcgattttagaaacatttagcaacttgaaccactcgaatcggagttacgatgaattagttatgaatttctgaagttttaatctatttgcatctagaaaaaaaactggaaaaaggaaatatgacgtcatgctgacgtcatcatcgccggcatgacacgggcgacgacctcgccggcgatagagaggtcggcagggctatctaaaggcatctacacgtagaggacgacgacgcgaactcaccggtactagcaaacgcgatggacgacgacgaatggtggccggcggcgagctctagcggcggcacggctcgggtcgtcggcggcggcggctctccggtgaccggcaacggcggcgagggggcggccgaggttccccgcctccgtgcgcatctaacggcggcgacaggaagcggcggcgactgataacgcgacggcgcggcgcggctggacgtcggccggcggcggcggcggcggcggcttggacggcgtggcggcggcgctacgggggacgagaaggctcgggagttggggcaaacgaaagaggacgccaaagggatgctatttataggcttggattagagagatcggactccaaacgagaggatttgagccggaaaatccgagggttagttggagagataaactcgaaaacgaattcgatttggtttatccgggcaaaattaatctccgagactttaaaggaaagggagaggataaggtggagatgatttcccctcaactaattttaggaaaacacaagagaaaaggccggatttggtggaggaagcggcggctgcacaggtacaggacggcagctcgggcttctgtccaagcttgaagatgaatagtacacggggaggctaattagactttcggctgggcttctacttccaaggactgattaaaggagggacaaaaagcagactttgggaaagagagggaaaggactgcaggctgagaggagactgggccgagagtgagaggacttttcctaattcggcccgaaaaggaaaaggtgaattttaattacttttccaattaaattaatcactgaaatgatctttgaattgttaaaaatacttatattgctcaaataatttcaagaaaaatcttgaaaatacttggaccctcaaagtatttaaaaaaattataatcagaccatttaatgattaatttaatatgtggataattactgaaattttctttgtatgattaaaattaagaattgagctctgaaaaatccgagaaaattccagagagtataattaaccatggaggatttaataaaaattaaatccatccatgctttatatttaggaaattttatttcccacatttaacttcacttgtaaattaatgaacatttaatataaattctaataataatttattaaataatttataaatctgaaacgaaaatcaggacgtgacactagccccaccgacgcgtcccgcgagtcgcgaaagcggcagggggggggggcctcggggcgtgatgtcgccccctcgagctctcccgtagcttcgccccgaggccctcgcccggctgccacgcggcggagggagagagcgagaggggaactcaggctgaacaaacataaatgtgcgacgccccnncttgatgngtngctgcggaggaggcgtcgaccatcaagnngccccggnggnngggnngancgccgcggagaaaaacctacagaacgcactccaacaanntcgagaactaccggagtcccggagtaagtaggtgtaccacgcagagcaaaatatgtaagtctccgcggct

SEQ ID NO: 60479 - DNA, 16471 bp, Oryza sativa
aaccccttactcatttattaatttaaacaaccatttagtcaaaaggtatttattttgtatttctaaattatggacacccaaactaccctgatctttgggttggcaaataatatcccatcttgtaagtctgtactttttcttatgatcatccccttgccaaaagaatgttgatctataataatcaattttttgaagaaccccttttggaatctaaaaaaagatatcataaacatagctaaactagaaagaacagaattaatcaaaaccagtctacccctaacagacatatgttttcccttccaactactaagtttcttctcaattctttgttcaataactttccaatctttgttactaagctttctaaaatgcattagaataccaagatatctaactggaaaagtacctaacttacaaccaaagatagtagaatattattcataaaagtcctttgcctggccaaaacaaaataattcacttttattaaaatttattttcaagccagacaacttttcaaacacagataaaatcaatttcagattcttggcttgttataaatgtggaattaccccattaatggtaccaacatccacacttttgtagcagtgaccaagacctaagtcagtgcgttgccctgaaaattacatgcatatatgaaacagatggtgatttatcaaaaatcatatcattcctactcaaccatagagcgcaacatataacagaagctcctatgagaataagtttcctatttttcttgtccacccccagaagccaatcatcaaaaatatgagatatgcaattaggagggtaaagaccaaaagagaactatacagctctccaaataaactttgcaaaatggcattccataaaaagatgttgaatagtttcattcttcatacagaaacaacatttcaaacttccattccagttcctccttgccaaattatctttagttaatactacccctttaagcaagtaccacacaaagatcttaatcttcagaggcatcttagacttccaaataatcttatttctctcaatataaccattgtttattaaagccagatacattgaccggacagaaaattggccattctgatgatagttccatctaaaacaatcactctgttgattcaactcaatatgtacaatagaagcccacaattcataccactttgctagattctgaccaactaaagccctcataaaagaaacatttagcggaacaggtctcgtaacattagcaactgaagaacttttccttcgaacaatagcatagagagatggatacctacctttaaacactaagttatctagccatttatcttcccagaatctaacttgttccctattattcagaatccaggaacccatgtttaagaaagtattcttaactttcataagacctaacaaaaaataagaatcaccttgtttcctatcaacttgggtaatagactgattataaagatactttgtttttaataagtcttgccaaaccccttactcatttattaatttaaacaaccatttagtcaaaaggtatttattttgtatttctaaattatggacacccaaaccaccctgatctttgggttggcaaataatatcccatcttgtaagtctgtactttttcttatgatcatccccttgccaaaagaatgttgatatataataatcaattttttgaagaaccccttttagaatctaaaaaaagatatcataaacatagctaaactagaaagaacagaattaatcaaaaccagtctacccccaatagacatatgttttcccttccaactactaagtttcttctcaattctttgttcaataactttccaatctttgttactaagctttctaaaatgcattggaataccaagatatctaactggaaaagtacctaacttacaaccaaagatagtagaatattgttcataaaagtcctttgcctggccaaaacaaaataattcacttttattaaaatttattttcaagctagacaacttttcaaacacagataaaatcaatttcagattcttggcttgttgtaaatcgtgctccgaaaagatgatggtatcatcagcatattgcaaaatagataaaccatcatccaccaaatgtggaattaccccattaatggtaccaacatctttagccctcttaattagtagagctagcatatcagccactatgttaaagagaataggagacaaaggatccccttgcttgaggcctttgtaagtttgaaaattattcccaatttgatcatttactttaatatcaacatgaccaccctgaacaaaagaaactatccattgacaccatttaggagaaaagcccttcattctcaacgtttgttgaacaaaagaccatttaaccttatcataggctttctcaaaatcaatcttaaatattaccccacttttatttttacgatgcatttcatgaatagtttcatcgagaataacaaccccttccataatatttctctcaggaataaaagcagtttgagtaggactaattactttttgagcaacgccaattattctatttgtagcaaccttggtaaaaaattttaaaactaacgttaagtaagcatataggcctatactgttcaattttcatggcctccacacacttagagagatataccttcccattttgtttgatttggaacatcgcacaagtggttaattattcctcgacgctacattatactccctccgttatttttttttcgccggagaggccagaggaggccatccgaatatattaaaaagaataaagttacaagaaaaagcgatagaaaactatcgaggttgaaagtgcacgaccaaaaaccacatgctaaccacacaagcacaacccactgagagaggaacctagcactaaaacgacccccgctatgcatggccgatcgccactgggcatacgacaacaccacaagatgagactctgaagacgatgctgccacggaggtcacaacatcaaggacaccgccatcatccatctatgggagatatggttttcacccagagcaactcgccaagggagagaggtatcctcgacaaggccccaaggggggttacgatgccagaaggtgtagccgctgccagcccgatgaaccatcacgcaaggctttcgcctagaaccctgcaaccctgcatgaaattcgtcacccatgaactcagaaaccaccacacaggcagtggcaacatgaggcctccaccccatgtcaccggtgccccatcaccggctgacttccacacttgttgttccctgctgccaccctagaagctggcccatgcctccttcatcccaccacctgctggcctcctcgtcatttttgccaaaaggagaacccggacttgacagcgtcgcgtgggtggccaaagcttccctcgttaaccaactgccgcctcgatccaacctagaaactcccccacgaagaagggagaggagctccaagaagggcaagggtgcccatcagcaacaaggaagatgacccaccaccgccagctccctttgcactaccatcattacctgctccaggcacatttgcgccggtgtcaccaccacccttctcggcttcctggtcgccgcgccgacgcctgcgccaccttccgagcacacggccgtcgcgccaacgccggcaccactaccgccgtacccagccgttatttaatatacgacgctgttgaattttttaagatatgtttgaccattagtcttcttaaaaatatttaattaattattatttattttattgtgacttgatttatcatcaatgtttttaagcatgacttaaatatttttatatttacacaatatttttaaataaaatgaatggtcaaatatttgtcaaaaattcaaagacgtcgtatattaaaagacggaggtagtacttgtttatcgacatgatgagtcgagctatgttatttctgccttcgtttgataaccttatcaaaggtgagaaaatgcagagcatggatttagcttctcatgttcagttagtttcttgcattcttttcatcaaattttgtgagcgcttacttttaaaccttggccaaatattttttttaccgaaaatagcgggagaggcttataccgtactatatatattatataattatataaggaggatatttactatgcggatgtttacacagagattatgggtaaccaaactttggtttgccgattttcagtatgctagttaatttggtcgaaaattgagcaccccctgtatattatgctgcaccaaagaaagaatgcttactctgcacagtctatatattcctctttgcagcatatctacctactttcgaaaaaaaaaaacctaggtcagtcaacgagaagttttacagcgaatatatataggtggaacaaaactatttccaatttgattaacattgaaccttgtatgacagattaaacatatgttaatgcgtcgtcaaaagtgctgttttgataaaaaaaatcctgaattattcaatgattttctaaaccaatccagagcaagttaggttccaaaggtgagatcatgcacccaaactactcatgtgacaaagcaagaatatgataaaacaaaggataggataggaatacatgtgtaaaatagaggattgaaaacacagaaacttcatagaaattggaattcggataggtggtaggaaaatcacatgattttttttattattgcataataaccatcaaacacccaacaatcaaaatttacaatgatcgaagaactaggcttatttcgttgcttccaccgttcatgaggtgatttgcctgtgtgagccagccaaaaaatgagctttgagtggataatagctttcctgtgtttttcttctaaaatcacatggaaaggaatttcatattttgttttttagaaaattccttgtataccctaaaattttagctaatcctttctattcctttgaattttgcttgcttctttatatacccaaaatttgatttttagcccttccatacccctcccatcagttgagcgttagttgaccgtctaatttctataaatatgaccattttaccctttgaatgaacatagaaatttataaattacaccattgaaaatgtaaaagtttgtcgcatgacactattattgttatgagtttgctctttgatacattatttatgacaaaatttatttttagataatgaaataaaaatatgtatttattttattttttttaaaaagtcataaaaatgaggagcaatcatgcaaagataggacaacccacgatattttttttataaatgctcccgataaaaaaaatattttcctattaaatttcaaataaaaattttaatttattacatttgtttcattttagaaatttatgtcaaaattttctgaactatttagtctcattagttatataaaatgtacatgctgtgcactcaaacaaaattttcaatcgtttttgaagcttatattcaaacataaatcaccaaggacattaaagacatttgccaccaaacttaacagtgaccgcttggccatgccgccaaaaaatacgatctaaaatcgagaaaagagcaagtattcatccacttttcttactaaaactaactttcttttatcttaaatctaattctacttacttttttctaatctttttcaaaaaatctattcatgctttttttttgatccagttatgattatagactctaccaagagtctgacgaattttttgcttcatccaaatgtgtaaaagatcgtagtcgcacttaaaagccgagtactctaccattaatgaaggaaaatgtaacggcaggggtgtataagggatcaaattgaaatttcagggggtatagaagtgatcggataatttcagagatataaaattgattgagtgattttttaagagtatacaaggaatttactctatttttttcccatttggtcattcctacgaaccaaaggtatctactgtgaccattcctgtaggattcaaattcctaagtttttcctccattccgaagtggtcctcgaaagctaggaatttggcaagtatcttgaaccatctttccaaagacaacaaaccaaattttggctagccaatgcttagtttggttccataaatcaagcacctgtaacactacaaagtcttaataaacgcatatgactaaataaacgcataattcttcagttcttccagcacttatttgtctggtgctgcatatccacttcgaagaaaattaggtcaatcagcaccaaattacagcgcgtatagatggagcaaaaccatgtcttatattgtattaatgttgactgttattccagtgaggaacaatccataaacctttaggctgagtttgaaagggagtttggattttgctactccctcgtttatcatgagaaccttcccgaactatcaacggtatgttttttataaatacttttttaattaatatagaagtttctttaaaaaatcaaatagactaatttttaaatttataataattaatactctattaattatgtgctataataacttatcttgttttactgccactaaaaatcaaagacaaactttactttaaaactcagccttagtcttatatgaaagaaaccaatggcacatcggcctattatattgtcaaaagtgatgtattattacgtataaataagaaaggcgaaaaaaaaaattcttcgaccgatttctaaaccaacagcagtggtaaattggattccaaacgtggatcatgcatgactgaaatgcaattccatagatagatgatttgaactctcttttccagaaacaactaaaccatgcagtaagctgcagctgaaaatcttaggatgaaccacacatatgaagccatatgcatgcatgcaggacaatgattatatatatatggctagtagtgtttctctggtgccacttgcagtgatgctctaatgagcaagaactagagcctttttctacatgcagcgttgcagagctaaatctggaagccccaacttgaccaccatgcttggtactttgagcaaatagaatccatgtacttctccaaagagtctaccattgatgctagtcacaaagctagcttgcttccattgatgctagtcacaaagctttgtttcaagtggatccatcaacttgggccttacattacatcttgtctgtgtacgaatgatggagattgatcaccctgaaaagcaaaatattaatatatgagtgtctagtcttatctaatactttctgtgtatgcatatcatcgcatggttatatcctctgctcccttcattggatgactacacattatatatattacatttggggaaactatatgcacatgatatgtaacatgcttcaaagcatatgccaccctattgatgcatatttgtgcataaagagaaaaaaatgctagaaataattttttcacataggtcacgcatatgatcccggtactagctaaccaaactatagttaaatacaagttttatataagtaagattgtagttacagtgtagttacaatatagttacaatgtaggtacacttcaattatactacagttacatttgaaagtttttcataaaaagacttgcggtacgatttagatttactcatagttttccatgatgcatttctgattattttttagttgtaaaccttccgtgggacatcttccatataatggatacatccttgatttgtgtgcataggtggaacaaccaattatgcaagtgggtcatccaaattcaaagagaaagctgaataaagacgatatatgtccagttaattggcttgggagtttaatgttaggggtcctgcacttaacagtgtagtgtggattcatggaattccctagaattctatcacatcatcaccaatcaacgtctagaacagaggattcatggaaaatttcttgctgatgacaaatttggaatatatagaagctactgaaatcatcagattttcaatgatataatgcttccactcgaaatttgacactaccctaccaattctagtattgcaaaacataagcgcacttatttagtagcataagattgcattctcatatttagtttgctaccaatgtggagccaaattatgatattatagtgtagaatgttctaaattgataccaaatctactataggcaataccaatagcctttaatccaaagaattataagtatcatacaagctaaaaaaaataaatagtacggtacattttggtagcaaaccaaaatggccctaagtcaacatttagttgttaagtctagagaatttgatcaaattttcactcaattatgcatgcgaaccctaatattctcctccattcctgtatattctaaccctatatagacattttagtattttttatataaatatccatagggaccacccctattattttttgtcaaaaaaattagatgggagatcgaaggttgtcaatattttttatttaacactatgaagaagatataccagtatggtcgataagtagatcaaatatatatttatatatacatgatatgtttaagattagtatctgcatgtttaggcaacacaaattgatccaattatttattgatatgaatgtggttacgaataatatcttcataatatattttgttaatgtatacacatctagttgttcttgtactcccttcggtcataagtatttcatgttagatactactatacgtaaataatgatgtctcgagatactctcaactaaaggctctaggaatgaccacaactaacctaattttcatgataactaaataatgtaagcaaaggctaaaaagaacctatataaacaaacatttacctgaggaagagtattgatcatattgatattcataggaataagatatttttctgggtatctactgttgggatacgcgtaggctacaatagtataaatcaaaattttctatcgcgtaaaccagaaaccatgcaagtattagatcatatattgttaccactcgacgcgctgcgcagcggaaaaaggcgctaagaagtcgaaggaattctcgcgaagtagcgcgcgtcgatgtagaggaagtagttgatcgcaccggctcgaccttctcctcttcgtgtgttctcctcgctgtactcccacgccgatcagcaccgcaaaccagcggcgcctctaccagtatccacatgtacagggacagaacgccacgcgcagatgtgctagcacccacgcgtggctagagttttgctcggggagggaagtgacggctagagtttctcacgtgatgcaattactccgccggtcacacccctcacgaatatataggatccatcacttgggcctccaaggcccgtaggactcctattcggatccctattcgaattaagctcatattggatctccatccaatccccttattctggtccattaagcatgcgaccctgtaggttcatgtacactcggctgtaacccgaaaactccttttcggttcacgcgtcaacagcggcccctagcagaacgtattgacccaccgggcatacataaagatcatatcgactgaacctctactgtatacttgtaagaacccctttgcctcacgatatcgattaagctcaatgctagatatgtgtcatcctcaaatagctcaatcattcactcgaacttgttgatagattatataacttgtgattgactcctcaatcacctttggtatggccatacactttcataatctacaacatcaaggggcccagagatatctctccataggaggggcaaatcccatcttgattattcatatctcactacatgttttgattcatagcatacccgaaaactacttttataactacccaattacggagtagcgtttagcagtccctaagtaagctactacacatgttgggaaccatgataatctcaggtctaaggattcaacaccaacactaaatgagatcactgatgacacaacacatatggctcttgcagtgtcttatgttgcatgttcactaacatgtgtccacattattaatttggtatctctataccatgatccatgggacatgatcatcaattaatacatgtgctgatcatctaattatatttgttccacgtatgatatttgaacaggaatcctttagaaatagtaacaaacaacataaagagtctcatcaaaaaatcacatattcattaaccaataatgttttatctatttcgaggaacaatgtcggagaaatatataaacatagtatgtgatacaatcatctctatgattacctctagggcatatcactaacatctaccaacatcaagaaatttaatcaagcaatatatcatgatgctcatgtatatcagaagtactaaattatgttactgtaaccaagcaacgtaaaatatgttatttagttaattatgaaactttgttaatagcagtccggctattacacattactctattagcattgctactcaaatagtattatttcataatgatcaattatactgagcaactcattgaggcttagttaatttatgcgcattcagcatcatatcattataaaaacaaatgaaaacccacaaaacatatataagaagtagaacatttactaccacgaaggaatgaaccatatcttcagggctcaccacacacgtccatcatccatatgtagtgcccgatataatttttcaacaaagacaaatctaccggtcatatattagctaagttttgcaggatttaattaaatttctgcttgcaaaagcatctggatttaatgatatggttttcatttttcagttttgagtgggccggccgagtggcgtgtcgtcacttattagaatgaatttgaactccaaggattgataccagaaaagcgaaattaattaacgtggagaagcatatcatcgaacttttacagtatgaagttatcatcagatctctaatatggaaaaggaaaaggattgtacccctctgtttggtaattgtggttccaactttcgtaagaacaattatgtaatccttgattatggtacttaattaagaagatactaataggtatcatagtccatattatagaaatttactctgaggtaccacacaaacgtttaatttctagctaatgcaaatttgtgaaacctctcaatactttcttaagtatcataaaaacaccctaatttggtacattcaggtaacatactctctctattttaaatgtcgttgactttttaagatacatttgaccatttgtcttattcaatatatatatatatataattattatttattttattgtgatttgatttattatcaaatgttctttaagcatgattcaaatatttttatatttacataaaaaattaaataatacaaatgatcaaacgttgataaaaaaatcaacggtatcataaattaaaaaacggaggtaataatacttataaaagatgtggtccatctaaattattttacactaaaaagtgatgacacctatcaataccatgttcctatttgtgtgttcatttctactctacatgacttcagccggataaattagcagctatcagtgatttcggattggggtgtaattgagattttgaaaagccggtattttcagtaaaaaaaaaaagcacacctgtatgatttgacgtttaatactacattgctttagtttgtggagtacgtcctataaagaaaaccgtagaagatttcccaggaaagaaatggaatcgaagcttaggttaatttagtttagctaagcttgctcgtacaacttgatccattacttaagcaccaaacagtgatctacctctgcatatataaaccatggcagccctggcatttccagctgcagtgcagatcaacacatctctcatctcacttaattagcgagttatcttaacaactaaattaggtcaccattagcattagcaagctagacatataatccaaatattgttgctgtgtgatcgatgggcagcgtgtcgtgcggcagatcagcggcgccggcggcgctcgttgcacttgtggtggtgtcgtcggcgttgctgtcactgtcagctcgctgccagtgccacgccgcgcgatcttcccctctcgcggccgccatgtcgccgccgccgtcggccgtgacaacggcggcggcggcggcacgcggcggcggccgcgtgctgcaggaaggaggaggggaaggaggaggagatggaggtgaggcgggggtgggaggagacggcttgttgccgaccaacccaggcaacagcccggccaccgggcacgcacgcaagcctcccgcgtgatcatacgcatgatgtggaatatttgccaaagtgtgaagcaaacaaacgtacgacacgctgcgtgcgcgcgcgcgcgttaattagatagctagctagtttggacggaataatctcgatcgatcttgtgtgtgtgttgttcttgttggtttcgcagtatattttgtttgtgtttaatttgcgtctcgtggtttgtaagagttattctgacttcgtggtcgctagctagctagctatatatttatatcgttgtttgtgctcaagagcatagttatgatatgtaaaaaagatatatatatcgcatgtacatctatattgcaataaaaagacggtggttaattagtatattgtattgggaaaataccgcataggtgtctatatttttctccggtgatctttgaggtggcgggcatgggaggtggcgcgctgcaggggtgcaaccggtggtggcaggctacaactgctacaccccacctagcctattggatcccatggagaggagagaaggaagggagaagaagatgagccaccttcaagtaatcatgtccctggctacgctctttggaggctgccgcttcatcgggcatcgagccagccactcatcttctggtgaaagtggtgggtacaggtgattggccgccgctctagccgatctgtctcctaatccggctggccactaccatcgtagtagtgagcttccctttgagtatcggcatcggtaacgcctgtgggtgccacacatattcctagaggggtagtttccacgattcttcactcatacttgccatgaggtggacactcagagcgaaaaatgtcacaaccagaaaatcacatttcccaatcactactgtattaatccgcgtcctagaaaaaaatcatggtatacctcaacgaatttgatgcgaaagacacatctttattatgttgataatatttatattattataaaggccgtcagacctaacaaacaaaaataaacaacaacagaaaaacaaacctatatttccatcatcacatgcgctcaactagggtataagacaagactctacctaggacttcttctccaaagtttcacttactaaagaggaaaagattgaacaaaaatgaatataatcatcgtactcagcaagtcacaccgggagatgcatgattaatgcaaggtggtataatgaatagtattacagggttgagttttgcaacaaacaatcatttcaaatcattttaggaataaaagtcaattttagaaacatgttcctataatccaattaattatcaaggtcacgacccatgcgaacctacattaaaccacaggccaaaaacagattaaaccggccaagcagccttgtaccagattctaaatcgtcctaagccataccaggccaaccattccaagttttagttagctaactagattatccaaattttaactactaacttgagtacattactagggatgcccataatcgaggtacaactattcaaataggttttactatgattagaggtgtatatctttacccataagacacgccttcctcacatgtcaccacgtgcctcataccaccacggtacatggacggaaaaggtggcattgttctttactcatcctagccctgaacaaggggactgacacaaccccattctacagccaaggaccttgtgacaggtagaggttataattgcgtcccaaagcatcagctcacccatattgggagtgactactcgagtgatcttcctttgccacaaatataatctaggttatcgagctagctacttgagtagctttcctttgtctctaagacaatatccatcacaccagacttcgtctgcttctattcgtgtcccgatgcccaatactagactgagctacaaagtacgccttacccacactagacatgtggtagtacagtaatattttacaacagaagctcgagattaatcctcatagcggtcgaggtatggttttgggagttttgaaaggggaagagagtgtcatgtgaaggatatacctcctaagttccagagttaccataagtgatctgaaatagctcccgaaagtcacataataaaacatctacgtgttgctaattaagcatgctaagcataaacctaaaaggtctaataagcgccacatatatagttcttactaaccggttcttgttacatagggttgtcaagaaatagttaagcaataacaaccaatagggccataacaaggaataataggcctagctaagttaaacagttattcatcgaaatttaatacaacaaagtgcaataatttaaattaaaataacttctgtaaactgggattcgatatgctcaaggagagcatgacttaccttgctctaagaaaagggtcttctgaacctttaacaacaaactcaacccacactacgggatcctccagaatgacagcaactacacgaagcacacaaacaaaactaaaaccctattcaagaagcaataacaatacctagaaagcacaaacatggattctttatgttataaaaaaagttaagagaattgaactagttgattcagagatcatatgaccaagatcatctaaagtttaatgttgttatgacaatttacgaattattgtgattaattttagatctgtagaacatgtctaagacatcgacccaagaagaaaggaagagttgagttgttgacatttggaccttacatgtcaatctctagaccacagtagacaaagtgcatagaagcagtccgcggatctacggaaggggaacctatgtgtcaaccggaacaaatgaccgacaaatagatcccactagatgccacatgggctgcacatatgggcaaccacatggcgctcacatgagcatgtggaaacactgtcatcacatgtgcacatcactgcggcacgagcgaaagctgacaccgacgcacgaccacgtcccatcgacaaacaacagtataaggaaacaccaaaatgagagaaggcctgacgaggggatgatgagctcacgaacaggactggcacagtgaggagacaacgacgatgactgacaacgaatggacgaggacgatgtagacgaggagatgactttagtgacgacctagcggcgtaggcaaggcagtgctagagcatggcttgatgacgcgatgccgaaggttgtgatgatgaggtttggcagcgcgtcgacgaggcgggaatagcgactagaggcactccagcttgatagtgaaagacggcgatgaggacgatgttactgtggcagccttcgggcgattggagagcgaggttgaagtggagttcagcactgcgaagccgaaggcggtggcggttcagccgggcaacgctctggcgagaagaaacaaccggccagagttgcattgcgagatagaggaggaaggcggcgataatgaatgggttccggcgtgctttgggcgaagccgaggggtggccggggaaggagatggtgacgtcgggcagcactccaacaaggtagagtgaggaggatgtcgtggagagacgatgtagccaggagggaggtggcaaaacagaatgatgggagggagagagggctctgttttataggcaaaggagggagatccggtgatggaaagtgcggattggcagtggcaatcatgccgagcagccatcaatgccagcaaggaaaggcgcggccatttcgggcgtttcgatacacacaattattggggggaaacttagggaaaaaaataagaggaatgaaaggggggttaaaagtccccagtcaatttggaagcatgggatttaattcgggtggattttggggagcaacatgcagggtttatgttagttttatctttctagaaactctaaaaattgttctgattacataataattatttcttgtgctctgagtaacgttttagaccatggagattttagggggaaaaaaatactccaaggcacatttgaattctacttgtacgtatttcattgtttgtgatttcttttttggcttttaatacattctattattccatttcagaaattatttttaattgggataatttatcacgacatgacaaaaatcttattgtggatgtccacaatactgatggtgatatttcaaatgtcacgacctgttctgatggcatcgaaggtttcctatcggcgagttgtctagtactccgtatgaaatagtgtctccgtcagattggggaagcgggaaaggggaaacgatgatccgcatctgaatt

SEQ ID NO: 60480 - DNA, 14989 bp, Oryza sativa
  unsure (1)..(14989): unsure at all n locations
cgctgctgncnagtggatttgcttctactgcaagtagttcatcagtgaccggtctgtgaccggcctattgctgtcacatccgattggtagggtaatcatgtccccacgtcgcctctgtatccggcggagtgggcgtaggtatgatccgtcacatcggagcgtcgctcgaggaagggctgccgcaagtcctcactcatttatgagggaatgacagggttgttccccgtgtcaggcgggggacgacgccgggttccactcgagaaccggttgctgcttagcttccgggagaaggcatggattgaaacccagtcaaagtggagtgggatccccctcccatggagggtaggtagaggcggcgcatgtggtatccccttgaactataaaaggaggaccttgcccactgagatcgggggacgactcccagaaaacctgaactccaggagaaagaaagcgaaaacgctctccggagtgaggaaacctttgtaaaactcatccataatcccaaacacagtagtagggttttacgctccatagcggcccgaacctgtataatccgactgtgtgcaagctagccgttagtcttagggacgaacgagtgatttccaagaggcgagcctctgcccccggccgaactcacaaaagggggctcttacgactccccgctatcgaggatcttccctcgacagctggcgcgccaggtagggggcagttgcgcgtttcgagaagaaatcgctttcttccgtcccaagtttctccaggccttagccgatgatggacgaggtcctggaggtagaggaggaggcagtggcgtttacccccaccccgtccgggagtggggattccggagaaagccgtgatcctcgtcaccatcgccacggttctccaactcctccccgccgcgaaccctcgcggagggaggatcccacccattcgggtggttcggctctctctccaccccctggcggagggaggccgcgatgcgtcggggcacgccgccgtctcgattatggagacggcggttcgccccaaggagcgcttcaggcggcgagtgcccttctgcggcatcccccggtaaacccggagtcggagacccccgttcagcactggctggacgacgtggccaacttggtcactactgcccagcggcagttggccacgggcggccgatccaccgccactggtacgtcgcgtacctcggttaccctctcctcgtcggcaaggagaagggcccaccgatcggccacgatctcaaggcggtccacagttccaacatcgtcgggggcctcgggaagccggaggcatcatgacggcctctacggggcgcaggacgctcgaatcaacattgagcgacgccgggacgagcgccgagctgcccgcatgggggaaggcgccttctcatttagagtgccacgctccccttcacgaggcggccctccccctacgctcacccctggggggacaggttgtagggcctttgtggcgagtctccggaatgtccggtggccccgaagtttcgccccaaccttacggagaagtatgatggtagcatcaatccctccgagttcctccagatctacaccacgattatcgtggctgcagggggtgatgaccgggtcatggcgaattactttcccatgaccctcaagggtcaggcgcgtggttggttgatgacccagccccccgactccattcactcctgggaggatctgtgccagcagttcattacgaacttccagggcacatatccccgtccgggggaagagacggacctacacgctgtacaacggaaggacgacgagtccctccgttcgtacatacagcgcttctgtcaggtccgcaacactattccgtgcattccagctcacgcggttgtatatgcattccggaacggcgtgcggcataattgcatgctggagaagatagcctccaaggagcccaagaccaccgccgagctcttcgagctggcggacaaggtggcccaaaaggaggaggcgtgggcttggaactctcccagcaccggtgcggcggccgcggctacccccgagtctgcccccgctccaagcggcgagataggagaggcaaaaggaaaccagcctgcttcgatgacgagggccatgtccttgcggcagatgggcccgcatgggccccgtgcaaaggaaaggccaccggcgataagccaagccccactgttccctccggcgagggccggtcggcggacaagtggtgctcggtccacaacacttaccgccatagtctcgccgactgccgctcggtcaagaatttggccaagcggttctgaaaggccgatgaggagaagcagcagggtcgacgggagggcaaagctcccgcgacctcaaccggtgaccggcgagaggaggccaagaacaatgcccccgccgatgatggcggagacagtgaggatctggacttccagatacctcaggggaccgtcgtcacgctcgacgggaggggaggggggcttgcgctcacaccttttgccaaggcttcaaggccatgaggcgagagcttctggccgccgttcccatgcacgaagcggtccggaaggcgcgttggtcagaggtgaagctcacgttcgaccagagcgaccattcgacggtgctcgctcggggagggaagttggccctggtggtctccccgactatccacaatgtcaagatgaagcgtgtgctggtggatgggggggccagtctgagcatcatctccccggctgcctttgacgcgctcaaggccccggggatgaagctccagccgtcgctccctatcattggcgttactccggggcacacgtggccgcttggccacgtagagctcccgataaccttcggcgactccaaaaacttccgcaccgagcggatcgacttcgatgtggcggatctcaatctgccctacaacgcagttctaggcagagccgcgttggtgaagttcatggtcgccactcactacgcctacctccagatgaagatgccgggccctgctggccccatcaccgtctttggtgaagtcaaggtcgccctcacctgcgcggagcagcgcgcagacaacctagtggtggccacggagccacaggccccagaggcctctgcgtcccacacctccaagaagcgcctcacctcggctgacgaggtgcccgtcaaggagatcccccttggcgacgatccgtccaagaccgccaagattggcggaactttggacgccaaataggaaagcgcgctcatctccttcctgcgggcgaattctgacgtcttcgcatggaagccgtcggatatgcccggggtccctagggaggtgatcgagcaccgccttgccatgcgaccggatgcgcgacctgtccggcagaaagtgcggcgtcaagccccggagcggcatgccttcatcagggaggatgttgcgcggctcctggaggctgatttcatccgcgaagtgatccatccggagtggctggcaaacccggtggttgtcccggaggccaacggcaagctacggatgtgcatcgactacacagacctcaacaaggcatgccctaaagatcccttccctctgccacgcatagatcagatagtcgactccactgcggggtgcgaccttttatgttttctagatgcatactctgggtaccatcagattcgcatggctagggaagatgaggaaaaaaccgcctttattactcctgtgggcaccttttgttttacaactatgccttttggattgaagaatgcaggccctacttttcagcgcatgactcgtattactttaagtannnnnnnnnnnnnnnnnnnnnnnnnntttgtcgatgacctggtggtaaagacgcgccaccaggacacgttgctacaggacctggccgaaactttcgatagtcttaggtccacgcgcgtaaagctgaaccccgataagtgtgtgttcggcgtgccggcgggcaagcttctcggttttctagtctcttcccggggcatagaagcaaatcctgagaaaatacgtgtgatagagaggatgtgcccccccagcaagcttagggatgtgcagtgcgtcactggatgcatggccgccctgagtcgatttatatcgaggctgggtgagagggcgctacccctattcaagctcctcaagagctctgggccgtttatatggacggaggaagctgagcaagctctcaatcagctgaaagcttacctcacttcccccctggtcttggtagccccggggccggaggaaccattgctactctacttggccgcgacccctcatgtggtgagtgccgccctaatagttgagcgtgaggaaggcgaacgggaggcccctccggctcgcaacggcccctcgtcccccgaaggcctagcgcccaaagctcccagcccccgggaggaccccgaggcccccgagggaggaggggaggctttggcaggtggccccgagccttatgatcctgaggcaatccgggatccccccgggacctccgaacaggcgcgccccggatcatctacccctgacaacacgaaccggccccgccgaaaggtgcagcggcccgtctactttgtcagcgaggcacttcgagatgcgaaaacccggtatccgcaggcccagaaaatgctttatgccgttttgatggcctcaaggaagttgcgtcactacttccaagcgcatcaggtttccgtagtgacgtcgtaccctctcggccaaattttgcacaaccgagagggtactggacgggtggtaaaatgggccatcgagctggctgagttcgatctgcacttcgaaccgcggcacgcgatcaaaagtcaagtcctggctgacttcatcgcggaatggaccccagtggatgaacctgttccatccgatgtccctttcccccctagagaggaagaggatccaaacgccgacattcgcggcgggcactggattatgcatttcgatggctccctcaaccttcaggtgcaggtgccagagtcacactgacctcgccaagcggagacgtcctcaaatacgtcgttcgactcgacttccgagccacgaacaacatggcagaatatgaagggctcctcgcgggattgagggcggcagccagaatgggcatccgccatctcctggtcctaggtgactcccagctggtcgtaaatcaagtatccaaagagtatcagtgcaccgacccgcaaatggaagcatatgtctacgaagtacggcgcatggaacgccacttcgacggacttgagctccagcacgtgccccgacgcggcaacacagttgctgacgagttgttgcgtgttgcgtcggcacgagccccactccccccagggactttcgaagaaaggctcgcgcaaccatcggcgcgaccgaaccctttgagggaccccaacaacacgccctccaaccctcgtatggatgaccgacatccggggtatctcgacggcaatactcttcctaaggatcgcgcagaagctgaaaaggtcgcgcgcatctccaaacggtacgtcctcatagaagggaccctctaccggcgtgccgccaacgggatactcttgaagtgtatttctcgagagcagggcatcgagctcatagccgacgcccatcagggtgagtgcggggcccattcgtcctcagaaactttggtcggaaaagccttccggcaaggtttttattggccggctgcattacaagatgcccaagaatgggtccagcggtgcaaggcatgccagttccacgccaagcagacccaccagccggcccaagccttgcaggtcatcccactctcttggcctttcgcagtctgggggctagacatccttggaccattcaaggcagctcgaggcgggtatctgcacttgtacgttgccatcgacacattcaccaagtggcccgaggcctacccggtcgtcaaaatcgacaagcattctgccctcaagttcatcagaggcattacgtctcgattcggattgcccaaccgtatcattacagacaacggcacccagttcaccagtgagctatttggcgattactgtgatgacatgggcatcaaattgtgctttgcctcacccgcccacccccagagcaatggccaagtcgagcgagccaacgccgaaatcctcaaaggactcaagaccaagacatacaacgtcctgaagaagcacggggattcatggctcgaggagttgcccaccgtgttgtgggcaaatcggactaccccaagccgcgccacgggggaaacaccattttttctgatgtacggcgctgaagcggtcctaccctccgagctttccctggggtcgccttgcgtcacactgtataacgaggccaacatggacgaccttcaccgcgacgatctcgattatcttgaagaacggagaaggtgagcggccctgtgtgccgcgcgctaccaacaaagcttgcgacgctaccatcaacgtcacgtccgggcccgatcactacaagttggcgacctcgtcctatgccgcgttcagtcgcgcctagggctgagcaagctctcaccaatgtgggaagggccatacaaagtgatcggagtaccccggccaggcttcattcggttaaccacggaggacggcatagagctgcccaacccctggaatatcgagcacctccatcgtttctatccataacatcgagattttttgctttcctggagctcgggccagcccccgcacaacccctcggtttgtgcgggcctggccgggggctaccactgtgcatcctttttccttttacaagcaatgaatttttctactttttcatgaagaccgttttctccccttcctctggcttgtcctggtttaagggataatccgagtttgctctaaaccctaagtgccgtaaggcggcctgaaaaccgccgaaagggagcacgaacgcgggccgcgccccgggttgtgtcgaaccccgggggatcggaagggcctacacacggtcgtccccgacccccggtcgtcgcagcctcggtctggccagtcccgctgggcggctccctcggggcgatggtcttgcctatcaccacttaggtaccatggaccgagcgcggatttaccttttcgctagaacaagctcgaggggtggatggggtcaaaacgacatatcaatcacaggcagtctaattatccccttttgccctggttttttcttctctctatgtcacaggcacccaatggaaaaagcaaaagagtaaaaggggttaaggaagtttcagttgtagaacaagacaggatggcacaatggcctaaatacaagaagtgcctgctatgggcacacgacaaaagggaattaaaagcgcgagtagtcacggagtgcccggccccccgaggccagcgccactgacgatgtcgtcctagtcatcgtcgccgtcatcacctccacttccgctttcttcgtccgaggtgagcccaaaggtgaaccggggggccgacccctcgaagttcgagacaatcgcgtcggccgcctcccggacttgctcccgggcccttgcctcggtcctcgggggaaaatcttcgagcgcgcaccatggcatgatgacctcgaggacctcgatccgccaacggatcgtggcttcaaactcctgtgcggagcgggcacaatcatccaaggccctgcgttcagcctcgagtgccactgtccgggcccgcagcgaggcgtcggcctccgatgcccgccgctcgtgggcagcggctgcgtcgaggatgccgcgcgcgtccctgatcctctttgccaagtcctcggcgtgggcctcatactgaaggcggatgtcgcctagtgcttcatccagggcactcgaggcgattagcgccgcctgccgctcctcctccgtctctcgtataacggaatccagcgcctccttgcacgcctggatttcggctagttgggtttggcgcattttgcgccccaccctcaccatgtcgtccacggcgcgacgcccctcatcgactcgcgcgcggtccgcagcgagctgtgcccactctgcatccagggccgttcgctcttccgcccgggcttgaacttgggcgttgagcccctcttgtacagtggagtcggcggcggcgagcacctgcagaagtggctccatactctccgcagtcggggaagaaaaggccgcggtccgcccccggggcgacggggtactgctagatcccccgcgagactgggggctgctctcggctccccttctacgagaccagccccgagggcgccccaagcgcaagggggagcggctgtccctctcgccccccgcttggggtcctcgagtggattcagcctgggcctcgggctcggggccgcccccagcctcggcctcgacctcgggctcgggaccgccctcagccttgacctcaacctcgggctcaggaccacctccggtttcggctcccgagctacgacctccctcaccccccgatcctgggtggcgctccgcatggaccctggtcttagagccgccctcgggagggacgtcgccgccaccgtcgtccccggcaggtcgagtacgtgtccggtatgtgtccggtatgtgtcctttgggtcccaccgcgaggctacaaagaccccgcagccttggattggccaggcccggaccgctccgaccgtttcgatttcgtcccccgcgaggggtccgaccctgagactccctgagaaggaatctcgctacaagagaacccagatcatgttaacgaaagaaaaagaaaaaagaaagaacaagaggacgggctgggtaagagcaccgaagtgagcgccagcaatcgtacctgcagggagggcggttgaagatccacttcaggggctcaatgaagctccctcggcacggctccgtttgccctatcttccggagccgcttctttttctgtctggccttgggcctggcaggtcgcttgtggcccgctggcggatgatctgtcgcgcgctcggaacctcctccacgcgggggagagggtggccaggactcggccaccttccgcttcccttttgggccaccggccgagtcgtctccgggtccgcggctcgggccgggcgcccttgagccaccgccgcctggaccgctggtccggctcccgcccgcggtcgcaccaccgccacccgcgccgacggcgctatcgctggcgccgcctcggctggaccgactccagctggcaccgacagctgacatcatggctaggatgctctcccggtcgcggtcgcagcagaggggaagaatcccatctgggattagtgttggctcggcggagtctaggcccagcacccgccgaatcaccctcttcgcgtcctcctcacctcagtcccagcgctcgcccacatgcgtgcgcatggggtcgttgggaccagtgtattcccacgtgccacgggatcgctcttggagaggtgcgatgcggcggtggaagtaatcgccaaagaccatcgcccccatgaggcccaggcttcgcaggcccctgaggcgatcccaaaccacgtcgtattcctcgcccagctccgaagccaccagccatgcggtggatctttcaggaggaccagcgggaactcgaagtcgcggatggtccggcaacgcagtgtagaaccagtctttcttccagtcctcccatttcttgtgaagatggctctcgatgtattgacccactgtgcctggctggggctggaagtagcatccccccaccaccgcgccttgcagcagctgtgggatgaagaaggcctggaacaaccgcatcgtcggtcgcaccccgatgaacatctcgcacagatacgcaaagatggccagcgtcatcacggcattgggtgcgagatgcaaggcatggatttcgtagaaatccagaacctcatggaagaatctggagaacggcggaatcaagcccgccatagcgaaggacaagaggtgcacggatcgctccggatatcgtggccgcggccgcgactctcccgcccgcacgacggcaccatccggcatgatcttgtggggaaggataaggtgcctgtctgccgtgatgcgggaggaagggagcactgtgtcgctggcgtcttgagccatggtggccggcggagaagtggcggagagcgtggcgcgtgggacagtgtgaagtggcgagaatattagggttcgagaagcgaaaggacgagtgggcggttggcgaaaggaagaaggcagagtctctgcctccgcccccttttatcctcgcctcatccacgctcacctcctcgtttcatgcccccataattgcccccacgatcctcgcgcccgcatttgtctcttcgcttcccgcgcccactcatcacatcgcccgttgtatccgcgtcccgcctttagtgcgcctgtcagtggcacactcgaggtggagtgtgcaacggccatgagcgcaaattgaacaaaccgtcaccgctaccgccgcaggagtggcgagcgagggaatcgaggcgtggtctgaccgacccccctgttatcgcgcctcaagcatcttcatcatgagcgcggtcagtggcagtcaaaccgctgttatggttggcacgccaacctggccaccggcgatatccctttgggttatataccggcgtggaggaatacccatactgagctgtcaccattagcggcccacctctcatccgcaatatataaccccaaataatgctatcccgtaatctagacaccacatctaaacgaccagatactactctaatatcatcgtcttgacatagagtaattgcatcagcaaacattatacccgcaccaaagcatctcccagataagctagccgtatactcagtataacatgaacataatgtaaagtaggtactcgtatactcggaaagtatttcaataccataaatgtatatagaagagtattctaataaaagtacaaagcgtacaaaagaggaaaggaaagctgttagagccatacccgaacacttccaaagacttccggactcctgattcctattctaattctattccaccagctagatactactaaactaaacttgagaggaatgagagagctattgcttgaggtttgtgtgaagtgaagagagtgagctccttatatagaggtagttatgacggttgtggaaggggaattgtgcgaagtgccctccaaccgtcattgggatgcaatcctggacgtccacgccaaaacatggatccaacggcgccaggattggttcagccgaaccaccagtttcggccgaacctggggctggtccaatccagcccaatttcgactggtggcctcctctattgctccactccacagacttgtgaattttggcccaattcatcgtgtcagttctgagttcttggcccatttattcataagtcttattctcgacatcgtctgattgatttatcatttaagttgatgtcgattctcctccactttattgtcattctctacaaaaggttagtaaacctaatactagtggaaaattattactctaacatacttatgcattgcaagcatcacaagttctctcctattttggtagtattgacggtcgaaactgatcgataacgaccgtcaacgaatccccaagcttgaacctttgctcgtcccgagtaaaggacgaaaggaaacaaagacttggttgttgatcaggagttgctactatgctgcatatctcaaagatacaggtgcaaggtatatgcactctctctcatattaaataatctttggcacggtggcttacccttacccctgattcccacgagacactgcttctccttgtcttgagcggttgaaagagagaacagcaattagagcaccaatcatccgatctttattcaactctcattccggaagttttcaaatgattttggaaaagaaaaccaagttcctcaaatgattcactcagtctctccaagtgtatcaaaatgaattaatcaccaaatattgcctttttgattcctactctaaggttttgatatgtggaactcggtagggatcaaacatggcatacttgcattcacatttattactaagtcaaaaacttagactagagcagataactgaacatactcaagatcaagatcgtgcaaaatgtgtgtgatatatggtggaaatggtgtatgaagaaaaataaagaaaaaacttctcctctgtgctcactttcttctccgaaaagtccttttattgattaggagagggcatgattacatttttttttcaacatcatgttcatgcttgatggagcataactttattattttttcataaccatgcctttccctcctctctttttcttctcctttttttaaaggattttttactttttaggagaagaaagcacataaaagcatggagaatttattttggtggtaatatggaaatacaatagaatattgcttagctcctagtgtaggagtttggcatgtgcatatatgtattcgttttccattttttaccgattcttcacaatcgctcgtctgtcattccaccttcgctgctctctcctctcgcttctcggtctcgctcgtctgcatgactgcatccgctggctgcttactcgctcccctatgctagatcagcgccagtggtggctgccggcctgccattctgtcgtacctgtcggctgccactgccgtctgtttgtctacccctctgccggctgctctcatcctttctttgctgtggtgcgtggtctgctccttgattcgtcctgtggttcaacgattgaccgctctcacgtggtgagtattgaattttaatgtatatgttattaggtttatccccgaatctgaacatagattatatttagactggttatactagaatagaatatgttacatcctgttggtccttaatttcctattaggctgaacatgtatactcagagtaatggtcctaggggggcctgtaaaatgggggccccgttcggtcgctccggtcacgcaccctcagtgacggccctgtgtactaggatatgtcactttctactacaaagttatcttattttgggatggagggagtagttcttccaccacttcttctttcattatatttccaatactggtcgtgaaacaccataaacaggaggatgttgaggcccgtaattcgaagtgaattcttgatttgctcgttcctagtctctatttattcctctaacttacttgtagtattcatctaagctacttctaaacatagctacatttagttttcacgtagataccacttgtactgctataggacagaattacttaaaaaaaaacagaagcagaagtaacacttcttttaatgtattagaactttagaagtaactataatgatagaggaaagtaactttgagaaaaaaaagaattaactcttcatgatgttagaagtaattatactaagaaaagtaactttgaaaaataaaaataactcttttatattaatagaaataaccacactgcttaaggagtcaaggataaaatttggataatttgatggatgcagtaaatttacttcacatatttccttatttcaattctcgaactatgtaatggagagttacttctatatattgtagtagaacttatttacttctataatttgagtaaattacttttaaatacttatgatcttgatcagagagcatgagaagtatctacacaagtcacaagagtttgacaaagttcaatagaatggcaagcaaccaaaatgtatatggtttaatcatgatagcacatttttggctctggtaggaatttatatcaaatgaggaactctcaatttcatcattttgaaaaacaaaacatccggaattcaagtcaaactagtatcaagatcatagcaactcatatttactatctcatatctcgcaacaacctagacttagatcagcaagtgcagcccatttacctcaggttcccggataattgttggctacttatatttaacctttgagagagtatttaccaagaacccatatatcagagatatgaaacagagcaactattcatcatttcaacaaagagaactagcttgtcttacctagcatgactcaaacctatcctatctttttggcattttctattttgcaaatttttatgttgttttttttaagttttataagatgcaattggaaagggaaatatgcaatgtgatacaagttacctcagtggggggagagatgtctcccccccaagcttggctttcgctgttggcggttgttacaagccaatctcataccgccaacatctgcataaagttcacataataaaacatccaacatagtgataggtgtttaatctcacatatttcacaagtgttggtatatatttgtatgcaggtgataaactccatttttgaggaaatctagactaaagtgaggagaattctgtatccatacaaggatgggttgtgaactttatcgaaacatcagtaaatcagcccaaaataccatgaaatggaaagaggaggaccaggggaggatgtcacgtcccaaaacgaccctaaaatttatcctttaaattatgcctagaataattaaaatccgtgtgaaaacctccaacaattaaaatgtgcaaagttaaaagtcaaataaggcttagaggatttttgtatatttcctaaaagcctgaaatacgtaaataaattttagtggaattttcagagcacaaataataattgttaagaaataaacaaagttaaaaaggttttataaaaagaaaaaccctaaaaagtccctcttccctcccttgggccggcccggcccatctctccccccctctctctctcctctccccgcggcccatccggcctctccccgcgcgcgccgctgacgggcgggcccgcccgccatcctcgctgacgggtggggcccacccgtcatccccttccttccgccgttcctgccacctcccccgcgccctagcgctgccgccgccgggaataccgccgcctcccgcggtccccgcgtgcaataaagtggggggaattactccttgcgatcccctctccctttccccccattttcccctttctctctcgcgttcaaacagggggatttgcccccgcaaatcttcgct

SEQ ID NO: 60481 - DNA, 2836 bp, Oryza sativa
ctattctataaagcataatggccgtgtgaagtgtcctgaagtatttccttgtacaatgtagaatgatctacactttgatagatgtcccatcccaccatacatggaaatcttaaaagatgcatgaacagttctttagatgtacaagtgtgactcatacaacagcactgaacccctggacaatggctatccaatgctgaaatttgcatagatattttgttgcttctgggttctggccaattccatggaacttaggtgccctctagtttctccctatgcgcaacactaggtcagctgcagcccggaagccctttaccatgtgaatttgtgctatatgtattgaataaaatattgttaacacttctggcagcaaacataaccacagctgtaggattaaggacctgcctaaagcttctcttcctttttgcccgtaacttttgtttaagaaaataataaaaccacttcagcttttagatctagcatgtgttatacaagaattaccctcaatttgtaccattgatattcagtatctacaagtaaactaattcacatcagatacatcatccaaatatttcagtatcaatactaaaaattgattctcttgtatgcgccggtgctctcgagttgaatatctatagaagttctcattttatttaggacctcaattttaactgttggaaacacattttatgcctatcaaaagaccacatgcatgcaaccatgtcaattttactaacctgtatggtcatttagatatttaataatcatttgtcttgtcattgaaatctgaaaatatgatacacatgtatttcagggaaaattgtctgttggaaccatggcatcttttattggttacacattcacactgacattcgctgtaagtatcagattttacttattgcatgactttttgtagcttgatgtgtttattgtattttggtcatcttacttgtcagaacatgcattttaggttcaaggagctgttaatactcttggtgatctacgtgggacatttgcttctgtagaaagaataaattctattctatcagcagaggacattgatgattcacttgcatatggtttagccaaagaactagaagattcaaatggtgcagtgcacgaaaatggcactgctaacaaacattacatgtcagcactaaaatcatcaagcagctgtagtaatcttgcctggtctggtgacattcacctagaaggtctgctcgccactattcatatttgttttatacatgcagttctttttccatttcaaaatatttttatgcatatgcatatttctttcatactataatcttctatacaataatttttcttaagtaatttgtctctagttccactaggcaagatgaagaagttcagaactgggatgccaaaaagagccaatttgcatctcacataataggttaatttccttttgtatcataaaaactactagattaagacaacaaaggggacactctcctcttcaaatgttgctggagtcatatcacttgcttgcctaaactacatttgttttagcttatgtagcatttacatggataagtttatgtcgatgtggcatccatgtagacaaataactcagcaaagctcaatgatataaaatagctctggctgtcagctatctcagccaaaactcatggggctttactttggtactgcctacacccagttagctctgcacttgaaaagccaaatcagccactgaactcttttgtgtcagttgcccctgtttgatttttctattcatgaagctttcatcttccttgaatattgattcatgcaaatgcgtagcgccatgacagagcaaccagagtaggcaggtctagtctgtgagcctcaagacaactccactcatgtacatgtcacaggggcagggtagtatggggttgtggtggctggtagttttgagctatagagcataaggcaaggacatcaagcagtcgcactgaagctctaatgtttgtgcagaaggggcacaaagtaggtagccttgctatgtccaatgagaactagctagtatttctgaattgtaaacgtccaggcaacaggttgtttagcgtggaaacaagctcctccagtgcctaatatctaagtaagaagaaaactccatgaaaagcaagaacgaaaacaaattgagctgtatgaagcataaaagtccacatctttattatcaaagacagaaatttgtcaacaccttcatgtggtgtagctcaaagttgctgaagccaagcaattttgcaaatgatggctcgagacatgcactgtaccaggatgaggcaacaagtgaggtgtagatagaaaagagggatgtatatcagtgtggagattattatgtcttaagatataatttcatctttgaatgtatcggtactttttttgtgtccattttccttgtgttttgccttttttgtgtgaaagcctaacataagaggtgtttccaagagacacttaaatgaataatgaagtgcacacttatgaacattggcctttttgtgtaaatctctaacttatatagatgtttccaagatgtacttcaatgaataataaagtgtgtagttatgaactctatttactaaaaaaacagaaaatatgattaactagattattcttggaccattggcatgcaactgatgctcatctatattttggcaggtgtccacttttcttacccactgagatctgatgtggagatcttaaatgggcttgatcttacaattgagtgtggaaaaattacagcacttgttggacctagtggtgctggaaaaagcacagtggtgcaacttcttgcacggtactatgagtacttctgtgtatccacatt

SEQ ID NO: 60482 - DNA, 45029 bp, Oryza sativa
  unsure (1)..(45029): unsure at all n locations
agctggttttatgttggcaaataaaatgggacagtgattaaggttagtgcaaacgacgatgacatgtagtacttcattttacaggttgaggcataggtgttttttttttttggcaaaaatacctgtgtcatatagctggttttggacaccaattctgtggttgtatgtgtttaatagtgtgcccgtgcattgcaacgggaaaactaatcattaatcagggttcagttttcgtgatatgaaggggatattttcatctttgtctttatataggagaaaaaattgcccatgatttatttatctcaattgcatcatgcacatcatggcaagaaataatgtctacctggaagctgcaacatggcagtcttattatagtactaacctaaaaattatataaagatcaaataagtaggcgtcaccgaaaaatgatctggtgaaatggtgatgtcaaaatcagtaggcttctatttagaaaatgtggctacattccaaagttgcatgaattccagtttgcttcatccagatagaccacttaacttaatttacgaaaattgagtgactgaatttgaccgactcaaagcttatcaaacgtactgagtgggagaggaatacaatttacttaattcagaagaccggtttattgtggtgagcagcttttgttttcttatttactatttcaaccatgcttaattgtatttgttaatcttccagcagtgcactatattttgcaatttcagtaccctattaagtagcacaccatttcagtactcgttagtcttccagcagtgcacattatttttcaatttcagatgttagctttaaattgacatgtgttagctctaaattgacattattcgacaacttccagtactaaagtcttgctctgaattcacatgtgttatctataaatttcagatgtttcatatagattgtccttgggatactgtcgaaacaagatttcggcaataataaaagggggtggctatcaagttaggaaagtggatgggtttggagacaaagaattttatacaggttcaggccttcttattcaagaagtaataccctattcctgtccggggatgattccgccgagtatgttattgattgtataaactgggaaaaaagaatcgcgccctaagaggcacacggaccctccttatataggggaaggagtccgctttacaaaatacagtccatatcctaacggaatatgggattacagataaaatacaatcgtaaccgactaggatcccgggtattttcttgacatacaagtttagaatctaacccgagtactcatagagatattctatctatatttggtaccatatatccgactaaattataactgtcgtgtagatatggggtatccataatctccacagtagcccccgaaaccttcgcagttgacagtaatagccttctcgaaacaaaaaacagtaatccgagtgcttcaattcaacttgccgagtgctaaaatcaaagactacgaagggcaaaaataaaacatggtgcatcgagtagatgcacctaattaggtgtagcccctgactatgtgattagttgaaaaaactaaacatatagtcaagaaccgagtggttatatagcgaagcacgcatggtacttagtaagatacccagccgactgcttctcaacttgaacataccaagaacaaaaatacaagaagggccgagtgataaacactcaaaggtccaaaaataggcatatttgataggaatctgagtaagaaactcgtaaaatgatccaccaaatatgataaagatcatggcaattaggaagtttaatagcctaggctataacccttaccataatcaaaataagcatataacatgctaggagaatgactactaataaatcagtcatctcaaattaacccaacagcttttgtagcctaaaaaagcttacaaaaatagtataacacctttctgtcgggtacctttttatgtgcatcataataattccaaagaattattgaattgcgttaaaaaagattttaacagcatcgggtcacatcattgtgagcacatattgccaaagcaaaaagcgcttaagtccctagggatcacaacgggccacgctgaaaacaaaattgggctgaagtaccgtacaggcccaggcccattagtactcccgataccctaaaaacaccgaagtccaaacgtcatttcgtcttccccgccgagactctcgccattccccgctccatgctacagtacagaaccgcgccgacgaagttagggttcatcaatctgctccaatcctccctcaaaaacttcacaaaatttctccccgcgtccaccgctccaattccccattccactctagccatatctcggaccaaattaaaccatccagttacattcatggcggaagaaagagaaagcttcgagagtcagtgggcgccctccgatgtaacagaagataatctgaaggaaatggtggcgcacagcgttcttccggcgaaggaaatcatcgggtggcgaccggcgttcggcgaagcattcccgacccccgacacgcacgaaatcgtggtatttgctcatttcttctacgacggattttctcttccaacctcaagattcttccgggggattctgaacttctacgggattagcttgcatcatctgaatccaaactccatagtgcatatcgccaattttgttcatgcctgcgaagcttttctgggcattaggcctcatttcgccttattccgccgaatcttcttcctcaagccccaaccgaataagagcaaaccatgtgtggttgggggcgctggtttccaactcagaggaacactgagccaaaagtatttctctatgcccttcaagacctcacacaaaggctggcacgcaaactggttttacgtccaaaatcctgaacccgcacttcccgagtattcctgtcttcctccggtttaccaggacacatggaactcattgcctatgggagatgaagctgctcaggcagtggaattgatggaacgcatgctaaaactgaaggaacaaggtttgcagggagaacagatcactcgacacttcatcaaaagtcgattagctccaatcaaagagagatcccgcacggcttttgagtttgacggcaagcatgatccaaatcaggaagatccagattctcttgactttaaggtcatgaaagaaagaactgtacaagatcttctcaaacgctattgttgtcagctattcacatctgctgcccattgtgccattcaatgcattcaaccctcctccaccggtatgcattcaaacatttcaacgcttcctcaaaagtatgcttttgtcctctattaagctaattgaaaattcaaaatatcatgcccaggaatttgccttgatgaaatcggatcctccaattgctcaacgccgatcaccttgccagcagactggtcaggcgagtggaggaccaaaaattcggtctgacgctcaaccaagtgcttccgatccagtcggccagtcagattcttgcaagaggaagctagttctaagcgacgacgaaggcgatgataccggaaggctcggagacaaaggagcgaccggaaaacccccgaagccaactaatccgaagaagaaaacctccagtcgtcctttgccaaaaatcagaaaatcttccaggtacaaatcatttggccatcttccttgtcttgcagcttacccgctgttgaaataatactaacaacataactcaaattcgtaggaagccgtctgacatagatccttctgaaaaagaccctgagccggctgacatagaggcaaacccttcaaaagaaaccgggccaactgcagaggattgcccgagtgacaaacaaccggcaaccgacaatgtagaacccagcaacgagcccccgactgcgaaccagtcggccgaagctgaagttggcgctaaccaggagcccccgactggaaaccagtcggatgtagggtcaagccaaaagattcccgaggttgaagctcaaacgaacaggcctctcgggaaggatgctgacagtgaatcagaaaccagatctcctgtgaagacaccaaagtccactcgtccccgaccgggaatcatcacaggtagacacgctatctgaaatcattttgatccaacagactttatttgaccgcttcatcttcattcatggatacactagggccaataattggtgatgaagaagaaatcctccggatacaagcagctgaggattcacgccctcctattctggtcaagtggtgggatgacaacatgcagcctcaagggatcgtgataaataagcaaaaagaggacgaagagttatgcctactgaaggaggcacttggtcaggcaacctgcattgtaaatgtaagctctctggcacctgatctcaaccatcttgtttgccatttaattcatgcgctaattaaactgtcttgcagaggattcatcttaggaacgaagccaaaacggtaaccttagagaggttagtccctcatctcggaaccctcgaagccaccaggaatcaactgcacgaagcaaaagaacttgctaggaagaatgaacatgatctgagggatcggattgctgagctccaggaatcaaattttgaactgagtggctcgtcaaaaggtatgcacaaactctgctcaactgactcatactgttatctttgcaatcttgattaaccgtgatcaatgtagtgcaagctgccaagatatctcagttagagaagcagatttaaactctggagaatgacaaggcagagctagcaagacaaaaagacttggctttaaaggaagttgaaggtatcaacaatcaatacctcaaaagccattatcctccaaatgctgactcattaatgtgaatctgttgatacagaccgcaatatcaagtctcaagctcaattcgacgtcctggttggcaagatcaaaaaacttgaaggagcccgagatgaggttgctaacgctgctgccccaattgttcaagcgatgttcttcaataacaacggcccgagtgcacttgatgcttctgaaatcttcgacaagctgagagttgctccagatacatatttcaagagcatcaaagaggttagaagtatgggagcaagtctggcgtgcgatgaccaaatctctttatccgagggttgacgttgacgccattgatggctttgcagacgggacgagcgaagaagctgctcttgacctcatcagcgatgcacaaaaatctgctgataagatagcagttgatgtagttgagagatttcaggacaccgatcttcgaccgactggtcctgataattctgataatgaaaagactgatattgattaatataccaatgattttgatgattaatgatgatggaggcacaatttgtacaatactgatgaatttatgttgtgcttgatatctcaacttagttcctgatttcttaaaagtttttgtcaaaccttgttgagcctaaaacccgcaaaagttgttaaaaaactttcagtcctcattgactaagccaagaaatcaaacagggcaatgatacatcaagtaagcaaattgaattgataaaaaatcacactccattattattatagtagcccctcgactgaaaacttcaaggaaaaacttgaagttagcagtcaaagaggaaagatacaaacgaaatgcctaagcataaaatcgacgaaggtgttcaatattccaagaattgttgatgagagtaccatcttcgtgcttgagtcgataagaacctggccgagtgactccagcaattatgaacggtccttcccataagggagataatttatgccgatcctgtgtggtttgaattttcctcagaaccaggtcgccgactaaaaaggctcgcgatcgaacattctgattatgataacggcgcaaccctcgcaaataccgagtcgactgaattaaagctacttcacgggcttcttctagtcgattgatgtcatctactcggccctcttcatagcgctcctcgttgaagttccgaaatcatagtgattcaaattccacttcactcagcaacattgcttctgcaccataaaccaaaaagaacggcgactggccggtagcccgactgggagtagtgcgtaaagaccaaagtacggacggcagctgatctacccacttgccagcatagggacgtagtcggtcgaacagtcgtgcttttatcccttgaagtaccatgccattggcgcgctcaacttgtccattactcatggggtgtgccacggaggcataacaaattttaatgccaaagtcttcacaaaagtctttaaatgctccgccagtgaattgagtgccattattagtgatgatccgattaggtaccccaaaccgatgcacaatgttgatgaaaaaatctctagctttatctgctgtgatcgtgatgaccggtttagcctcaatccacttggagaatttgtcgatagccacaaagagatgcgtgtacccgccgactgcccttttaaacgggccgaccatgtcaagcccccagaccgcaaacggccaggacaacgggatggtttacaactcttgggctggcagatgaatttgtctggcaaaaaattgacaaccttcgcatgtccgcacaatcttgtcagcgtcagacacagctgtaggccagaaaaaaccttgccggtaagctttgccgacaatagtccgtgtagcagcatgattaccacaaatactagaatgtatatccttcaacaattgtctcccttcttccaaagacacgcagcgctgcagtattcctgatggacttttcttgtacaactccgtcttatgaataatgtaaagtctgctgcgcctggaaatccgctcggcttcatttttatcttgaggtagttcttgtttgctcaaaaattttatgtgaggttctctccaatcggtttcgattatgcttacgccttgagtatccatggctccgattgtttcttttctgggtacggttggttcgtaaagatgttcgacgaacacatcagaaggggctgcctcccgtttggaaccaaaattggccagtctgtcagcttcctcattgttatgtcggaggatatgggtgagctcgagtccatcgaatttatcttccaacttgcgtacctcttgttgataagagatcatattatcatctagacatgaccactctttcatgacttgattgacaaccaactaagagtctccacggacaattagtcggcgaatacctagagatattgcaatccttagtccatggagtagcgcctcgtattccgccatgttatgggacgcagaaaaatgtatccacaatacgtagctcaatctttctccagtcggggagattaaaacaaccccagctccagtgcctataagcctcttcgacccatcaaaatgcatagtccaatattccatcttttcctctggcatgtcttcttggcactcggtccactcggcaaggaaatcagctaaagcttgtgacttgatcgaagttcgtggcttgaacgatatgtcaaaagacatcaattctaaggcctatttcgcgatccgtccatttgcttcgcggttatgaagtatatccccgagtggaaacgatgtgactaccgtgaccgggtgactttgaaagtagcgagataatttcctgatggtaatcaagacaccatatagtaacttttgaacctaaggatatcttgtcttggaattggctaaaacctcgctaacgaaataaattggacgttggactttttgaatatggccttcctcttcacgctcgacaaccaggaccgtactcacaacctgggaggtcgccgacacatataacagtagcggctcttgcggatgtggcgaggccaaaactggtggagtggtgagaagtttcttgaagtcttcaaaggctttctgtgcttcgggtccccactggaaattgtcagtcttcttcaacagcttgaagaagggcatcccccgctcgccgagtcgtgagacgaaccggctgagcgccaccatgcaaccagtcagcttttggacgtctttttgggagcttggcggtttcatgttgaggatggcgttgattttctccgggttggcctgtatgcctctttgagataccataaatccaagcaatttccctgacggtactccgaagatgcacttttccgggtttagtttcatcttgaaagcacgaatgcttgtaaaagtttcttctaaatccacaatcaggtcatccttctgcttggtcttgacgactacatcatcaacataagcttcaacattgcgaccgatctgagttgaaaaacatctttgaatcatgcgttgataggtcgctcctgcattcttcaatccaaagggcatagtgatgtagcagtaggccccaaagggcataataaacgaggtcttcaagcagtcggattcttttagtcggatctgatgatatcccgagtaacagtccaagaagctgagtaactcgcagctggccgttgagtcaaccacctggttaatgcgaggtaacccaaaagggtctttgggacaggatttgttgaggtcggtataatcgacacacatgcgccattgccccgtctttttccgaaccaggactggattagccagccagtcgggatgaaggacttccttaatgaagcctgctgctaacagcttggttaattcctccttgattgcatccttcctgtcctgtgcaaaacggcggagtcgttgcttgatgggtttggcgtcttccttaacatgtaaagagtgctcaatcacctctctggggataccaggcatatcagatggtttccacgcaaaaatatctttattattctgaagaaaggtgatgagcgtgctttcctatttacaatctaactcagcgcctattacagcagtcttatcaggatcggagggatctaagggaatttttttcgtcttggcatcactttcttcggtcttcgttagcttggttgcgggcacttctccctcgcttgctgtggtcgcagccagtcggacctcttcgcgggcgagcgtagtctcgtgggtttgggccatctcgcaactttctttgtcacatgtgacggcctgcttgatgtcgctccgtagtgatatgactcctcgaggaccaggcatcttcatcatcatgtaggtgtagtgtgggacggccataaatttagccaaagccggtcatccaagtatagcatgatatgttgtctcgaaatcagcaacttcgaaacaaacattttctgtgcgaaaattctcccgagtgccgaaggtaactagaagagtgatctggccgagtggtgtagctgacaatcctgggataacaccgtggaagggtgcattactcggctttaattccgtgcgagggatctgcatatcgtccagggtcttagcgaaaaggatgttgagtgcgctgccaccgtcgatgagagtccgtcagagcttgacattgcgaaccactgggtctagtaccagggggtaccgcctcgggtggaccactcggtcgggatgatccgagcggtcgaacttaattgctatctctgaccaccgaagatattagggcgtgttaggctgaaccgcattgatctcccattctgttagcttctgctttctcttagattcataagctaggggtccgccgaagatgtgattgagttctttgcgatgatcttgaaaaccagtcggggcatcgtcttcatcatctttcttctttgatgtgccttgatctccgtttgagggcttacgtgcgttcttgacgtattgctccgcaaactgtttgttgacgaagcaatctttggccacgtggttggagttgggatgatgcggacattgggagttcattatcttgtcgaaggtgttgacgcgggaacgttgtcgggaagatggagaggttgtggccacaagttcttcgggcttacgcttgcggtccttgtggttgttacttccactccctcctccggtcggcgtatccttctttggtttccaagtggtgcccgactgcttggacaccgtaatagcatcttcggctttggcatactcgttggctttttcaaatatctgcttgactgtcttgggaggtttgcatccgaacttgccgactaggtcctcgtgtcgaatgcctttagtaaaggcggcgatgataacgtcgtcggtgatgtcggagatcttgttgccttgctcggagaagcgtcgaatgtaatctcgaagagattctccagacttctgaacgatattgtagagatcgaagtgtgtaccaggccgttcaaaagtgccttggaagttggcgatgaagtggtcgcgtagctctgcccatgatccgatcgtgccgcggggtagcccgtgaagccatgaccaggcagaatctgctagggccacaggcagatagttcgccatggctttgctgtctcctcttgctgcgcggattgcgagaccatagacggtgagccaagactcaaggttggtggtgccgtcatatttctcaattccagacggcttaaagccggctggccaatccactcgacgcaggtcgcttgtgaaggcagcaactccgtccacgtcgtcgtcatcgcgatctggtgaatgatggcctcttgctgcgtggcgctggttgatggtgtcgcgaagatcgatggggcgccttcgatgtggggagtgtggtcgttcaactcgacgctccctatatcattcgggaggcgaacgaacagaccgttcatcatgtcccctgctcctgcgactagatccggcgccggcaatgctgaggcttggctggtgatagtcttgagatcgaagatgagggactcggctaccagtcggggtgcgggtgcttgcggagttggctggaaccgaggcggcgatcatggtctttgtctggttcaagatgttgacaacatgatcagcttggttgagtgcgtcttccttgaggagggtgttgaggagagtgattgctgcaaccgtgttctgctggggggtgcgaaagaccgctgtcccatcgacgtcttgttgcccaatgagctctctcgctcgccgcccagattctaaggcgcgttgtcgtcgatcttcagcctcctttgcaatccgttcgcgatcttgttgctcacgctgtagtcgttctcgctcctgtcgctgtcgctcttcctctagtcggcgacgttcagcttcttgccgtgcacgatcttggtccgcttctcgggcttggcgctgttcctccgtttcgttgtcagccatgaatacgccgaagaagaggggcgtgtagttatcctcatagctgtcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgaggggttggagtatgtcacatcctgaatttttgtttcaggatttataaattatttaataaattattattagaatttatattaaatgttcattaatttacaagtgaagttaaatgtgggaaataaaatttcctaaatttaaagcatggatggatttaatttttattaaattctccatggttaattatactctctggaatattctcggatttttcggagctcaattcctaatttttaatcttacaaagagcatttcagtaattacccacatattaaattaatcattaaatggtctaattgtaatttttttaagtactttgagtgtccaagtattttgaggatttttcttgaaattatttgagcattggaagtatttttaacaattcaaagatcatttaagtgattattttaattgggaaagtaataaaatcctcctcctcagcttgggccattttcggcccattccttcctttccttcctctctcttccgccggcccaacctgagccgcctcctctcctctcagcctagccggaaaagtctactttccctccctgagctactgttcatcttccaactcaggcagagcccgagccagccgtgccgtgcacagtgccgccgcctcttccttccaaatctcgcctccccgttgctctttttccaatttagttgaggggaaatattcctcttatcctcctctatctttaccccaaaaatcggagctaatcgttgagtatcttatccgaatcgagctcgttttcgagtttatctccaaaaccgagtttttgatttcccggatcgatttcttgcgggaggagtccgatctcttcaatccaaggctataaataggaccccctagtcctcctctttcgtttgccccctcccccgtggtctcccgtgcctcgtagcgccgccgccacgtgctccaccccgccgtcgtcgccggccgagctccatccgcgtcgcgccgccgcctccgtcgtcgccgccggtcgccgtcaccaccgttaggtgcgcgggagggtggacaagcccggccgcctgacccccgaagccgccgaccaccgcagccccgtcgccgccgtcgaccgaagccgcgccgccgctagacctcgtcgccggccgtcgtcgttcgccgtttggttcgagggtgggtaccgttgggttcgtctcgtcgtcctctacgtgttcttgtcctccaaagtcgcagccgaccatccaatctccggcgaggtcgccatcttggttcggccattgatgaggtcatcatcatgacgtcatcatcgtttttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagtttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgattactttattccttgataccttgggtaacaaattgattagcttgaaccttatatattggtttggttcagctaaatgctatgtatatataattgcttagccatgcttagaaacattatcacataattgggataactaatgttacactatcacttatgattatatttaatggtagctcacgatgtttaatcgtgttatgataattaattgataactaaaacttgacaatggtgggttgtgagcacatggttttgaaggtcgtgctcatgacaattaaggaccggttcacgagctactgttgtgaaatattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgatgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagataaaggatccagaaggagaagacgtttggcttataccccagttgagttgcctgtgggagtggagctgaagccatcgctagaccgttaattccgctgcagttttcttttcttttgaaagtatgtaacactattattgatgattctgtatattaaattgtcagtttgtgtacctcggctgattcctggacgaggattttatgcacaaataagttcggaaattactagtgaatttctgggcgtgacagagtataacgccaacctccctggatctagatcggatcggggccaaagccggagctcgcctagatcttcgagtgggagatgtcttgactgtgaagacagcggccaagtcatcatgaagtttcatcaggattgagggataggacccgtcgtcttgatctggtcgcggaagagtagattggatctcgtccgagtggtttgaagccgactcgggagagatgatcttggagtaggcctcgaccgagttcggaataccgaacggcacgggggcctggtctctccccgactggtttgaatccgagtcaaggagagagatcttgccgaagtcgttggtgatgaagttgaggctgccgaacttgaatgcctgctcgggagggaaggcgaagtcgtcgatgccagagacggaacccatcgcacttagtcggcaaaaaacttgacgctaccctacctggcgcgccaactgtcgaaacaagatttcggcaataataaaagggggtggctatcaagttaggaaagtggatgggttcggagacaaagaattttatacaggttcaggccttcttattcaagaagtaataccctactcctgtccggggatgattccgccgagtatgttattgattgtataaactgggaaaaaagaatcgcgccccaagaggcacatggaccctccttatataggggaaggagtccgctttacaaaatacagtacatatcctaacggaatatgggattacacataaaatacaatcgtaaccgactaggatcccgggtattttcttgacatataagtttagaattaacccgagtactcatagagatattatatctatatttggtaccatatatccgactaaattataactgtcgtgtagatatggggtatccataatctccacagatactaacagcaacgaaccttgttgtttctatggaaagttgacactttttattttattttttgatgcatttatgacgatcaaatcccgtgcactgaacgttagaacttagaaccattcagtgccttgttacgaacagaggtggtgcaatgcatgacatgatctgcacttttatcactgaaattgaggtctgaatgttttaggtctggagttgagtttgagttttgaatcacagttcagtgacttcagtcctgatgatattttcccaatccatacatgttgtattccttgcatcactagccatcatagcagaagggaatgagtaactataattttggttgcggcaagtatttctgaaagaacctgttaccctgaataggatttaagtgtacagcttaattaggtagaaaagatacagaatgctgtttagtactccttacttgaaggcctttgacgaagccatgtccatatggtcaaatgtcatctgtaatatttcaaattcaggatggtgtgggatgatgagcttcatattttaaatttcctttttatcccagaaatacttttatgttatttgttaggtttaatatggccaaatttaaaatatgaggtttttagccctgcacttcttaacctgaacactcttggatatgcatagaatcttgtactaactttctccattgcaactgaaacactcagtttttttagcagataagcattacgttgtgaaaaactgaaaagattacaggtatttatggtaaagtagaaacctaaaataagatggaggaaggcgaccagtacaggttagtgccaaataaagggagtatgcaatggccaccagtaaggtagtaacaaattaaatgttcaccagcaggataaggactaatatcttatattcgcgcaaaaaggactaatatcttatactattttgttgggttgcattaaataaaggttagtctttgggtaatgaaatgttttctggttaacattcagttattaatatgtcaaacatgctggtctgtgaatgggatggaaaaccctggttgattcttttacaacttattatgtttttaatatgattgtagaaacttgtactaaatttttgtaccgcttgctgattgataatctctattggacactacaaaatagacgcgccagttgggtcggtaaatgattttcacacaatttaagttcgtatgaaattttccctatatctccccttttattcatatgaaaagatagaaaaaaataataggattgtattcctgcgctttgcttttataggaaaaataacaaggggtatgatctcttgctaaactttcatttctttttcttatggtactatcaaagtgttcctatcctgtttcttgtgtttttattcccgtatgattggagaagcatgccacttcaaatcttccgttttacccatttcccttttttttctaccatgtgaatcttagaacatagaattttgcaaaaaaaaaaatctatgttcaaatggatcattaaaaaattggtgcatatctacagttactcaagtactacctcaggttataaaactttctagcattgctcacgtttaactttttgccacttttaagatgtggcaattaattatttgccactcgtgttctttgacatgtgggccctcatatgtcaatgacatgcgggtccagtgacaaatactttatcaccactcgtaagagtggcaaattcttaattattccttattctacataggcatcaaatgctttgtttttgtacttgtttacacccgcaacaaattaatgaaataactcatttactttttaaacatacttttaaacgtatattgccctctatattgtatactaagtgattatgtaatcaattctggtccagatttattgtgcctatataatatcatattattgtactttttgtgaaatatatttgattaaggcatgcattgaattaaagcttaattgtacatatcataaaaaaaattgctaacatgaaattttaaatgttaataaagataaatagaatagtcccgtagcgtatagcacgggcatattactagtcaaagttagtacgagatttaaaaggtatcacggatctgaacagagttcttatacagatttttagcactagatacgttatattttgtagtattagatttgttttgatggaaggttatcatcaaactaataggataagtcctataaaaaacttaattaggagtagcaacatgttaatggagcacgttggcttttcgattccaagatctgaaatattttactactccctccgtttcaggttacaatactttctagcatgatgttaatgaatctaggtatgcaacatctatatgaatgtccctgaaaaaaaaacatccatatgaatatgggcaatactagaaagtcttataaatgaaacagaggtagtagtatttcacgttattgtcactcctagaaaacagattttcctgaaaactcccattttcccagacggaccgttttcgcgtgcatctacgaaaaatcggcctcccattttcgcgtgcagatccttaataggcccgcacgtgaaaatcgtgtgggcctcttaagtggaccgcacacgaaaatacctctccctcttttccctctcactcacttcaaaattttcaccttctctcttcctttttccttttattctccctcaatcactcatctctcccttcttttcctctcctctcctcccctcccctcccctccccaccgagcgcacggggtgtgggaggcgcccggctcgctgctgccgccaacgaggcggcgaacggaagcaggcgggaggcggcacggcgagcgaccggccggatctgcgccacgccaatgacgaggaggaggaggcgcccgggagcagtgacggcggccgatcgcggtggcggtcgggatcggatggctcggaagcggcgcggtcgggagcggcggtggcacaatgacggcgatgacaaggacgacggtggccacatgcggcagcagccggcgattctagggttagggtcgttagggttttggattttttggattttattttttttcgtttttttgcgtgcaggcggtataatttgaccgtaggggataatcgatcatcttgtacggtccacttaacccgactgcacgggaagatggattatcccgtgcggttgggccacccgcacgcgaaaatatggattttcgcagacacctaggtgcagctaggcgggacctccgtacggaaaaatgcattttgaccgcacggaaaaatattttgtgtatgtgtactagtgtgtagtacggcatgagtatcacttgctctgttattaggagacatttcagattttaaatagactagcaaagtgttcgtgcgttgctactggaaaagttacaatatatcatatctagctagagaaacgtgaaaggcaaataagactacgataaaattaagtgagaggactggagagacttaaattagtaactacacctcactcatttagctacttacgtcaaactacacatgaaatatctatagtcaaataaatcgataaccgatccgaaacaagagttagagctattgattttttttttgaaattatagacctttgtcataggttggatttgaaattaagacttgacactatttggacgacgcagagagcgtaaaggaagtcgttttgaacagcgacacggtctccaaaacacaactttgatttcttgtttctataaaaatatttattgaaaaatgatatatgtatacttttatgaaagtatttttcaagacaaatatattcatataatttttatattttcaaacacaataacttgagagttatttatgatttatattcctaaggtttaacttaaatattattctaaatgattttcttaacgagtacagagagtagtttggttgaaccaatttaaatcttatggatagatgcatagaaactttctctcgcctcgattatcgtatggacgatatgatagtcgagactcgagagtacatcacgggctcgcggtgattagctttggctgcttggtgggagcaatgagctaggtggcgagaggagtttaggtcacgatgaggcttttatttggcagactcagctcaaggaaagttttgtgggctgtgggcatcctagctatttgatcagcaccgatgcggtcgatctttggatggatgttgtctctaccaatggacaaaaaaaattcttgaaacttatcaaatcaaattgtgatcacgaattggatatatacgtgcagaaaaacttgacccaaactgatttagtaacgcacggaggactcccgcgggactcgggaagtacgtcaatgcgtgcgtgaaaaaacccaaaaagcacatcaccgaaaaaccgatacgaagaagaaattgatgaacgaagaaaacaaatttcgctcttcatagagataggatatatagaacattgcggggtgtcgaagaggtttttttccgggacgacttttttttcctggaatcagattttaaacgttgagcgaaatgattttttttcgcgaacctttttttaggctgcgttttttcttgccattttttttcctcgaatcggattgctcttttttctcgttgcgtggaaccggatttttgtttctcgcgttacgttgtgccaaactttttctcatggaatcataggaaaatgcttacggtcgaacgtccgatccagctaaaaagatcggaccagacgcaccgtataacacttgccccaaattacaaccaacatacatgtcgtttctttttcaacaaccaatgcatttctctctttcatcagtcagctgacatactacttattgttcatgcatgtagctatttaacaagcttcaaatgtttttttccaaataaccatatattaaaactgtgattcgattacactattatatttattgtagttaaatctttataacaagatacgatatgactatattccaatcaaaacattttttgtagcaataaatctttgtttatgtttcaattattttatttagatgtttcaataagtatttcgtaatgtttcactagtttatttgtaaatatcacatagcatgttttaagaatgttttagttggtaatttgtgatgtttcaatgcttatagcgtgatatttcagacgtggtataaaaagtattaggtatttgtaaaatataatacatgttgcatatgatattttttctatgtttcattcattatgactcaaagtttcatatattcattgatggtgttgcggtctgtatattattaaatgttgcatcttctggaacatttcatgtaatgagtagaacaatgaaacatatttttggtgaaacaatatcccattgtttgacaaatattttttcatcctttttaaatttttttatggacacgtctttttgtttttgctggattttttttattgtgacacggtattttttcccgtggtgtagaaatcgaatgatttttttctgcattttttgggattctttttttccggcttatttttcgttgcctaccaatgagacgtttttttcgctgtttttttattttctttacatatgcgttgttttgttttttcatggcttttttccgccactgttatttttgcgatgattacgaatcgtactttttttgctgttcttttggacggcgttttttttccttgtatttttaccgaacttttgtttcgccttttttttcgatggtgttttattatttggactgtctagccaacattcggctgataaaaaaaaacagcatgctgctctatagcaaatcccttattttttgcgtgactttttttccgctctctttttattatggacgacggaaatattttatactttttaagtaagtagaaaaaatgcctgtgcgttgaaacatgtgaattatattttaattttattatatttatacggtttagctaaatgaaattcatcgtcggaattcgcttagatatttttttagaaaatcatgagctgtaattaggcgtacgactttcatctcaagttagcatgcgagttttattacagagatttcttatacgacttcttttgcatttttaaaagtaaacgaagttaaaattcaactcaaacacggatatgtattttcaaaagcgaacgaatttaaaaaccgactcaaatacggttgacgtattaaaatactgacaaaaacatcttcaatttttataatagtagagatagagaacagacgtagagatttatgcatgagtacttcatcgtatatgcgtctaaatttgtaccgatagatagaccaaaacatcttaaaaaagctatatctattcgctccatcatataatataaagaattttgattttttcttgcactatttgactactcgtcttattaaaaaaaatttgtgcaaatataaaaaacaaaaagttgtgtttaaaatactttaaataataaagtaagtcacaaataaaataaataataattctatttttttataagacgaatagttaaatagtgtaagaaaaagttaaaatcttttatattatgggagtatcgaaggaaccacttgcggccaaatgtgggttaggtggtttcggtgtgcgcgccgcgcacccggctgccggcctgcgttgtcggccgctgctgtcccatgccccgttcccatgccgcgcccggtgacgacgcttggtggcgtcgtgaaacgcaaaggaaaatctcggtacagacagctcggcccagtactacaaaaacaatcaccaaatcgggcccggccacacataaaagcgtcctaataagctcgcgggcttagcacaaacaataacaatgttgatgttattatgctaccactaattaatgtcgcatgttaatatatatgcctttgtagtttgtcctcgtatatcaccaccacattttatatatattcgtctcgttggacaatcagtgtgctatgtgcatttgtgtgtgttgcacatgtttgacaacgatcgatcgcttgcacgcactgttcatcactgttgcgtgagaggatcagaggactcgaccaaaagggatgttccagctttggcaaccggctcacgtatcaagtgcgtcagaccatatctgtctcgtttcctttcctaacctttctttttttttccctgaagggtgtgctttctgtgaaatcagtagaggatgtaaaccatggttatattcttaatttctgtttggtattatcgtagattatgataatttcgaaccatgtgaaacaacttttatttaaaactatgttacatactactctccgtctacaaattttgtacagggactataatatttttatgatctctccataaaataaagaaaattatttcaggtacttcctcgaactgatcgcttggcgcatttaaaccctaaattttttggataattttaccctattctcggtaatccactttacttcttattgatatttctttttttcctccttaaatttgtatttaaagtttcagtttttttattccccctatctccgtgttgatgaggtgactcaaaaacgactcatgctttctctcggctgaccctttcctcctccagttctgacggctattagtcaccgattaggagggaggagcaaccgcggtcgggcttgttccgtggttggcttaatcttgtttccctttcttgttcaaattgaaggacttttcaatgtccacctccttcatcacggttgtggctagttgtggttggaacttccaaacttctctccggcatctaccatccggtcgaccgctaactactactaggcgtgccaccaatgcttgccacagagagagcagtatatgtgcaccagatttgatgtcagtcctccattttcacaagaagaaggttgtcccaaatgatatgaacttcttcaatgagttttcctcaatcgccttccccaagaggagagagctatgcagagaccgagggtggtcttagaatgattgtatcctcttgatgtaattatctaagatcgataaaactctctttgtcaaaaaaaaaaaaagaggagggagctattggtggcggagagaggtgcaaatatcatgtgaagggcaggctgaacgatggtgctagtcaaagtgacggaagtgggcagtgcactaggcggagatacatactttccatggtttattattggatgacaattttgtatggttctagcatcatagtttgactatgtaatctaggtagttcacaaatgatatctagaactaaaacttgcaatttgtgatattaataaagaggcaatggttttcgttaatctctattgagctttcatagctatttttcatgttaaactagggggattgccttgcgcaaaactgcagttttgcccgttgctagataattcacatagagtaagatttaatatgtaactccaaaattttatttatataggtaccattatatgtgaaattatatttgaatttcatatatgattcttaggttctatttttataagctctagatttcatatacaactcttaaattctatttctgcagatataattgtattttatatagaacaatatcaattgatctacacttttataatccgaacccaccatgatctaacacttaagatatttttctttttctccaaataattatgtgacaatttctggttttcaaaatgaacgtggtgccttctttcaagtcagtcttagtaaaatattataatagatagatactcccttcgtttcaggttataagacattttgactttggtcaaagtcaaattgctttaagtttgaccaagtttatagaaaaaagtaataacattttcaacccaacacaaatttattatgaaaatatattcaattattgatttgatgaaactaatttagtattataaatattactatatttgtctataaacttagtcaaacttgtaacagtttatcaaaacgtcttataacctgaaacggaggagcagatcataatgtccttatctgtccttatctaggcctaaagttcttcttagcagtaagtcttcagatggaggaaaaaaaaaacatcacgtagcaattttttttgccatgttttaggttcctctctgttcttctcatagattatcttgcaatgagacatttgccttttatttgaggtccaatttatgaggctcttggattgagggtttacttatgttcttttgccatattgtaagcatgtaagtgctggcgttaattacttatgttcctttggtcatatagctgcactatacatttctttcaaatccataattgtggtttgagtaaaatgcacctgcggtccttaaatttgtcagcaggtttcacttaggtncacnaacttgcatattgcacatccaagtccctaaacttggtttattgtatcatcccggtccaaagccgtgtttgaccgtggtcttgctatacgtggcacgccacatgaacgatgacatggaattgggttaaaaaaattctcccttcttccttcttttttcaccactgctacagcccctcccctcgtgccgcctctcaccaccgagaaaaaagaaggaagaaataaaaaaaagaaggaagaaggaagaaaaaaaaattccatgtcattgtccacgtggcgtgccacgtagacaagaccacagtcaaacgcggctttggatcgggataatacaataaaccaagtttagagaccttgatatgcactttgcaagttcgtggacctaagtgaaacctcctgacaagtttaaggaccgctggtgtattttactcttgtggttttatccatacgtgcttgtgctgcagtccattttgctggtgtagtgatattaggggggccatgcattagagttttggcttttaatttgtacgaaatatggtgaagaactttagatctctctctgtggagtattgtattagctgcaataatttcaaactttagggatctcaattcttgttttggcattagaaatttgaactgtgcacctgtcattttgctggtttcttttcctctcagggcaggaggatcatccccactgacaaccagaacacggcgtcagtatgcctgaccaatcaattaatgatggatgccactgacaaccggaccacggcgtcttcgacaccaccatgatttctgactggttattgggttaagcttcgttatgtcatctcctaatttttttatgtccatgtttgcttagagcaagtttaatagtatagccgactactaactctaattcatctatagctaatctaataactcattcatacaatagttacatactacactattaatacctggtcccacttatcatacacacagcgtgtcttagagtccgtgctacaactggctataaatttgtagtccgctgctcttctctctttttatttatctccttaaaatatgtttgcagctggcttatagtttgctattgtacctgctcttacgatggtttatcattctccagatctatgaactggttcttgatcatttgatcatcatgtgcttgaaattttacacatttggtcctgagtctgtattaaatgtgtaaaatttcaagtgataaggtcttctccagtgtcatgatcagtttgctgatcgtcacattatcaattagtcccctttaattaatccaagcgtgaagcatgcatgcttacgtggaacaattaattatatataagccttgcggacttgcacaaacaaagatgtatatagaggcataagtacatagtactccctccgtcaaaaaaaaaaaataaaccctggatttccgtgtccaacgtttgactgtccgtcttatttaaaaaaaaatatgaaaaaaaaattaaaaaatacaagtcacgcataaagtattaatcatgttttatcatctaacaacaatgaaaatactaattataaaaaaattcatataaaacggacaatcaaaagttggatacgaaaacccagggtttatcttttttttggtcggagggagtatatagtaggagtagaggagcaagactaatttgagaggacacaactctgaactgtcttactcaagctcagcaagatagatatcgatggcaaaggagtgcggcagcagcagtgtgatcgtcggggtggtgaaggtgaaggtggtgcgagggaccaatcttgccgtccgtgatgtcttcagcagcgatccctacgtcgtcctcaagctcggcaaccaggtgatctctttcactctttcgacctgctaattaagcttgctagtacgtactattgccgagttattattgaaggcctgttcagattgtaattaaaacaaaccttactaaaatttggtaatcttgctaaatactgcatcaatttagttttttaccaaactctagtaaatacatagaaaatcctgtcaaaacttgacaatattaccaaattaaaaaaatggtattgctaaaatttggtaaggtttattttggctacaatttgaacatgccataagattattaaaaattgctccgtatttcgaacgaatttgtaccaaattaactgaaatatgttcaaatggatcatctgaaacctctggggtataacattagctaagtgaaaggaattgatttgcgagatgtgcatacgtatacgtgccattaaagatttactggatttaaaaaataacattactattcgactattcacaaacatgccattacaatttcgatgaaacaccttccatgccacgttatacgctggaatcgcgtctgtagccgttttttgtgcactgtattttcgtatggactggaatgcccccagcatatgttgaagagggacctcatctattcggtttgaccaaaccgagtccctggaaattaaatcaccactccctggagtggcctcggtacaggggctattattcaagttggaccattgcaaatgctcttaggtagaggctttatcataacaatttatggtgttcatcgattgatttggaccaacttaagctgccgaatggtgcggtcgtgactcggtcagagctaaaatatgtagttttcgctgccaatgcatgcattcatattggttgcttcaaatgcttaattagttgcattattatctcatgacacatcgatgtgaatgtactgacaacaatcaagataactgctacacgagttgggaattgaaagattagttactggagtatatgggtaatcacaaatgatgcggcattgacgtacatcgagttggttttttagataatggaatagaaaatcctggtatttgctcaatgagttacaactaattattatagagtagcatacaaaataaaaagtttctcacacaaaaaagaagacacctaccaacccaagataaggagtacacaattattgaattctgtttgtgaatcttcatccaaaattagtaaacagttacataaccattgcctcaagattacgacatcgagttggtttgggggcaaaaactaatagttggtgacaaactacctgtttggcgtgcaattcggtacgtagagaaatacgaaaatgcagtcatattgtttagctatacgcgtaacaacagtcatatcttggaaagagcagtgtcatgagtacttcgaaaattcttacaacatccttgccaacgaggaacgaagttctcaaccatttaatttaattaattaaaaatcatagcaaatcaagattcaatcataattttttacgagaaacaacaggattattaaaataaaatataaaaaaatgatatttacaattttatttatgaaggattaaaaaagaaaagaattttgtgaacaaaggatcgattcaatcgtaagttcatagtgtgctgaattagtacgagggatgagcggatctttatagttctggcttagttgtaggccagaaggcgaccgctcttgtatagcggccgggggccaggttgtgctaggtttcagttgtgtggagctgtcgtgatcagtaggtggttggctcatgggtgcagttgcctagttggatgattttttcttggttctttttttttatagcttccaaggctttagttatatatatattttttctaatttgtcaatagaatcttcggtctggtgttggtcgttaaaaaaaaatgtgccatatgtaacaagtgattatggcattgtatgttttggattgagcgtatcgtttatacattaattttgctatatatttgttgacaaattttctcctaaaaatttgactgatataattatagtataatcgtaatgtaattgcactgtaacttacatatatctataatataatgtaacatgtatgtaactttcatataattttaaaccgttagatttgtttcaagatttatttaagtcactgacaatggaaacctgactgcaggaggtgagaactcgtacagtgaggaaaaacaccaatccagtgtggaacgaggacctgacgctcatcgttcaagatctcaaccatctcctcgtcactctcgttcgtaccttccaatcctccatcgatcgatcgatgtactccattgtgttctcctagctaggctagagatcaattaatctccgcttgcttgcttacaggaggtctacgaccgtgacccgttcgtcgacgaccccatgggcgcggcgttcttcgagctccggccgctggtggaggcggccgcggcgagcagccgccgccgtaccccctccggcgttgacagtaaagaggacggcaccgccgtggtcccaaggagcgggagctccgttgtgtggtcggcgtcggaggggaaggcggcgcagggcctggtgctgaggctcgccggcgtcgagtccggcgaggtggagctgcagctggaactggaatggcacggcggcgcggctggcgacacctcaatgatcgatcgattgattgatcgtaactcgtaaaggcctgaattaagacagaataaatcgactgagctagctcaagcttgtaagatcgagttcagtcagtacctctggttcgatcgaaaatttagtttctcgtttcgatttcaagaaacaaagcagctcaaggatcttgcatgcttgtattactattgaagcgattgttgagacaagtttgtccaatgctttgtgatttctggtaaattggattattaaaagttttatcgcatgattagctatatttatagcaccatcttttaagaaaaaaaataggctgttcattttttacattctaatttacatacacattataaatacactgtaaattttgtaagtttcaatatttacatttgtaatctatactaataatataaaaaagatagtagtggtggcgaatatatcactgccactcaattattatacggtacccataaacaataagataaaactttacatggcccgtatgcctaactcaacagataccttcaaattaatagaaaaaatagcgtgatgatgatatattaaataataaaaataatttatatatactaatccgttacgacacacatgtattatgctaatttttctaatgcacaatgtataagagaattaggattggaactaatttattatttacttaaaagataaaagaactgatagaaaagatagaggcatacttatacgtagaacaggggaaaattgactaaaattaagtgaaaaatatagcaccataattttaacaatgatgttacaatttcacatagttgcccaagaataaaaaaagagggggaaatattgagagggcctcgggcagtcgggctatctatgagctaggctaggtcaagggcgacccagtgtgtgatataaagttggaataaatctattttgcctccccaatctcttgatcctgtatcgctccaccgcaaagccaggtataatgcctccaccatcttcaataatcagtgcaaattaacttctcggtggtttggaacgtggtttttgtcaacaacgcccatatgtaagtgaaatatgataaaacatatgtggtgggccccacatgtcaatttccttttctccttctccacctcccccctctctctcctcgcattcttctctattgcagaggatgagttggtgccagcactcacgaaggcggtgcatggcatggtcacctcgatctctaggtctgatcggctagcgctggcaccattgcctctaggacgagcacgcatgcgcacgccaggtcggtgggggatcttagtgcccgtttgtccaaggggagcacctcagagatcacgtccatgacaaatctcgcctgattgatgcaacgcttgagcacgttagggagctcgtcacggagtgtgtccacctccttgcgcgcgcctcgcgacccgcaaaagtgaagaaccccgccaagtccatgctagcgcggagtgacctaagtcacttagcaattccatcggtggagccggtcctcgcgcaaagctcttggacagggaatcgagctgcaagagcgcgagatggagccgtcgatggaggcctcctggcggtaaagcgcctcgagcctatagtttccgatgtggaatacttctttgtcgtgtagtagctcgtagtgaaaagctgccatggattcgatgacgagaaattcatcagaggaatagaaaaacaaagagagaggaagaatgttgcttgccttgatggccttttctattgcttcctttgcaccgcctcctccttagtgtcattgagctggtgcgcaacgttgcacttttcccagtccttcgcatgttgaagaacatgcacttggtgcgggccacggagcgtctcgaagcaagccgagaggcagtgctctagggaactgaagtgctccgtgagttgctgatacaggcgcgtgcaggtcatgagcaagaggagatgacgttgtgcttgcgctccctgcaccgcctttgcgagtgctaacgccaatgcatcctccgcagcagagaagaatgcaaggagagaaagagaggtgaggaaggagaaaagaaattgacatgtgaggttccctgcatatgttttgtcatatctctctaacatgtggacctcgcatgcagaaaaccgcttcccaaacaactaaggagtcgatttacactggttttcaaaaatagggagatcttatacccgattttactgttgaggattgtgacttaagcaggagggtaaaataggcttatcccatacaaagggcctgtttgggagagcttctagtagctgcagcttcttctacaatctccaactgctagaagttccttcaaacagttcagattttcacctagattctgagaatctgtaattgtagaattcagaaaataaactagctagaagctggatttcctagcttctctcgattctcaccctgctgcttctccgaatcttaaactccccaaacagacccaaagtttaggcacagcccggcccgcttttgggccttgcgccttccgggcctctcgtaaaatgcattgggccggtccatgtctcagttctatccgtcaacaaacctacaattaatactccgggcctgcacggcttggacccggtcaagactcaccacggtccacgcagcagcgggcagcgaggaggagaagatgccgccgcccgtgccgccggaggagcggcggaagccttcgccggcggagtcccgccagtggacgcagcgcttcttccaggtcctcggcgccggggagcccctcccggcccccgcggagctccccgctgcctactccgcgctcgtccgcggcgtcctctcctccgccgccgtctcctcctccgcctccccgcgcgtctcctgcacgctcaccgtctcccccgccgccgttgtgagcgcccccccccacccccacatctcctcctccgctgaatcctatcctattcctaccctagcgtcgtgatgacgtcgtcgctgctcgatccgcgacttgcagaacgggtacaacacgctccacggcggcatggtggcggccgtggcggaggccgtcgggatggcgtgcgcgcgcgccgcggccggcgacaaggagatgttcctcggcgagctcagcaccgcctatctctccgccgcccgactcaatgtgagcacacacacaacatcgacctcctcccaaccccaacaggcgaacctacgtttttcttttttcagaaaaaaaaattgcatcgttaaataaaatttgtttcacttattggattattcctatcttgggtattggagggaaattgattacagcgaccgatctgtggttggggtaattggtgctgggtaatctagcaagagatgagctttgttttctttaggattggaatctggcaacagctagtccaccatctgagatgaagtagtttatctaggactggtggtaaatatatttcaggactgcaagagggtgggtgatccagctgtagaaggtgtatttatttctaggatgaatcaaaatcatccaaacagggaaacaactgttctaaacagatggtgaaatgaacatagtttattcttttgtcacttaaatagttccagtgatatatttgaaccctttgctattctcttgatatatatgcatgtaataatttaccaatgaaagctgattttgcacaggaacaatccagattacagaattcagtccttctggacatggtgccagtttaataatgtgcagacattccacagcataaaaatgtcattgcactaccactttaccgcactgtgttgctagcctggtgcccaaactcacaacatcatataccctgtatgaaagcacaaattaaccatttcaaccacaacatacaaatgcaactcctcgttttcagaaacttccatcttattagaggtttagagtgaagtgtgtattcttttccctgatgttcccgttgtttgttgatgcagtccgaagtggaagttgaagcgcagatactcaggaagggcagatccgtggtggttactacggttgagtttaggctcaaggataccaagaagctctgctattcatctcgagccaccatctacatcatgcctgtggtgagcctgtgaaaaaccacatggtacgtggatgaccaagtgtttgtttacacaacaattactgtgtagtatatatatgtgcatatatagcaaatctatatatgccacattcacaaacatagatgagaacattatcatatgcctatccagcaaccttccaaagctcagatgccttgaaaggcttccctttaagttccgcatccttgttattttcacttggaacttcagccaacaatgaatgtatgttagtcaggacatccagacaagaagtatataaaagattaaaccatgcgagctagtatatgatacagttctgttttcacgctttgaccttcaagtcttattgctccgcagtattcatccatgtcctatttaaactgtggtttccgttgaatcagattcctcgcaattcagatcccagcatactcttgttcacgttcgtgaggtttttacggaataaattaaatcttaaaatgctgatatttaggacgctttcttgcagcaataaatagatatttatccagtttatacatgcccacatacgccagtttatacacggcatctcccagatgttgggccatatattttcctgttctattcactgcatttcgttcgtcatactgagcttctaaacggtacgatttttgtaaaacctatatttatatataaatttcttagaaaattgttttaaatttgttcacctttaaataattatcataaatcattccactattcagccactgcttgcctagacgtcatatattctgtcagagtaacaatgtcacccaaatactcttacatgtccaaccataccattgccacctctattgacacgccgacggcataaccatgatactgtcttattgggtcatctatctagctgtatatccctgctgcatttgttgcattttgcattccactgcctggacaccattctgtctgtcagaggcacaagttctctgaattctatcatgtctttaacgatttatggtagttccttcggccctcggcatgaataggcctgtaccccctccatttcatattataagatatattaaccttttcataatcaaacttatttaagtttgactaagtttataaaagaattagcaatatctataatactaaaatagtttcattaaatctaatattgaatatattttgatagtatgtttgttttgggttaaaaatgttactatactttcttagaaacttagtcaggcttaaaaatgtttaaaaatgtttgactagaaaaaaaaaagacagcgtagggagtagaattcatacatgtccaaacggtgaccattgctttctagttactggaagaaggcacggatacacatgccatcatatacatgcatagcacatacacgcaatgacaatgcaagattttaatacaatggggttgaaatgggatatgatatccatgacaatgcaagattttaatacaatgggattgaaatgggatatgatatccatgtggccaaatactcagttggccagaccattataatttaagttttgatcctgtggttgaatattttgaatggacaaatcattgaagtatgatacttataattggttagtttggttagctagttaagttcgacaattgaaaagattagttgctacttagctgagtaattggaagctgacgtggtcacatgagcttgcttcattaatattcagacattcagtagatggcaacaaagtaaatcacgtaattgaattaagagtaggaaatttacatgatttctttgttagttacatagagagaatactcagataagccagggaacagggcagcggtgccctgtaaaaggtgcagtggacacatcaatttatacttcctataaatcaccaatacaagtgcatgactttctttttccgattgataatctgtggctggtcagagaaaacatgccgaatagctatatttatattttgagtaaagttcatcaccagtccctaaacttgtaccgctgtgtcatcccggtccctaaactccgctgtgtcatctcggtccctaaactcgcaaatcgatcgttcaggtcctcaaacttgttcgactgtgtcatcccggtccctaaacttacagatcactcgtttaggtcctccaacctgttcagttatgtcaccccggtttctaaacttgaatgtaaatatcatctgggttaaatatgactgtctaaagactttatatttaaaaataattcataccttttccatgtgaaatctaatgaagacaaactttatataaacttgtagccattgacgcgatctacaactatagttgattttttttattttaagtcattttttggtctcaaaatgtaattttaaaattaaaatttcaaaatctataaacatgcaacaatattttgggaccctaaacagttttaattcaaaaacttttcaactacaaatttgtaagtcgcgtcgagggctacaattttgatataaagtttgtcttcattagggttcacatgaaaaagttatgacttattttttgatataaagtttttagaccgtcctgtttagggaccggggtaacacatctgaataagttggaggacctaaacgagtgatctgcaagtttagggactgggatgacacagtcgaacaagtttgagaacctgaacggtcgatttgcgagtttagggaccgggatgacacagcggtacaagtttagagaccggtgatgtattttactcaaaatataaatatagctattcggcatgttttctctgaccagccacagattatcaatcggaaaaagaaagtcatgcacttgtattggtgattttaacatgctagctgtcacaaatctcagcacctcggtactcgggtgatcgagtataatgaatctgagcgcttttggactgattgatcgggtctatgatactgtttgggaaacttaagattatgattatgagaatttgttggctgacagtcagtttatgagagtatgaaagagctgagttttttgcttatggtttctagttagttttctggattgtacaattatatattcgtagaatctagatcacaactgagaagctacagaattctcttaaatagttcctatatactatggtaatactcctgtagctagtgatcctgatcccggcgcactgaatcaactcgaattagcgaatttctctcaacatactcgaaagagagagagatttggcgaaacataatgacttgtttctctattttctttcttttacttaggccgtgtttagttgcttgtcaaaattttttttttgacgtatacggatatacatttaaagtattaaacgtagactaataacaaaacaaattacagattccgacgataaactgggagacgaatcttttaagcctaattaatccatcattagtacatgtgggttactatagcacttatggctaatcacgacgtaattaggctcaaaagattcgtctcgcgatttacaggtggactgtacaattagtttttctttttgtccatatttgatgcaccatacatgtgtccaaacatttgatgtgacagaaaagttggaagtttgaataaaaaagttagaatctaaacacagccttagtgtaagtaaaatgagtggctgacgatcgcgcccctcgataaaaaacatcctgcaccatcccacacgatcgatcgtgacaagtatggagaaaagaaacatcgcaataaatttgtccactgaaagcacacatctcagggtcataaacaaaaagcgccctctccccacgtagtgcagccacgtggcgcgcgcggaaaggggagatagcggagcatgtggatatgcgacagtttttcctttttctcatgttttaaggtatttttagtttttactagaaaaatacccatgcgttgcaacggggtaaaaacgttttttaccctatacattatactccctttggtttgggactgaacgctcattccatcctttctagctccagtcctaacctagtccactacctccctctactcaacctatcttcgactcagcccacaagtggaactgtatgcccatctcgaacaatctcgtgcctgtaccataatgccgatcctcccatcaaatccgatactccggtcaagcttggatagtagccgatcctcccatcaaatcctgtaatctggtcaagcttacatagtctcgtgtccgtacgatgacggagccgatcctctccatcaaatttggtccaatctttctcgatctccaaaatttaatctggtcgagctcgtatagtcttcatagtcctgtgcccgtgcgatgacagagccgatcctctccatcaaatccggtccaatctttctcgatctccaaaatttaattcgtttgagctcgcatagtcctgtgcccgtgcgatgacagagccgatcctctccatcaaatccagacaaagccaatcctctccatcaaatccggtccaatctttgtcgatctccaaaatttaatccggttgagctcacataatctcgtgtctgtacgatgacagagccgatcctctccatcaaatccagtcgaatctttcttgatctccaaaattgttgagggattttaatccactcaatctcctttttctttttttttattaaaatctccaaaattgttgagggaaaatgatgagagagtagtgaagaatcagtttttgcaattaattggagaaggaaaacatggggaggcaaaacaacatggtggtgacgctgggtttgacacggcgaaataaaccgcaaaaaaaagcgacaaaagaaaaaaagggaaaacggtgaaaaaaaagaaaaacggcgaaaagaaaataaaacggaaaaaaacgaaaaaaaggaaatggaaacgaaaaaaaaggagacagacagcgaaaggaaaataaaaccgaaaaaagggaaaaaaagaaacagacggaaattgttggcagaagccttatgtattttttaattaggtatatagatatgtagtatacatacgtatataaagtttgtatatatgtatatattttttatacatcaaaagtgtatgcgtataaatacatatatattgtatatatatgtgttgtactttacatatgcgtataaaaatttatacatatgtatataaagtatatactacgtatacacgtagagaggagagaccagggttttaaatttcgaaaatgacatttctgccgcaggtgggtgatagaaccgaaatttcggaaattttcgaaaaatttcgtatgagattttttaaatttttgacagattttgaataaaatttaaccaaattcacaaaaaattacaaaaaaaaaccaaaattttcggtcgagatgttaggatttctgtgaggggcgaaatttctgaaatttctaagccctgggagacactggaggggggaaatccactgcgcgggagtgcaactacccgtgtagtatcccccacacaatgtcttataagtcggactcactcaagaatagtgaaaaagaaacaacgactgaaaacctatgcggtacagtaactttgaacattgaagaaatcaagaaaatgccaacaactcccattacacaaatataagtatttctaagataaatataagtatttttaggttatttagtacatggtagggattaatagttacaagaaaatattttaggttgtgttctgtagctggtgagagaagatttctctagttctctacgtgcacgctttccaaattaatgaacaatgtgttttacaaaaaacaatctataggaaagttgctttaaaaatcacattaatttgtttttaaaatttaaaatagttaatactcaattaataacacactaatggttcacttcattttacatatgttctcaatcttccattttcatgtcaaatcaaacatagccagtgtccgttgtcaaggagatatgttagggcattagggggtgagagatggttaaagtgcgacagtgtttggaggtaaaatatgaaaaagatataaataagaagtgatttgatgtgataagtaataccgtatatattttttatatttgtgaataaattccaaatactttaaaatataggtacagccatatggcggattccctacaaaagagagaatactcagataggccagggtacaggggttccctataaaggtatggcgcattaaagacgcacaatcgacacaaatcaaatttatacttctccaaattaaaatatgagaaaaatcaaagaattgcacaaacgtcctaatccaagaaataccatcgacgaacccaacttgaaaatgtcatcgtacaaacgcttttgtcacagaaatactgttaccgttagatttccgttaataaaactccactaagtgctataaaagactattttacccatatgaattgttgaaaaccaattaaaacttttgctctttccatcaacttactataatttagagcaacctacaaattgtaagctgacggaaaaagaaaaacttttaattaacttttaataatttgttgagatagaatcgtctttttatagcacttaattaagcattgctgacggaaacctaacggcgattgtatggctattgtacttgatgtgatttgatgatataagtaatactgtataattttttaatatttgtgaataaattccaaatactttgaaatacagatacaggtagagttatttgtttttaactttcaggtacaggtagagtagattcgatttgatgatgtgaggctgagatccaaagaacagccctatttttttttgtctagtgataagcctccgcagccctcggtcctatatatatccatgcatggtacggtaataatcaaggaagcagcaagctagctaaagctagcccagtcatggagaaagagcagcaagccggccatggcaagctccctcacgagcagctgttgctgcaagccagcacggagctcatgaacctcagcctgggctacgccaggtccatggccctcgggtgcgccgccaagctcggcgtcgccgacgctatccaccgcgccggcggccgcgccaccctccacgacctgcacgccgcgctgtccctccacccgaccaagctccccttcctgcgccgcgtcatgcgcgtgctggtcgcctcgggcgtcttcgcgcaggtcgaggaggaggaggaggaggaggatcactaccgcctcacgcccgtgtcgtccctgctcgtcaccgccggcgacggcagaggcaggagcctcctgccgctggtgctcttccagctctcgccgctatgcgtgacgccggcgacgagcatggccgagtggctcaggagcggcggcgaggaggagacggcgttcgagatggtgcacggcgtgggattgtggggcgcctgcagccgcgccccggatctcggtgagcacttcaacgacgccatggcggctgactcgcggtttatcatggacatggccatcaacggctcgggccgccaggtgttgacaagatcacctcgatggtggatgtcgcgggtggcaccggcgcggcggccagggcggtggccgccgcgttcccgcatatcaagtgcaccgtgctggaccttcctcacgtgatcgattccatcccggctgatcatggcgatgttgttcagtttgttgcaggtgatatgatggatttcatccccaaagcagatgccctcctgcttaaggtcagttatatccaatgtagtgttgctgacaacttttcatggcggacgcagcttcaaaatatagatggggcggagaacggaaatgttcactcgataaaagcaatcaaacacaacacatatcgtatttatagtttaatcacataactgcctcgatcattatttgtggcgtgcgtgcattatgaagagacggactaatttgttggacgttcacaccttgtcatacctaattttgatggcccatgactactataagggggtagagggttcttggggatgtagagcgacacgggtcgtagctggatcggtcgatccaccctgcctaatgggtagatccgcccctgttttcatgtattggatagcaagctaagctagtacaaaatttaagacattttagattataacattaattcttgatgattacagtttgtgctacatgattggagtgatgaggactgcataaagatactaaaacgatgcaaagaagcaattattccttctagagctgcaggaggaaagatcatcattttagatgttgtagttggatcttcttctgaagcaatatgccaaggaacccaacaattgtttgatctgattatttcggttacgaggaagagtggtgcaagatattcaaggaggcaggattcactaaatacaagattagcccagtgttaggttttcgatccattatcgaagtatttctataggtttccagtatatgggaactccactttatatatattcttgcactcttgggtgtggttgtcttcttttatcattgtcttatgcttcatggacgcgctatatatcgttattttctctgtaatatatatgcgaggatgtccttttccctttttgtccaagaaatctactagctaaatacccgtgctttgctacgaattaaagtaaattatatgtgtgctaatattgtttagaataaattaattgtgatgtttttgcacatttttgttcttgttgatgtttttgtatgataaacttgtattataggaataattgttaagaactattttgtaatattaaagcacatgaagtagtaattggtaaaaaaaacatgtaggagtagttggttaaaaaaaatctatacaagagttattggagtgacctattcactgccgccaccattgcctttttttaaaaggagcctacaactaatattaaagtaaatcatgcccttttccatctcctcataaaattatctttttaccctttctatctaagtacatgtatcaatacttaaatattttttacgtgataccttttattctagagcattatatctttactatttctgaagtgcaaacaccgtaaaacttctctttattcatttcaaatagagagtcttttgtttggtaccttggaatataatggccctgctcgaatttccaacaaaagttagataaacttttggataaaagtggcacgctcttcaaactgctaaacgtgcatttcgtgcgaaaactttttatataaaagttgttctagaatatcagattaatccattttcaagtttataataattaaaactcaattaatcacacgttattaccacctcgttttacgtgaaacacttgatttttatctttatcttcagaagattcaaacaccaccaatatcgtaatcaggacattgcggtcgtgtccacattatgaagatttgtgaaatctgaaatcggaactttacctcaagtggatcagtctccccatcaagctcgaccataacaagagcattcatgctgcataacaatagataagctcgaatttatatgattaattaacttaattgatgatatacaggttacattttataaaaagcataccttatctgcaaggcagtgtaccaaggatgcgtgcacgctcgtattttgtcatatacattgatgttttctgtgggcgagccatctttttcatattccttgtcatatacagtatcctcattgttactatttctggaatacaaacactgtaaagattctctttattcatttcaagtggagagtcttttgtttgataccttagaagataatgtcataatcaagacatcgcggtcgtgtccacattatgaagatttgtttttttccgtaccttttgtcttcagcttttgtgattaatgtattctctgatgaaaatgtatttgcaataatgtacattaaaggagaatggtagagcatgaatacatagttatttgcagtaagatttttgtaacaagcatatcctatttgccacaattacccttccttgaatattccttgctatgtaaagacaatatatcttactacagatatatgtatactttcttttgtgattatatgaaagatccccaacacccgcatatattgcatagacacaaaagtgtgccctcttttaaaaaaggctcgagaggggatgataggaataaaaccctgaaccacaccaagtttctacgaaaaataactcacagttacatgtgtggatattggcttaattatgatacctttgaggataatgcggccacaacttcaccaatacaaaacaaaaaaagttgtttcctagccacacaaacataagatttattcttaaaaaaagaacgtcatgtgtttgtttccctattctatgaaaaagttcacacaaagtatataccatttattttgtgcacaaaataaaaccaggtcttagcaaactgtcacgtcagtgtatacacattcatcacaaccaaaaatgggcatgtcagccaacatctctactctacgcatgtagtaataaatgagaaagctgttagaataattgggctaggcccgatttattctattaaatatcaaaggcccataataagtgttaaggataataataccacctcaggaattaagcgaggagtatctcaacttaaatagggagttattggaggctcccagttgaccggttgaggtgggaatcggaaagccacacgcgcgcgccgggccggggcgaggctggcgtgcatgcgtgccgtcacgtctctatcctgtttgcaaccacgatcccacgttcccacgactgcctccgtaacggcgcgtgcacgatcccacgacgtgtgtgcagcaactggctagtccgatcagaacgattcgctcccacgactgcctccgtaacggcgcgtgcacgatcccacgacgcgtgtgcggaatctctcctgctatatgtgcgtgccgtcacatctctatcctttttgcaaccacgatcccacgttcccacgactgcctccataacggcgcgtgcacgatcccacgatcccacgacgtgtgtgcggcaactggctagtccgatcagaacgattcgctcccacgactgcctccataacggcgcgtgcacgatcccacgatcccacgacgcgtgtgcggcaactggcggaatctctcctgctatataaggaggccgctagtccgatcagaacgattcgcatgctttcctctccctggtgttcttcctcctccgcgcgcgcctgctgcttctgttttcgcttcctcgcttctgatcgctttcacgcacgagagatcggaaggagcagggcctccggaaccacaccttcgcctgagatctgcaccgggtaggcgggtgatcaggtttttggggagtgcttcccgcacgactgctctgttcgttgttgtctcgtcgtccaccatgtctacgcctggacacctggagccggagctgccgccggcgccggtgctgctgtctctggagatggcacgccgggagccggagccgttgcgaacgtcaacaccaacggaggcaattctgcctcacaatccagcggagggccattctcggtgtatgtccttctcctgctgttaactcattcgttcataccgctgttagtcgtgttagtcgcaagtcagttgcgtccttggtatgtgcatgatgcttatgataccttaagcatgctactggttatgctacatgttgttactagatcaccccacattgtttatactatgattattgtcttaatattttggattaaaatatgccgatatatgaccatattttcaacgattcaaaaacctgataggtcattttcggtagttggctttgctgctgcactgaaaccatatgcatttgatggttctaactataagaggtggaaaacacgtgcactattgtggttgatagcgatgcaatgcttctatgtttcacggggcaaacgaagtgaaccacctctctctcccaaggaagaggctaagttcgaggcttcggattgcctgttccgtggagcattgatcagtgtactcgctgacaatatagtggacgtgtaaatgcacatgtcttccgggaaggacatgtgggatgcacttgaggccaagttcggagtttttgacgccggca

SEQ ID NO: 60483 - DNA, 17486 bp, Oryza sativa
  unsure (1)..(17486): unsure at all n locations
tttaaattcaaattcaaactgttcaaaaaatgttatatagaaaaatgaccaaaataaaagttatagatcttaatgagttatacaactttgttgttgatgactttttcagttgaaatcatttagtattctaaaatgttgtttgaagttatcatattttcgaattcaaatttaaactgttcagaaaatgttatatagaaaaataaccaaaataaaagttatagatcttgatgagttatacaactttgttattgacaattttgccatttgaaatcatttactacccgaaaaattatttgaatttcttatattttaaaattcaaattttatatagttcaatcaaacccagatggagaaatgaccaaaataaaattagtagatctcaatgagggatgctggggtgtggcatcttggcccaggacttaataggattaatagaatactcataccaacaagttaccacttcttatttctaaagaactctgaggttaagcgtgcttggcctggagcaatttagggatgagtgacttgcacaagcctggagcaagcacatgagtgaggacaaagtgtacaacaaaaaagacttgcctggcctaggagaggcgggacgttacatgggatttcttttttttttttgtggattatactcatccgtgacgtgctaatgagagtcatccgtgacgggcttttttgttggcccgattgaaatgtgtgtcatccgtgacggtcgaatgccccattgagatatttcaccacatcagtgacctttgcttgacggggcccctacccgatagagatggggcttgccgcccattacaaatgactgaacccgtgctagtggtcataaccatatcataaatatcaattacttagatgagcatggttccctatgatagatggttgttcacaagtgacaagtggtagcaaagaataaaaggtatacacgattaatcataggaagattctatttgttgagagttaatgttttcaattttcattttgagtcaaactaaattatatttaaactttcgatgcaggtttgacttacaaacaggggaggataagggaggagacgcgcaaacctgaccacacggcgaaagggtgacagagccaggctaggcaagggtcgggtgaacacttggtttggccaacccagccaggaattggttctggctgctgaattttgtgcacagccgtgggccagcgttcatcataccatcatgtcaagttgatcttgttgcgcgtcgggagttccgaaaagactcccccacatttgtcttgtaccttttctttattcaacaaaaacataaaaaacaaaatgggcttccatcgggatgaaacaccggccaaccaaactttattcaataatcctaggcgcatgaagttcctaaatttattttttttatctttatcttgataatttttttcatggcaacaatgagcatggtgggtatcttagcagggtggagatatgatgcacaaggtggttgagattcttaccggatagttcttaccaagcttagaactaaatcgaatgcaacaaagttttgcatttgttctgcttggttccatgtgcatctttgttttctcggagaccaaggagcgtggtatgagtgttgtagttattttacactgctccttagttgtctttttatttactgcaaaaggttagtggacaacaaatacccgagggattacaaagaattggaaagattttatcataccctcaagatcagttgttcacatccatgctaaaaaggaattgaattcaaaacttcagaagtgtggatctcacaaatttgccataattttattttgtcatcatttttttcgagagacactttattttattcttgaaaacaaatatatatatttttcatttttttattgttcaccaaattttcatttaagcaaaactcttgcagggctgaggtaaatttgcctgaacaaggtaaaggagcattcaacaatatacgcactgtgcaccttgagaggtgatctatttctcttttgcatgttagcaattgctttattcctggccctgtcctacctctagtgtgactcgtgcatgagaactcacctcggttgacggaactcgtcatgaaaagcttgtagacctccccccacacacacacttggacttttgtgtcataagacgtcaaaaaccaagtgtgagatgttggggtctcttgtgttgcatcgccaaggatcaccaacgtgctcggttgatgtagctcttgcattcttaggcatcgtatgaccctcgttcttaatctcaacctgtgattgttagtgaccaagaataccggaatgtgcatactattctaaaactggtccttgccttcattgaaaaaaaaacttgccatgataatccggggtaactcctggcagtgctttgtttatggtcacaagctcagccatagagacatcttgctgcaaagttagtgccacaaacacatacgagatttgcaatagttatgataaatataagcatccacaaccacacttctaatcatgttagaaatgatggccaaaaggcggttgtggtcctcgcacaagaaagcgatactaaactaataggaccctggggattccttatgtgagcatgaatcttggggaattttgaaagagaagctttcatgctcaaagtgccgttctcatcctccagagttgatgtctcaagcttatccataacccaaaggttctccttctcaagagatgcatcgtgcaagaacgaggttgtttcttgacaactgtcaagaacaacatattgagggccagagagataaggttttggctcgattggaggtcatgatggtggttttatggaatgtaattcaaagatctcaaccgactcttctttttcttggataaaatccagagcgtcttgtttagaagatgatttgagcagctaaaatggaagaacaaccattatgtcctccccgatatcttcttcaggaagggtatcagtcaaggcttttcttgactgcgagaatggaacaaagaaattgaccctcctaaagagaatttgaggctacctaatcgaggagtattgatgagaagtttctcgattggatgtcttattagaacatcaaaatcttggatttcaaaaacatgaataatccaagattgcctccttgccatcatgaatgacaggcacgtcttgtacaatacctaattcttcaataagactcccgttagggtgctcgaagaatttgtttgtcggtgtaattgccttgtcactcagaatagtgaatacaaaggattttgagacaatattggcacagactgatggactgtaaaggataccaacattattcccttctaagtgatagggaatggttcgaggagcgatatttattagaattacttcggaagaaagctctgcctcctttagccattcgtcactcatgattgatgtcagctcccgaactgtttcctttagatatccatattctattggatcgagagttggctagagaataggtggccgtaatattcgagaagatcgtccctgaatttgggagcacatcccggatcatgaatttcttcaatatctggagatagttcccgggaggattcctcagttagatctgatgatgttgacggttcaggttcctccgtacctgacacagatgcctctggagggggttcaaatcactgcccgaaggtatttttggatattctatcgagaatttcctttccttcgacgggggttttgtgcatgaatgacctccagcagttatgttgaggtaaagtgcagactccttatccaaacccgtatggaaatgttgcagtaatgcaaaatcgggtatggcaaggttgggactagactgtaccagagtaacaaatctggcccaagctgcacctattgatttcttattattctaccgaaagctgaggacttcgatccggaggaaagtaatacgactaacaggaaagaatgtgaggcacaaaatctgtctcgcaattcattccagctaccactcacactcccaacggtgtaaatgtaccattgttttgctctctcttgaagagagaacggaaacaatttccatttaatagtctcccgtggcatgccttggatcaagaggcacgaacacagatgctcaaactctcgcaggtgatgataggagatttcctggtctagactagagaaagatttctccctaaccgtaatgatgaattcgggacgaatttcatagccaggtgttaaataggctccgatgaaggaggtggctcgtaaaatttgccccgtggagcagatagttgaaagatatattgtggctccatgggcgagaagagttttacaagaacatttctctgggtagcaggggtgaaggtagaagaaagaaaagtaaaaaggatatgaggatgaacaaggtgcagagataaacaacaaccgttctccggcaacggctctagaaatgcttgttggtatttcttaacgtcgcagatagaatttgcaagcgcacggaagataccgatgtagcacttgacccgagagtattccaaggtatcgatttctgcagggaacgtgtgtgttaactctttaccaggttcatctaaggacacgaagcaaagataggcaaagggtagagaggatttactagtgggagacaatgtctatggaaagcttaatttaatcctaacgcgatacttcgggcactggccagcccgctgctcccagatatggctctaccgcgtactcggacagggaggacttcagtgtaattgagggttgtcaccaactctacacccacctcaaacctactatgggatatgaagcaatcactggaaattaactacctagacaccgcgtctatgatattaataactattctagtgccggccaaacactaatgcaatcattataaattaatggactatagtgaacaatgatcctgcatgctaattaggaactaaccaataattaattctcacaaagtaaatcttaattactcagaatgatatttctattaaaccagagtaattaactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagtgccgaggcgccccgacccctcgtgggtttttgctccgcgtgtatgggttaggtgagcacagtggggctcacctaaccacatttattgcggtttggctgagcgtgtcacgccgcatgtaacgcagtgcagtgcacttgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaaccattacaggcaagatgttgtgtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaacctccgtccatttatgaaaaggggggggggtaagtccccacaaaaaagagagaaattgtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagtttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccctagggcgcgctccaagctgcgggcgcgctcctacatcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcggctgtagagcctttgtgacgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacccgcgtctgttcactcttgggaggatttgtgccaacagttcaccatgaacttccaaggcacatatccgcgtccaggtgaggaagcggacttgcacgcagtacagcgaagggatgatgagtcacttcgctcgtacattcagcggttctgtcaagtccgcaacaccataccatgcatccctgcgcacgtggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcttcaaggccatgaagcgagagcttctggccgcggcccctactcatgaggcgacgtgtcgggcgcggtggtcggaggttgccctcaccctagaagcttgcccgcaggtacaccgaccacccaccgtgcgttgcccggggagggcagattgcgatggtggtttctcccaccgtttgcaacgtgaagttggggcgtgtcctcattgatgggggagcagccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccacggtggccccatctctgtccatggcgacctcaaagtcgcgctcgcttgtctggagcagcgcgcggaccacctcgccgctgcatccaagcccgagggtggcgacgagaggcttggcgcttccgccctcgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtctggcagaaagtgcggcggcaggccccggaacgtcaagccttcatccgcgaggaggtggcacgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttacccccttcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgccctttgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggtccccgagccgaacggaggcctaaggcccctgacgaccggagttggccctttgcccgcttttccgacgacgccaggagcccccgacccccaggacggccccgaagccactgtgggaaggccgcccctgttatcctccgaccccgaggtcatcagcacagaagataagtgcgcctcgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgctattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccgatgcgggggtcacgttgacctctccgagcggagacgtcctccgatacttggtccgcctcgactttcgagcgaccaataatatggcagaatacgagggactccttgccggactaagagtggcggctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccatactactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccagggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaatgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacgacacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcctggacctgcgcgcgcgcgcggtcctcggtcccaggagggaactcatccagcgccatccatggagagaaattggggtctctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggtgcgggcaccttccagattgcggcgcgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcagcgcaggtagcctcgtgcgccgccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccaccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgccggcggtgagccttacggcccacctccaccatggcctccaccgagcgtcgccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgtctcgtcctggcgaaatccggcctcctcccgagcggcttccccggcctggcgggcccgggcggcctcctcccaagcggcttccccggcctggcgggcccgggcggcctcctcccgagcggtttcctcggcctggtgagcccgggcggcctcctcggcttcccgtaggagatccgcggcctctcgccggtcagattcccgcctgagggcctctgcggccgccggatcctcggcctcagactggccggacttggaatggcgggagggacgcgacgggatctcgctgaaacgaaagaaaaaaccagaagacgaacaagatgggtgagtgaaaactcgcgttgagagaatgaatacagccacgatgggagagagacgaacctgcgagggggtcggttaaacgaccactttggaggggaaatgaggtttccccgagatggttctgtctcccccatcttacggggccgcttcttcttgcgctccccctcgggctgcgatgttggcgcagccccctccgggcgcctgttactggcacgcgccgccgcgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcaccgggggctggctcggaagtcggaggcgcgcttcgtcggcgaggggagtgtagaaccagtcactcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccttgccattgcaaaggggagaaagaagacggaccgccccgggtagtctggcgccgggcgtccctcgcccagcgtgactatctcctggccggtggcagattccggcatgaagcggcgcgacagcctagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcgcccgcttgcggcgcatgaggtgggtatgcggttgtggcagtcgagatagatcatatcgtgcgcgcattaattacgctcgccgaccgaagcgacgttaccatatctttagacgaaacgaatcgccatgtccagattcgtgtgctactcaagtaatgtggcagtcttgaagagaccgctcattgttgacagcagagttaccattgccgatgtgcgtggtttgtgaccgttggttttctgcccaattgtggagaccggtcccacctgtcaccaggtcttaagagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggantgtatgtactgtatcgccccataggtgaattagagctgaatcttttgttatttaatttttttaaaaaagcattttttttaacaacgaacaatgtcaaactttttttttaacctgaaccttttgaccatgccaatattctttgacattaccaccgcaaagcttcatacaacactatttatgtggtaagaggtgccacattgtatgttgctatcctgtggcatggcattgccacatcaaagctttttcccatttcaaagaggattttgctttgcgtgtgcatgtgttcagagcaaaaaaaaaaaaaagaaaaaaaaccacttagacatcatagctaggacttttagcataaccaatgttgtacattcttcattctccttgtaattatttttccctcaaaaattattttttgcctgttgtacataactttctctttataatggaaaattacagtaggaggctctccatgctgtgtttgggtaaaaagaaaaaaagaaaaagcttccgtcacatttac

SEQ ID NO: 60484 - DNA, 18430 bp, Oryza sativa
aatcagtcctatgctaatcacgttaagtgcggctaattaagaacttgacaccgcaacgctgtacgcgggcgttcggcgcggctctttcatcctacttatatatcctagggtgtagggttttggtcggcaccgcctctcctcctcctcctccttcttcctcgcgccgcgtctcgtccccctcaccgccgctccactgccccgccgccccgcactaccgacgatggcggcgccaccgaaatggcccgcccgcgtggtgcgggagacgtttctttcgagtcgaaggcgcacacccggtgttccccgagcaccatcctcgccgcaaaggattcccctctacttttcgccgacgccgagatgaatcagttcatgccggtgctcctcgacaccgctgcacaaggctcgcagctcggatgcccgggacacgcctgcaaatctctccgctgtatccccgtcgccgtcgatgataggcacctcaccttcaccgaggttctggggaactggtcctttggggactacttcaaggaggaggcaattggatttgcgtgggagctcttgactaaggtaacagttcccccccgcccccccacccccctgtcttagtctcttctccatctatcttgtgttcatgtgtggatacgactgggctatgcaaatcgtgggatttggatttgtgatccactagtgtcttgggtggcttgcgattaatttttgggctgcagatttacctgatgtgcaggagaattggggtatctagttcttccgcaactgaagggatttagggacgttgtatacagtggaataatgactagtttttgtttttttagggcgattttttttaattcggttttctacgattgattgaaacataaaaatggtggccaatgccattgttttgggatgaacgtttgattttttttgaagatgaaaaatgtggctatctgcaattaggagaaacgccgtttatatgtcacttaagttgatgtgttgcttctcgggtgaaacagttgaaggtgcaatctattaagttattaaaatgcattcattggactcttgatctggtctgggacctatatgttgcattcatggaatcatgatctggtcagcgacctatatgttgtgtttgctgattcagggcatatgttgtgtttgctgattcagggcttcagactgtaactcctgaatcattctctgatatgcaggtctacgaattggaggttgatagaatttttgtgacatatttcggaggtgatgagaaatcgggcttagcccctgatctggagtcaaaacacatatggcttaaatatctaccatcagataaagttctacctcttgtcaacaaggtattgtgcatgtgctggcttactgatgagagcttttggcaacagggcattttgttgtattagtttcattttatatgttcgtttctctcagattattttgctcatacaattcgattttactattgttgcattacttacaaacgaacaattatataaacctcaacagggtaacttctaccaaaatggtgacactggtccttgtggaccgtgcagtcaaatatattttgatcagattggtcatcatgatgttgcttcattattgaacaatgatgaccctggttgtattgagatatggaatcttgttttttttcaggttagtatacttcttttaatctgttttgtgcagatggctaaagttttttcatatacatataatcagttagtttgttttatttgtacatgatgactatccatatttattccttctacacggtgctgtgctattgctaattgcttttcttcgggtactggttgataagcttttatatgtaatcagtgattttatttttatttgtacatgatgtttttccttatgcatacttacatttgctgtttgcattttaattctagttcaataaggaagcaggtggcatattgatgccatcatcagccaaacatgtaggcactggactgaacttcgaacaattaacttctatacttcagaagaaaaagagcaaatttgacaccgacatattaatgccgacaattgactccatccgccaagtatgatgcccatatgcacacttgatgtttttattctgtataatagttagccatagtttcctattgattttgtatactgtatatgatatattaatatttattaatgaataatttgcacatctaaatgcagtgtactggcaatgaaattcaaccatactctggtaaatttggtcctgatgatattaatgaagttgatttggcataccggatagttgcagatcacataagaacaagtagttttgctattgccgatggttctcagcctggtaagtatatactgtttgatggtgataaatgatatgaaacacatgcaaatgcttagggttttcttgttgtgacacatgcaaatgcgattatgagatgtatttgccttgttaatgaaataaggagctttgtcaccttgcattctatatggtatgatgatcttcaaagtttatctgtcatcagaacatcctctagattcttggtccacctggtttactagggacggtaatgaactgaaaagattatgtggtgcatactgcactaccattacctgttttatttgtcatatgtttgttatcctttcagtcttcattttgtagtgaaaaatggttcttgcctgtctgtaatattatatcctttttaggaattgagatagcaaggaatatgcttaggcgggctatttacttcggtcatcaaaacttgaaggccaagcaacgatttcttacaatgtaagaacgatcacttgtctatgctatttgccacgtcttttggtccatatgcttgcgtaactttattcttgcacagaatgccacaaaacaatgtttcctctggacacaaaagctagtccttttggttttgtggatttaaacattatgaaccttggaaatcaaatatcagtttaaatggtacagttgctaacatggatgtgcatatataagtctctaaaagtactagtacataattttactaagttgaatagcttattccgtgcactactaaatttactgcacgaacacatggaatttttatatactacattgcatggtaatatccatgtcaatctgcatgggtggtttggatgtaaatagaatttttatcatgcaccctgcatcaagcacatagtttccatctttttttgttattgtttgcaccagcagtaacactccacagctcaagttgtaggatgctattatcttgtatgtattgagatggatacttggtactacatacggagttcagcactgatgcatatcatagtcctagaagtattaggttatagtattgcatatatgagatggtaacttgttaccgcatatgctatgtgtctttagtggaactgcaaaaatagcacatgagatggaagtattttaccatgggaggcagaataatatgactacacctgtgattatggaagaagagcattactgcagatatctgttactcctgtcccaaaatataaggtattaggactggatgggacacatcctagtactacgaataacttatattttgggatggagggagtatgataaaaggtttaacatgaaacaaactagttttatagtgaatttaggggctgatgtggtggacgttatcaactattactttgttttagtctgagtctttttccaacaaatatttggtttgtcattggcagatttaacatggaatctgaccgaactgtttgattctattcacattagcaaaggcctatgatatgattgctttaggttcatgtgtgccttttcatttgatagtttaatttattttagctgatacttggctttgatatggaaaatttttttcctcccagaccgttgccaccacccatgtacaagtattgttatttggagtaggctaaattgcttgcaatgtgggtcaataactctgcttagactgtagggaaaaaatacatgtcctatatgatgactgcctgggatttataatacttaaattgatctttttttttccttgaacagccttgtaagtgcatttatcgaatcaatgagtggagactttcctgagcttttacacaatgaaaagaagataaaagatataattgcagaggaagaaatcacttttgcaaaggtaatagtggtttccagatgatttactgagctgaagaatcagtttttccaagtaaagtttcaagtgtttttgttgattaaaatttttcactcaaaaagagtgggcacacttcactgctcttaccatgcattaataacaaatcattttgactacatttggcgaagggccctttgacatttcaatttgctgggtttttagtgccatttgatactgctatatagttatgttatttctagattggtgttttactatactgctagaagagggtgatgtagaataattgtgttgcatcgagcaactgtatcaaaatgggaatatatctagaataatagtcgcaatcttaggtattagattggataaaagtggctttcttatatcaacaagaagcttatctgacccttttatgcctcctgtttttgacaattcaagtttcttttgttttttttactcataattcaaatggcagctatgattccagttcccattctcattatgaggttgttcctactgcatgtattaacattacaatatacacatgcaatattgcagaaaagtacagtagcttgcaatatagttgattgtcaccaaaattcatattctgccttctctttctgtttaactcattcttaaggacaagaagaaatttaaaaagaaagacagcaaaaggcggaagaaggagaagaataacactgaacaaaatgttgtggtgaccagacctccgaaggtgtcctacaagactaggacaattgatttctttggtcgtcccactcacattattcaccagcatgagaatgggccatgcggtcttatcgtgatctgtaagagtatacagcttccctttttttttttgttctatgtttagcttaatttacattagtttcatgtgcctgtgcaggcaatgttcttctcctaaggagtgagattggattgttcctaaacaaaactgaagtgatggaggatgatcttcttagtcgtatcatttctcgccttaaaagatgcagaaagatgcaggtttgcaacttttatataactgtaatttctcacaataaatacaaatgtaactcaggcttccctttttcttttgcagtttgagttgcatgagggttttcagtactcagaattccaacataaagttttatctgtagcaaaaaacctctggagagaagtatgcataaatgtgacttttaaaaggtgataatgatataaaatgtgctgattggttgtgtttgtgcttgcgtgtgttctgatgtttgaaatgttgacattgcagtactgatggctttgtgttctcacctgaatatgcactttttgattatcttgaaatccctgtattccatgggtggcttgtggatcaggtaagagaacctaattgttatgttctttttttgtgcataaatgtaagaccaccgagaacactgaatgtgtagttattgcagttgcacttcaatgcagcatcatgcttaatgtggtgtctttgctttgctgcacggtacctttctcgcattatcagacgcagtaatggaacacctcagcccatttgaagcctgtagatgtaggaggtgttggcccatgtggcccagaagtgttgttgtggtggtgttttagtaccaactcggaagtttaggtgagtgggggcctgcttatatgaagcgagttaacccttttacatgaagtgaggatgaaagtgtaagcagagtattaaaattaaactggctgttttgctggatatgtttgtttccaaacctagccaggcaaatgcaaaagtgtgggccttcgttcctgctctggagaagtggagatacagcttctcatcatatgtgcacatatcagtcacctcgcctccctcagattacctcacttctacctctacatacatacaacaggatgatggatgagcatgagcagtgggcaaggaatgggaggacactgttatagggtttagtttagggctttacctcacttctacctctacatacatacaacaggatgatggatgagcatgagcagtgggcaaggaataggagggcactgctatagggtttagtttagggctttgttcctgggtcattctcatcaggcccgattgctagggtttagtttagggctttgttcctgagtcattctcatcaggcccgattgctatcgctaggctaggtgcaggcaaccaaacacaaccatagcatatacataactatttctcagattttggttttcaattgttacattgattatcaggattcagagttggcgtcagctattgctacaagttcttatgatgaacttaatctagaagttggagagtatatatcgcaaaaagaagccatggggattaaagggcgtggtgatcgtgaagaagatgaacaactgctgagagccattaaactttccatgggggacaacagcgttactgatcaaacacggggacaacagcattagtttcgtttttgaattacatattatttgaacataactttgccaatcttaacataaatattattctttaccctaaacattaatattattctttactcaatgttttcttagtggagcagatctcagattttcttcagggccctcaactgactgcccatgggtataaagtttaatttacatgttttgaaatagaatactttggaactaacagaaaaagaacatgttgaagtacaattttttattgttgcagcttgtcatgcttgcataaagaccttgaagaaaagaaaccttgtgtacttttctggaataatcattggagcacagtaattaaggtgagaaaacaaggttaacagtctttgattattttagtactaattttgtttatctgcctttattatattttgacctttgcagtttgaagaagaattatatattttagcttccgattcaagtttcttatcaagtgaatccggtgctgtttggcaaaagttggaagatgtatgtccttatttactactaatttttgtttgattgaaatgcatgtcttaatgtcaaagtcatggtacattaggtgaatgggggtggttcatttgtggatagctccttcacaccaattaaatatgccggtgaaggagcaagcttctgcagtgatcaggctcgtctaattcaggtataacttctctactttgtacgatgtaatgctgttattcaaacctggtaccttgttttgtttcttgtacttcactccaataatctgtcgtagtcattcacctgtaacttcatagtttatcctaatagttggtcttaaggaattttatttctcttagcctatagcttcttactgctcttgcattatcttcattcttggaactgataagcagataatagttgtggtcaactttaaaaaagctccagaggcatgagagcatggttgagacaatctttgctagtggagagtacaaaaataccacatttagtgatgtgggctttgggcatgttctaattctaaacaatacaatttcttgaacaagattgtcagtcagcggcggacccaggattccgtcatgcctgggctaaacccttaacaaccgaactagcactaccttatatctacaatgtgttatagcagaagcatatcataaatgcatcactaagatggcactttactcaatgtttcaaagctaacatattacaaaaactcatggctaaacagaaaaaaatatgtctgaaaaaatatctatactactataaaagacactagtggggtggttgttctgccaccaccactacttttgtactttctgcaaattagtccttgatattttctgatattatacaatagtctaatatttgtttgaatcaagtgaatattatgtattcaaataagcaaacatgtctaacatattattatatattttcttttacccatagcaaagcatgagtgttttgctagttgatctacaaaagaacgaacaacaaagaaaccaaaacaacttgctgaaatcaatatgctgaagttgtgttcaggaaaagcacaaaaattgcactaacctttctagttcaattgtacagctaccatatactgatatactagaatgacaaatacaagtatatactgaattgctgtaattacattgtgaacagcaattagattgatttgaatagctataatattccatgtagacgttttggtaggatccatggagtgctgcaatacagtagcatgatgtggcaggaggctacataaatatttccacaataagagtgttcaatacaaatgctatccacattgagtttgttctccctctggtcataagatacattctgtattgtttgtaggaagtaaatctgtattcttgttcttaaatgcaatgatagccagtgatcttggttaagcaaaataattgggttgttgcaattacaagaatctttttatattgaaacatgacatataatctgttaagacaattatgtctttgttacagaaatgtctaatgcctgtttttgccatgtctcacagagtaaccaagaatctgctgatccccaatggtggccccagggacttggtggaaagaatgaatggggtaattttttgcctttttcttgtgtcgattcttcttgtatcgaaatatgaatcttttttcttcctattcggcaaagattactatttcttctttatttgggtctgtctcttgaatctcttttgcaattattgttcacatcagttatccaactctagtggtaggctggcatgactttgttctgcaaaacttgaagttttgtagcaagtttatagatgtggcatccaattttttctttatgtacagctcatgtcgttttcttgttttcttcaaagtctagcttgtcttataatttatgttcaaacatatggattgaatgatcactgatgaatttttgtagttaataggaccattcgtaccccaacttgtgtgtgaataataactgcagtagtgtagcatatttgaataggattagatattctcctatcttaattcgttgtgtccacttcaaagtagctctttagtgaaaaaatggtttattcttgtatttcacatactattttctgatgcttcagatcatactggaagaaatgctcctgctggaaaggaaaatacggtcaatccagacattccaattccatggtatctgtactttacattgaaatggatcatcattgtgcggcgttatttttgtttattaaatcttgtttaatttgattcctgtttagtgctagttgtatcaggaagaaattccattgcactgaatcattagtctatgaaatccttttatatttttatacccatttataattattcatactggagacgaacatcattggagcaagattgtctgtttgttgaattcttctctttttcaactatattatttaggctctgtttacggaagcttctgggattctcgtagaatggactatggagtttgtaggctaacgtttagtcttctatcttacatattaaatacgttaagaaagatgcttgccatatagttctttcagggacttaccatataattcccagtccatcgccagccccatctccaagaatatttggaactggagcactgccaaacagacctttagttgataatattgtgtttctgcattaccttcctattatgtgttcagttcttgtctgaaaaccatacaactgtgtcaagtgaggatgtgggttcagctacgatgcatttttcttctgcatgtaggacttccaatagattcaataaattgataactgctatgattttaaatatgtttacaccttgttttgtttgaactttgggtggtccgttgtatatatctaactttaataaatttatgctccattttcttccaactcatgtctcaaaggcgttgcatatgtcagacattgacatggttccacttttttggtagcttaatagtggtatgcatctcagcgtatataaataaccattgtgcttctaaaccaccaagctcattaaatcaaagtgttccttgcagttaaactttttcctacattacaactacctattgtcatcaataccacttgcattcagattgttcttaatttctctttggcaactcaactgcagtcatgaggacttgtcagctgttgaagtggtaactgaggagcagttgccacctgctgaaataacagatgttattttacctcaaaaggtacatagctcctcaagcactcctgaagttgcaagatcagatcaactaaaggacgcagcggcttcacaaacccctaaatgttcaattcaagctgtgccatattcaacacctatatcttcaccacaaccactaggccgtcaggtacttgaaatatctgaatctcaggcacaattgcaagatcatcatatacttcagacactagctgatttgcctgtggcttgctacgggattttggaaaataacatttggcattcatttttattttttaaagcctaaaactgttgacctatcaagtcatatttcgccatcagtttttggatgtctactgggctagttaaagcagaggcacacaactctttccatttgaatctcagggagcacaaatgcgtcactaacattattgtggggcccacacaagtgaaaggagtggtggtggtagattcattgccaccaccactaccaacattttaaagtagtatagatctgaatcccagtacattgtagtacttcttaatccattcctactcaaacagtttgatttcattgaaagttgttggcccaaagcaacgaatatcagcccattctaccgtagttgtgacaacacactgaaatgttagcatgcatcattcatgggtagaaagcttttattttcatttaaatgtctgccatgtggatatagctatatattactctaatagcaatggaatttacccctatcttgaaagcttttctttgtttgcatgtgatgtgccatagattgtctgattcttgttggaaaatgcattgtgcaccagactttattgaagttcctaaaataagttttagatactggttttacgtctcgcagaaacattttattagaacttagtgatgaaattatgatatacagttcaaagtttaaattgtttaaacttatcacaaggatttgcaaattaactcaaatgattttctccccttcatttacacccaatcggaaaagatgagtcatgtatttgttagcaatagcatctacttggtaagggcaaacatagaagaacaagaaaaggagaaggtacatcaaaactctagagcaccttatatttaggagagagttaagaaggctcaaatggcctacatgtatatggataggaagtacctcttacaaaggatgaagaccaattgagtaaaaggaatttgttcttttttatttcagataatagcagaagaagaacgggctcaattgttgttcggttcatttggttgctgtgaccttaagtattggccttcttacccgacggtggtctgtaactctgatgtaatggccaagtcagtgcctactgtttccaacaagagggggttttcttcatttgttgacaaacccctctatatttcgaaagcttcatcagagcaccgtgcccaacaaagtgcttttacaaatcgttttctcgaatttctcagagggtcagacttctaactttaattttgtgtagtctatgttaaagactgttgcatttaattcatttttccaacaatgactacaggtttagattggggaataccgaagagccttattacaaaggaacagctgcttctatggtttttcttgatcttccaatgatggacgtaaagtttgatcatatcaagatatttgataatgaacttgcacttatgatatgccatgactttgagaggtatttttctgttctatttcttcttttgtttcaaggatgcttttgccttcttaattggtttgtacattttgttgcagaagtaggctagatctgaactatgcagcaaaatcatttatcatggattttagaagtcagttggaagggatgttcatgaagaagtttgaaagcttcgacaacattatagttcgtatagatggcttaccgaaaattgacaggttcacttaattgatttgtacactattttactttgactttgtgttatacctgtttatgcaactattatgtttgttacatttgcagattaatgtcacttgaggcttttgtgaaattgcctggaaatcattttgttgaaccaagaactttattcgctactgggagttcattaactgttgcaagtggtacaagagttggaagaatcatagcaacaggtgcgcttcaagaaatattgaaggcacatgctagtcgcaacagctggaatggcagttttaaaagaaagaacattttagtaagaaatggttgctattctgaaatctctatgcctttccatgctgagttcagcagggactctatgctcaatgattatatagcatattttgatgaagtgatctccctatttgaattaaaaggagtaggatgtcctgccttttttccttggatgcggaagtccttgttaagattcatgccagctccttctccatccttctgcgatgaattcaggcattttcaatgctttgcaatggcgcaatttgctttgaagcgtcctgtcgttaggattgggttcctttcaaatctttacaggctccggagatgtgcaaatcgacaagttagaaaaactctacttgccattcttaggagcttatcattaagatcagactggagggttattgttctattgcacagccatcccattctggtaaaagtgtacctattcaacaaaaaaaaggataaggaaggaaatggtggtggaaagacaaaggaaggaaatggtgagaattctaaggatcagaaaggtggtgaaaaaacaaatgatgcagattacaagatggcaaagttgacgaagtatgataattcagctaaccatcttgttatttacactcgccacgtgattgaacacgggatggatccagcacaacttgaggtaatacattctatcttttatttgtttttttttcttaacttgaacttgaatcctaacagaacattaaatttcttagagcgatgatgaagtcttggaagatgaaatgtatcaactagacgatgaatcaattgagatgctttcagagctagatttgctgtattcacattacctggagttgaatgacatgttggaagagttgttctacagtggtatgatgacgaaagaactttggcaagtgtaagtattttgttctcctaaaatctatcaatctaatccaaattaaaacataaaggagaactaactgtgagttcttttgtaggttcgaggagatattggatgtacacaacatggtggagcctctgtagtgactagatacacttttaatcactgatgtacgtctttattcatgaatgatgtatgtttttgcttatgaaacaaaatcatgagactcgtgtttatagtgtggtttttcttttgcaacagtggaagatataactgaagatcgacagatgtccgttctggaatccatgccctcagctactagtggcaaagaacctgagtagtcaaacgaacagtaatcggctgaaagtttcctgtagatagtgtttagctggctctggtgtcttgtttagttgtttgtgactggttgtctgtctggttcctggtaagaggcaagaggacatataccaagagcttcgaacttggttcatgatggttttcatctgatttaggcagcttacacattgatggttgtgtccatcagtatattttgtactctctatcccaatttaactatcacctaagcaaagttcttccatcccagtttaatcatcacctaagaaaaatctaaaaagcgtagatactgaagactgttaaccttcatcattttaatccatattggttaaggtgttttgttgtttcgtgtttgtggattgtgtcacgttttaaatatattgcatgatgttgcactaataaaaaatattcttgcttggttgtatgtagcgcatttaacaatgctcatttactcttgcacaaacaaacaaaaacacttgttagatgatagatcattttagatgatcattttaggaagaccataaaagttttaggggatgattaaaagggaatagagggaatattatcaattaacaacaacgagaaccctgatggctgacggtgctgttatccttgtgttgttatccttgtcatggctctaagatgtttagcttttgacttaccctctatatcaatctttacttttctgttgtgaagttcttggattttgagcaaacggtataacatggctgggagcgtatattgcttttgagtagcgtcggttcttgcgctcaatcttctactcctatcccattttaagcacagttgtgaatttatgtgtccaacgtttgaacatccatcttatttaatttttttatgattagtatttttgttgtttttaaattataaaaaataaataatactttatgcttaacttattttttaaattttttaaataaaattttcaaataaaatggatagtaaaatattaaacacggaaaattattactgcactttgaaataggagtatttacttttaggttgcatcggatcgggcacgtgctgaaaaattgggcaccctccccatgcctgctactgttgcgctcaccctaccgttgtgctatgctgttgcactggctttgcatctctggtgttatcttttcagttgataaattgtagtgcagttgataactaaaaaaaaatatagcccttaattgaaagggaacaaaattatagccttaattatagccttaaggcctcaaaattatctacaaatccttctaaccaaaggaagcctcaaaattgtcatgtggtaatgacaaagctggtttggtctcggagcccatatttttttttaccagtagtaaagatgatgcatacaagggagggcgaaataaagcagtggtacgatgttgttgaatacgaatagtaaatatagcgtacatcagaacttaggctgcttcgtccttaaaagaccatggtaactgcttgccaaattatcactactagctccccatttctataaaatggcttcagcttgcagtaaaagttcactagtacacaataaatcgtatcctacaattatctctctaggcgcagataaaccccaagccagtttccatactgcaaacgacaaatgaactcctaaaccgccaccaacaatgttaccagcatcctgaatctcaacaccaactggcttccatctatccatctgtacactgatgctctttcttccaatgtttcttcttctttatatgggcccccacgcctttcacatgcgcctcacttcaactgctgcactttcagtttgtccatgtgccacctctcctgtgcctgaacaacaacaaaagagttcgtcaaaattgcctagaactggaattggttacatttttttttataaagaggaagtacccatactactactatcatctagtagcaggggaaaaaaaacaaaacaaaaatcgatagcaagaactagtcattagctgctagtaggttggttactttgttttgatcaaatatatcttactactctgtcgagcagcagaaccatgctgttttgaacactgacagtctctaaaatatataactttgaccgttaatttcaattcaacgtgtgttaaatcaactatcatggacaagacatatctatacatattatatccaatctaaatattttagaagagattgattataaatttaaatgtttgattagagatggcaccaaaatgacacctttacccctctttttgcactggagggagtgagcaagaccaagctacaaaaaataacctttgtctgaaagggtaactttgagatactgtgttcttcaacggtgcttttggccaggaacaaaggttgaaacgcattttcttgggtgcttatcttcttgcactatgctttgaggcaagcttggcatccaatcaatcaacaagcatttgttctaaatgtgttgttatattcttaatttgtcaaaactcaaccagcatcattaaagaaattgagtgctcaggaattgtgagtatagtcctagacggttttgctgtactttcactcaaagacaaaaaggaatttaaattgagcacagcacaatttgaaattctatttctattggttgccaatcatacagcttagacaatgaaacaagccgtattagtaccccttgtgttcacattgccgtaatcaaatctgagatccagactgcaatatgttcctaactggtggaactagtgaggtatcataaggcccttcttctaaactaaacagcgacaaatacaatgatggcaagcaagtagtgcatttatacatatatcagaagtatataccagcacatagaagttacctgtagtgactttcttcagatatgtggacatctcactggcgatgtaggtgggcataccgaaatagtattttcggacatcaagctcagcaactccttgtatcttcttattccttacatcaacagtaaccacggcctccaatttgtccgtgcttccggctatggaaaagaagtagacatgatcatcatccatgcttatggtggggaataccattgctacgctccgcaatgcagctttgctgtggccacatccactcagcttagacagcagcttcaggtggcttgggtcacggacattgatgctgaggtctttgacattgaggtgacaatcacggcgccagtgctcccatgaagccaccggaattggcatggttcaaatggtggccttccagccacgacggagaacaactgagctggtgtaccttggctttcgccgaacccattcctggtaagattcagttggctggacagtggtgtgggtctctcctgtcccaacgatctccagctctatgtacttgatggagtctctgcaaagactgacggtgacatcacggatgtagttggggtcagtctgcttgaggaggcgatcccagttgccgctcgctggcaggggcaggggcatgtcgcggagcacggggtggtcgtcgagcacgtcgcagaagatgatgccacgccagaggtctacccagccgaccgtaccgcgctcgccgccaatcacgatcgtcttccttgtctcctggtaaaacctgtactccgcagccgctttgggcaaaggcacaagcttgtctctcagctgatcctccagcgtcaagagcttggagacccactcaccctgctgctgcttgccgccatggtagaggtggaggtggaaatccttgtttacggagaggaaagtgccggcgaaggcgagggcggcgacggcgtactcgccgtcgccgtggctgacgatggcgacctcggagtcgttgaagcgcatggagcgcggcgggggcgggatgaggtggagcagaggagggtcggccgcgcggtagacgaagtaatcccatgtcccgctggagagggcggtgaggggatcgaaggggacgacgaggaggaggaggtcggcgtgggaggcgatgaccttgggcgtggcgcggaggaagtcgaggcccgggcagtggacgcagaggtgggagaggagcggcgggcgtgcggtgcggaaggtgaccttgatggggaggcctgtgctggttgtggactcggcggtggtggcgttggggaggtcgccgatgtagcaccatatgtcgatgagaacccagtgcggcggcggggaggcgccgtcggaatcggcaagtggagggggaatcaacgacgaagacatgaccaaggaggaggggattggatcgcaaatttggggctaagagaagaggaacacactctctctctttttataatatcctttttctttagttgagaggtccagcctaccacagcacgggcccggcccattaaacatcgctccgttcacttcatcttttgtgcaaaattgctaattcgccgagacgagggccgcgcgtgggccttttttttattcggtatttttttttgttttttccttccctttttattggtttttttatgcgtacgggatatatacgtgcaaacacaaacttttcatatgtgtataaaatttttttatacatgatgtatttttcaattttttttgactttttaatacgaactgtcgacgaaatgggaatgggtgtacccatttcaccgtcaaaacaataaagcaccttttaacgagggaactaatagaaggacatggtcgtgggccccaactatagggtttgagaatgcggctcgaggttagccgcggatcgggccagacccgagaccccgatctaagaatggccaaatggctagccaagttaaattttaacaagtataaagaaaaaatgcccttcaatagcctctccatcatgt

SEQ ID NO: 60485 - DNA, 797 bp, Oryza sativa
  unsure (1)..(797): unsure at all n locations
tgaggcccttgatgtctaactcctcgnacagnnacncatcaagtataagaatttacatcactatatgctcggagcaacttacatcaatcttggtgcacattgttatcctgcaagacccccccgcaagacccggccggggccccgcaaggaatcaattggaggtggtcagccttcttccgctccgttgggcacttcggttggggcatggcggcgaactggcaatacccggcgagatgcgatgcttccctaccttctttgagatgcgatgaacgaaccgggggtgcccggcgtgcctggaatgaaaggagcagccggaggagaccgccgtgcagacctgctgggcctagtcgctgcgtgtatcgcgagcgatgacaacggagcggatcgcgtccaccggccggccggcgtgcgtgtctgcgcggtggatttggggattgggaggaagctggtggttagccctagggttaccttacaagggcatagggttatatgcttccactttattgggccttcggtgggtttcttctggtataggagtactatctcaaaatcccactcgtcctttcgcttctcgaaccctaatattctcgccactttacactgttccacgcgccacgctcttcggcactttttcgtcgggcaccatggcttaagaccccagcgacacagtgctcccttccttccgcatcacggcagacaggcaccttatcctttcccacaagatcatgcccgattgtgccgtcctgcggacgggagagtcgcggccgcggccacattttcggagcgatccgtgcact

SEQ ID NO: 60486 - DNA, 30490 bp, Oryza sativa
cgagctcggtacccccagaagcttgtttgattgctaaatcctccatgagttggctatggcatcgtagactagcccatgttggaatgcggaatttggcaactcttctaaagggggaacaatcctcgggctcattaatgtcacatttgagaaagatcgtgtgtgtagtgcttgccaagccaggaaacaagttgggaatccacatcctatcaagaacatcatgactacaacacgccctcttgagcttctacatatggatttattcgggcccgtggcctacataagtattggaggtaacaactatggttctgtcattattgatgatttttcccgcttcacttgggtgtattttctccatgacaagagtaaggcttaagatgtcttcaagcacttcgccaagcaagcccaaaacctctatgatctcaccatcaagagggtgcgaagcgacaatggaggagaattcaagaacactcaagtgaaggaattccttgacgaagtgggaatcaagcatgagttctccgccccatatgatcctcctcaaaatggcattgttgagaggaagaaccaaactcttattgaagccgcaagatcaatgcttgatgagtacaagacttcggatatcttttgggtggaggccgtgagtaccacatgtcatgccatcaaccgcttgtacctccacaagatcttaaagaaaacttcatatgagctcttgagtggtaagaaacctaatgtttcatattttcgtgtctttgggagcaaatgctttattttgagtaagaggcctcgctcatctaagttctcacctaaggtggatgagggattcttacttggctatgaatcaaatgcacatgcctatcgtgtcttcaacaaaacctccggtattgttgaagtcactagggatgtgacatttgatgaatctaatggctcccaaggagagcaagttgttgtacatgttgtaggtgatgtggattcaagtcaagctataggtactaaggctattggagacatacgaccagtcaagacgcaggatgaccaagaagacagggatcaaccttcgtcatcgacatccaatagccctacattgagtcaagtgtcagtcgacccggaagttccgggaccagatggtcggaacctccgaacctctccaagccaggaagttccgggtccatctgccaggaagttccgggcagaggacagtcaaggcgtgcctacggcacaagtggatggaattgatgctgagggcactgtagagcatcctgatcaggctcaggtcccctcggtgcaccatccaagaatacatcacactgtccaaagagatcatcccgtcgacaacatacttggtgacataagaaaggaggtaactactcgttctcgtgtcgctaacttttgtcaacactatttgtttgtctcttctttggaaccaaccagggttgaagatgcacttggtgatctggattgggtgatggctatgcaagtggagttgaataacttcactcgcaaccaagtatggacattggtggagagacccgaccaaaatgtcatcggcaccaagtggatcttccgcaacaagccagatgaacatggagtggttgtaaggaacaaagcccggttagttgcgcaagggttcacccaaatcgagggtctcgattttggtgaaaccttcacacccgttgctcaccttgagtcaatccgaatccttttagcctatgccgctcaccatgatttcaggttattccaaatggatgtcaagagtgcctttctcaatggacctatctcggagttggtctatgtggagcaaccaccggggttcgaagatccaaggttgccaaaccatgtgtacaagctccacaaggcgctctacgggctcaaacaagcccctagagcttggtatgaatgtctccgagattttcttttgaaaaatggttttgaaattgggaaggcggatactactctcttcactaaaaaatctaagagtgatttattcatttgccaaatttatgtcgatgacataatatttggttctactaatgcctctttttgtgaagaatttagtagtatcatgactaaaaggttcgagatgtctatgatgggcgagttgacctttttcctcgggctacaagtgaagcaagtacaagagggcactttcatctctcaaaccaagtacgtgaaggacattctcaagaagtttgggatggaagatgccatacccatcaagactcctatgcctaccaatggccacctagacctcgacgataatggtaaatgtgtggaccaaaaggtatatcgctccatgataggatccttgctttacttatgtacatctcgtcccgatatcatgcttagtgtttgcatgtgtgctcgctttcaagcggagcctaaagagtgctatttgattgccgtcaagagaattctaagatatttagtccatactcctaatcttggcttgtggtatcctaagggttgtgactttgagcttttgggctattccgattcggattacgccgggtgtaaggttgatagaaaaagcacaaccgggacttgccaatttcttgggcggtcccttgtttcttggtcctccaagaagcaaaattctattgctttatccaccgccgaagtcgaatatgtcgccaccggttcttgttgtgtccaactcctttggatgaaacaaaccctaaaagactttggctacaacttcaccaagatcccactcctatgtgacaatgagagtgccatcaaaatagccaataatcccgttcaacattctcgaaccaaacacatagatattcgccaccactttttgagagatcatgagaccaaaggagacatttgccttacacatgtgagaaccgagagcatattggccgacattttcaccaagcctttagatgagaaaagattttgcgagcttaggagtgagctcaatatcttagattctcgcaacattaggtgatgggtggttggctaatttatagccaaacatatgtcactaaaatgtaaattaaaaaaaataaaaaaaaattaagcttttgtgtcttgagatcacttcttgtgtagaagatggtcttgataccaggaatgaagctaaaacattccccttttatccaaaaactcccttttgtgaaaatttttgcaaaatcctttgtgtgccttttattgcgaaattttggtttttatttccttcttgtgatgtattgtgaccatagttatgtaatgttgtttgttggctggtcatatacatcataagtctcttcatgtccatagttcctaatttcccttcgttaaattctcttctcctccttgtttttgggcctgactgcccttgttctgtcaggccggaagttccgggcctccctgtccggaacctccgggtgtcggggagtatatatactcagggggagttagaaatcccggtctctctcctcacttcttctccctccccgacgccagccctagccgccgctacagtaccccttgtggcgattttcaattccatccgtgaaaatttgattcctctctgtggaatcaatcacattggtggctaggaggttcttcccgtgatcgatctgcgatttcctctctcaaggtagcacttttgatcttctcttttggttcatcatgtttttgccccaatctctaaatctgtgaacctagggagaaaaccacttggatagtcttgtttctgctaccttgtagatcaccgatctataggatttgttcacatgcactggctatttttgagaccactgttcttcatttttgccggccggaagttgcacctggaacctccgggcgctgtccagccagcctgccattcttgattctctcaaattttgcctaactactgcactccaatttgttgattcctgttgcagtaagcactatgcctcgtgagaagagacagaaagcctctcaggatgtgtccggtgatgagagtcctcctattcattttcctcgtggtcgtttgggaaaagaaaaagtggttgaaggtggcagtagcagtggcactcgtacctctcccaggtttaccaggcaatccagcaatcgcccagttcagattcgtgatgttgacagtggtcaaggtagtgatgctccttcttcaagaggtcgtgggagaggtggtggtcgcacttctggggctggaagggcctctcatgatttccttgttggatctcgtgtgaatcccgttcggctctacaagactattggttttgacaccactcctatgcatcacattggaagacccaagtccaactaccttcatcagcttgccaagtgcagaagggaccgtttgattgatccaaagacacagcctggggagtcacaggatcctcgtttcagaactttaactcaattggattggtacaactcagtgattatggctagagacaatccagtggttgagatgaagtggattgattggacttacatgaggaagaagaacaatgaagtgttcaaccaagcaatgcaagtttgccacaacaagaatcttggagatattcttgccttggagtatgattggaatgaggaggtcattgcacagttctatgcgacagcattctttgatactactaggaagggaacttcttatgtaaagtggatgactgagggtgttaggcacaagatttccatagcacagtttgctgagatattgggcttagaggatgaggatctcaataggcctaacatacatagtgaagcacttcttcccatgatcaagactaaattcatgtatactaggggatgctcctaggacttgtatgggaactactcatggtttgcatccaaactacaaggtgctgtactccatctttcgttggtctttgcttccaaaggttggagatgccattgctttgccttccaaacatgttcatcttctcagtcgcatgcgctacaatcagcctcctttcagtgtgatgcagttgatttggtatgagattgccaacaccattcttgagcctaagcgaggttgcatctatgctccattcattatgaagatgattgagacagtcaccggggtgttctacattaaagatgggcgccacaatcctttcctcttctccagtggcacctagatccatcccttctacctcagctggtccttcttctagtgccccaccgcaatcctcgagctcttctcccatcaagaaggcacttcaggcaatcttctgtatgtgtgctaagactgcaaagaaagtgaagaagatagaaaggcgtcagaaggaagatagaagagaggctgggaaagaagtgtcagatgattctgaagatgaggtctatgtggatccttttgaggcttatgaggcagcccgcaatgttgccggtgaaggtccatccacctatttcaatgaagagtcttcccaatcagatgatgatgatgatgaggatgacactgaggcagctgctgaggatgctcctactgatgttgacaccgctgcacagtccgatgagtctcatctcttcggcgataccgagattgttccttcagatggagatggagatgagtgatcctcttcttctcttcatggtttcttgctttttggtgccttgatgctaaagggggagaaattgtgaattgaagggggtcatttaaatcatttttgctgccttgactgctgtctggtcatttggccagaagttccgggtcctgtgatctggaagttctggccaagcagattccctccctattatctatctctctatggacatgtaatcgtattctattatggttggatgtaatgactgttagatgttttattatcctttatgtcagtaagttagactatatgaatgttgcattttgatgtgatgtagtgttcttttcatctttttgagtgtttgcaatgtcatctagttcttcttctagcatatcactcatcatttaagcactcacatctgcttcttatttgattggggatagtgtgaagttacctttgagctttccttcgtttttatgcatattgtattcttctctcatttccttatatgcatatctttagggggagcttcacacttctctcatcatttcaatttaaattctattatctttttgtgtgctttaaccatgttgtcatcaatcaccaaaaagggggagattgaagatgcacttaaaccccctagtgggttttggtgattaatgacaaggtggttaaaggggactaacgtgtttatcaagtttattcacaggagtttagtcccaaagcaagttgtgatggctaagaatgcaaggagacccccaaatttgaatgctcctaagtgcgaaaaacaccgaaggtgattagactaggtttttcactttcgaaattgagtttaggaaaaaacatactattaagaggggtttcaagtgtggttctagggtatacaaagtgctcttagtcatatccatgtgtcaaaatatttttggaatcatttttgaaaaatgatttttgtccccgggacagagagggctacccggaggttctggccggaacttccgggcgccatttcaacagcaaattttcctaagtgctgcccagaagttcctggcacttttgcccggaacctcctggcaggcttccagtttaaacttgtgagtaacggctagatgacgtcatctagccgttatatatatggatttcgtccccaggccaccctttggctattccacttcagctctttcatgttctagggttttctagccactcccaagcttcctttacttcctccactcaaatctagagcctatcttgtgagattgagagattagattagagtgtaagagtattttggagatggcttgaagattaggtttgtttgagcactttggataccttgtgggctgtcacttgggcttattactcttggagatcttctcatagacggttaggtgtcgcccgtgagcttccaaagatcttgtggatgtcccgggaaagtttgtgaaggttttcttcacctccgcaaggaaacgaggtaagtgagtaaagattcttgtgctgagttttcagaggttgtcctaggtagagcaacttacacttgtggtcttttctagaaggaattgtgagttggatcttggtggtcactcaattctagaaaatgacctagaagtgttgagttgaaggttgtggacttcttctgggatctttgcataagtgaggcaaggggttaatcgagacccggctctttgagcacctcaacggagagtaggatccgtgtgatccgaacttcaggaaaaaatcgcctttgtctctcttgtgcatgatctgtgtttgaatctgctggtatcttgtgatttacatcttgtgcaaccttgtgcctgattgtctctagctaggacctgttttgcttccccaaattttgattttctctgttgctaggaagttcctggctcaagaactccggaagttccgggctgctcatctctgccaggaagttccggtgttcttcaccaggaggttccgggccctgttaatttaactgctgtgattattgaaaaaatttcagaaaaacctattcacccccccccctctaggctacatctctgcgcgttcaatgacgtctaagacgtcatggccttcctgaagacattgtctaggaggtcatgttccttgcattcaccaccttttctttgtttggtcatcggcggtttttggttgtcttcatcaggttgggtgagggactagtggatctccttctctcttgacctcttcctctcctcaacctctctacgtgtggataactgaaagctttttgacgtctttctatattgagtcggtgtttagcagagcatttgtaacctcccggttggccaagtggtgattgatcacgcttagcggcggtcggcttggtgctattgtcctctctagggtgtgctacgaggagttgccagctcttggtggtggtgtgtttgttttcatttgtttttcttggttacgacctcgtagggttgtaatattgtaactttttcttgctatactaatatgaattttgcattgtctagcgtgaatcattaaaaagagaatctaagaaatgccattgataagcatccaatttcaagaaataccatcaacaagttcaagttccatgaaataccatcttacaagcaattttatcctagaaatgccatcatcattaggattccgtccatcccgcgccattaaatacattgtaacttgtaagtgcaagttttattattgaaagaatagcgtatgtgactacgaggagtccatggaattgtcatcaactataagagctttcataaagaatatagacagagttatccataaaataaaggggttgtttggttttcataaactccctgcctcccagcgcacgcaagcgacgtggatgcctccgcgtgcgaacatgctactcgaagcgctctcagctaggggtggaaacgagccgagcctcgtgaaagcttggtgcaagggaagcttggcttggcttgctcgctacaaacaacgagctaaaactgtagctcggctcggctcggctcggctcgttaatgggctcgagctggcttgcgagcctggcatcaagtaaatctcaagtaggtctaacagaaatcgagaaacattttaccacatagaatttataatactgtgatagttttctttaatatgtcatcacaacacataaatagataatgtggcaatcaaacttaccatttccaacaaataaatagttagaaaaggtgcaaaatttttgtatataaccctatgcactaagccaaacgagcttgcgagcggctcgtgaaccagctcgggcttgactcgtttttgaaacaagctaggaaggaggcttgggctcggctcatttggctttcgagccgagccaagccgagctataggagcccgaactttttgtccacccctactctcagctccgcaattcccagtagcttttaatataaccgattaaaacagaagagagtaagttggaacaaccattagagcatctccaacagtctctccatatctaactctcgaaatgtctatttggccaagtctccatctaatttggcaagtcaaacttatggtttactccaacagcatctccattcaccctctctattatgaatctacgacagtgggacccacatgtcagcctctacaaccctttcttcttcctcatacttccttttccccacgctctcgtctccgtgctggtggcactcctctgcgtggcggcggtgtcgccggtggaggtaggggtggcgcggttcgtgtgcaacacctgtttctcctctctctccacgccgccatccacgccggcgccctcactgctctgcatctgattcccttgcctttgttccagcggggccggggcaaccttccaacgccccacctattgcatctgcgccggcaacaccctcgacaccatcgccaggggcgtctccgctggcctcgtcccctaccaggacatcgctgcgccagcaacatctccaacccaaacaagatcgccgtcgcccaggagctctggatccctgtgcctgggtggacctccttcccgatggtgacggcgagctcgaggaaggatgcaagcaagcgacgacgcgcctccttccctatgtcggcagcaggcacgagcggaggcttcccccggtggtctcgatgcaggaaaggagttggaggcgcccaggcggggttcggcttctccaaatgctaagccactaccgccattgttgtcctcttgtcccatcgacgtggtagatcggagcagcaacgggggcgacgatgaaggccaacgatgggggcggctatagggccggcgacggagtccaagacgaagacacctcccgctccctccttccttagctcggcctaggacgaggcaacgacggacgagggcgtaggtagtggagacagtggagggcggcgatggatgccgccacagtagccggtgtccagatcatggcacgggcgatggctgctgcacgcgctcagcaatgcctcggatgaagggtgtgcatggagaaacaggcgtggctcccatggatggctagccggctttggctggccaaactagccggctttggctggctaagtttggccagcgaggaagcagtttggatggcttggccattcaaatagcaagcctgttggagtacaattttagtctaaaattgccaaattttgacttgtgggatagcaagactcttgaagatgctcttatagctctacaatttctgaataatccttgaaagctttaacaaataagcatattcacacgactgatacgaggattaagtgcatacaaaatgagaaagccttatacattattaattaagtttaattattataaattaaaaaattagattatataatattttagaagaataacttttataaagttttcatacgaaatactgtttagtggtttgaaaaatatgttaacaaaaaccaacccagaatcaggcgtgagtaatcttgagcggtttgtaacatctatataaaaggttttctcataaatcatgtgttaacaagaaaaaagagcgcatattatattagcactctctctgttaataaaaaacttaacttaaccaaggacaaatgtgacttatcttagtagtatagtaaatataaataaaaggttaccgaaatttattcgagaatgctgggaatcggtaaccggcagggggtgggggtggagcaaaatacgcgcacgtgccttcccccgggccccccacatgtctctgctcacctgccacgtgtctccaccacatactccgttgcaacaaatcacccacatattttggaaatgctctattaagggaattcgtttatttttttattccaaaaaaaatgtttcacctagtgcattcacaatgtttgcccccccccgacgcgcacatgcctcccccgggccccaccacatgtccctgcccacctgccacgtgtctctaccaataaatcacctacatattttggaaaccctctattaagggaattcgtttcattttttgttccacaagaaatgtttcacctagtacactcacaatgtttcactatatataaatctaaagttgcagtgaattgaaacattctttgcaacaaatcagccacatattatagaaaccctctattaaggaattcgtttcatttttttccacaaaaaatatttcacctagtgcacttataatattttagtatgtatggattaaatctttcactatttactgaaacattgtatttatataaggtgaaacaacgccctatttaaatgactgaaacattttcgatctacttagtgaaacaattccgatataattggtggaacaacgtgcaacatttaaaaataattcaataataaactaattttttcatcgaaatatatccatatatggtcttgttttaaatatttaattgcaacgaatttaatggtgtaatcggatcatgatttagataaataatttaagataaaaaatagtttaaagatttaattgcaacaaatttaatagtgcaatcagatctgatttagataaataatttaagataaaaaatagttcaaagtagttttggatgcatgcatgctgatgatgtcaggctgatacgtgcgtctgattttttctatctccatcgaaaatccgacgcgtagacgtctcccatttattatattatattagaatgagtcacgtttaaggtaggttgaattttgttcagagaaaagtaccagaaactcatccgtgagtagggcctacagagccacagcctacaaggcccatttataaaattctccaaccgggggcccatccatccatccatcctcgacaccaccgtctccgcttccctttccattcgcgccgccacctcgccgtcgcacccagcggcggcgccgccgtgccggaggagcggcgatgtggtgccagtcgtgcaaggaggagtacgaggaggaggacgccgggacgtgcaaggagtgctacgaggaggcgagcgagacggaggaggagctcaagcgcgagatcgacgacctccgctcccgcctccacttcctccgcctcccttccccttccctcgacgcctcctccctctcccactccgacctcctcctccacgccatccccgccgatgcgcccgcccgccccgacacccccgccgtccccgcccaccgcgtcatcctcgtgagtcattcttgcttcacttttttccaatcgattagtcccaacacgtagctttctttgttcatgccattcttgacttctcatgtgctagtgctcaattaagtttgtggactactatttgccagattgatctaggattgatgttccggtagccaactagttcatgattgattatatataaattgggggtcctgctggctacttagcggcaggtcgctgattttttgctggcttaaatcttgtaacccagagctacccctgtaaggatgaacttcgtttcattctgatgcctctggtcttcttcttctctagattgatttggattctagaatttccctagccataaccattgtttgcactgcctttgtttcgatgtagcctgatctgtgacgtacaaatttctctttccacaaagaacaaagatatgtatgcattatatactaggacatgtttaattgagatatagagtgggtaatgtgttaatgtctggcttaatattgttactttgctgtaccactgcaagtctgcaacaacatgttaaactagtctagtaactaataaaggagaagaagctgcagaactgtataagtgtgcagattcttcttcgcatgtttttagtgttttgagttccttttctttttccaatgtgttggtgctacttgctttgaatgtgtttgagttgaactcaggcatgttttgcaatgaagttttactagcagtaaaagacattatctagcaagtaaaggcttaaagctgatatccaatactccaatgtgatgaaggaggttgaatttcactattttagtgtctcaataacattgcatgttgtaaacagtatgacactgactaaaactattttgagggcatgtagtttttgaaggcatgaagcataacagagcctggacttcaactgtgatcttacacttatcactgttgatggacagagtttaagtggcttctaaaaatgtaagctgtagggtaaacaggaaaatatgcttctcggtacatgtgtattccaatggttattgactggatgtgacaaaatttgtataagactgattttgttcctaagaaagttaacttattatggtacaataataagctacaaactgtagcatgctcataaatctcaaatacagtcactttaggctgtgttcgggaggtgaggttgggaactcacctcccgtgcacacaaaacactttaggctgtgttcgggaggtgaggttgggaactcacctcctgcgcacacaaaacggagcgacgcattttcttatgattaaataagtatttgttattttttttttgaaaaatggattaatatgatttttttaagcaacttacgtataatttttttttgcaaaaaacgcaccatttagcagtttgaaaagcatgcacgcggaaaacgagggaggtgagttgggaaagttggggaaagaactcagctggagtagtacaatgagcaagcaatggcaagatatcatgttaacatggtaaaagagtcatacttgagtctttataagttattaagacttcatttatctagtttggaatgcattcgcccatcaataccttgacaatttttgttgctcttttttttttaaaaaaaaagtccgcattaattgtataggagcatgcatttgatcaagtgaagttgcatagaacctattttcttatgatataaatcaataaataacagatacgacaatatatatttttgagagtgtctatagtacttgcataccaatttatgtatctaatgcacaaatggaattaggtactcttctgcttttatgtttccttttcactttgtctttgctcttttgatattccaaaagtaatttccatgttgttagatctggaaagataactttggcaatgatgatccatatatcattcgcctgtagtgctgttatgataactttggcaatgatgatccgcatgtaatatttgtaaccttgtaaatatttcctttttttataaaattacactgctgggcaaagccctagcagttttcctggtaaaaaaaaaaagatctttgatgggagttcgaactacaggacatcacctgcctcacaggcaaacatgaatctcccgcttcttgaataggcaccccacagtagctactgctggttggacaacaaggaatattaccatgactatacaaattttggattttgctctcagtgagtggctttagagtatattcatagaggctttggaaaatatgtatttttgaactcgacgcaattccattcagattccttgatctgtcaactgtactgattcagtatttaacttttggctcatatgtaatgcatcatatctgttgtattttggcaaagatacaaatagctttattccttgttcacagactttcaattatatcatcgttcttctaatttcttagctagctattagtatgttctgtagttgatttgcttgagatatttcgcatttgtgaattagttgcatcttactgatgcacacggactagtttctgctgtagaatttattttattatccattaaactgagtttcttctctttgaaaacaggccagcagatctcctgttttcagagctatgcttgagaacgagatggaagagagccggagtggcatcatcaaaatatacgatgtgtcctacgacgtccttcgtgctttcgtccattacatgtacacagcagaagctctccttgacgagcagatggcatctgatctcctggtgttggctgagaagtacgaagtgaagaacctgaaggcctactgtgagaaattcttaacatccaaagtgagcaacgacaatgccatcacgcattatgcgtttgcgcatcgccacagcgcgaagcagctgctcgagacatccctggcagcgatcatggacaacatgtcaacgctggcagatcgggaggaatacaaggagcttgttgagaaggacccaaggcttgttgtggagatatatgaagcctatctgaacagacaagtgaacactgctgctgggaaggagacagattccagtagtaggaaggggtaattcaaaagaaaactgctatcagagatgtaattaatgttctaaccaagcttttgcatgttcatgctaggcaaagactggcacatcaaattgtcatcctgcggtgtaggcgcagaacagctatttctgtatatgcttgaattgatactgtgtgctcgctactgatagaatgagatctattgccatctttatgtaacatataggtcaactgatatgtgatgatcatcaaacacactcagtatgaacaaaaaactaagtgtaaactatttgcaacgttgaacggttaaattgattaccagggctctgtagtgatttgtgcatcgttccgagagtgcagaacattgcatgaaccggactagcttctactaaccttgatcgatttctttagtgttcattgccatccctattgctacgttcatgcacgtttcatcggcgttgagattaaaaagataaaatatgttccaactagctgaagaacatatattattcggctggttgccaaatactatgagaaagtggtcttacatttggtgaatatttgaagtctcgacatttgaaatagggccttgagctctcaaaaagccagagataagttgcatgagagagtgctaaatgacagttaaaagtggtcccactcacctacatcaattatacttttttacttgtgatgtataactcaaatagagcaaaaaacaaaactcataattaaggactattgtaattctttgcattttcctccattaaccattagattgaagttgccattgtctagcagtaacttttctgaccttcgataaatacaaaaggctaacctttttcttttctaaaagaccaaaaggctacattttctgaagagaagtactccctccattccaaattgatctacatatagtttttttgaagttattcctaaatgatctacatatttgtgttcatttattaagtctattcgttatttgtacattggagtaaatagacattgatgcatgcatccatgcatacaagtatttataacccacatgtaatatcttaatttgttattggctaggaaatagtgagaatgatgcatgcatcgagtttgttgctagagtaaatatagtatgagagatttattagtttttcttggtcttagtataccatgaaatatgtagatcaatttggaatagaggaagtagcattcaagtttctagtgaaacaagctgacaagatccttcaatcctatcatattaaccagggattgcaggtttgcacaagattgaaacaaacaattccgttgtctgcaaaggctcctttgcgtgatgagagaaggtctcatccactgaaaacatcaattacaatttaatataatgatgttgtaatgatctgggaagctgcacttatctgaaaccagagtgtgacgtgatagcctgagtaaatcgctaaagtctaccaaaagcatcaaccattaagatagccagttcaaattaagtaccaaatctggtagctccttgatcagacattcactcctatcctaatagtcagcaaacagttcagatagctgatcatctgtccattcagttacagaagccatcttatttggctgtgaatgcaacgatgcactgagagtagttgcatcactgttacttacagagctattttcttgagttggcaggacaatgcccaaagttccagtaatgaagtccttttgctgatgctcattgggttttttgattgaagcgtgctcaacaagatgtgcgacatcatccagaccaatgtttagattattggctaacccataggtctcaatattcgtacttgacataacattatctggcaataccgcatcacccctttgctttttgctattagggtgcacccgttcaccttcaagaggtcgactcagcttttcatcagaactagctgcaatagaatttcccgttctagacatgaccgagcatccacctagagtagactgggaacatcttgtgtttgggttttcaggatcattcaaagtttgctggtgatgctcttcaccattgtggtttgatatatgcctgctgctgaggcgctgcatcaatgtttgtagttcaatcccttggtgcttacctgaactggaactagttttttggaattgctgatcggcactgtagcttggtgtattcttgtttgaaggatttatatctttttccttcatccttgtatctaggtgatttcctacaccttgagtactgccattgtccattcttaacgtactatctcgaacagcatttcctgcataattattatcagaaagtacatcagcaatcctatcatccctggtacttaagatcgtgcggcagatacctgttgtttgtccgtatgtttcaactccagttttcctgatgcggttatctccttggcatgaagaatcccgtgtttcttgacactttactgttatggaatacatgtaacatattattgttcttaagagattaatatagagaaagggatatgaactggaagttaccaggatgttgactttcagaaggacttgatgaaaacacttgcttagatgggaagcagaagtcctttggcacaagctgcaaatataaaaacattcataccgccatgtccttaaatgattatgatgttaatttaaggaacattgtaatggcagttcaaaagtaccattgtgaaagttttgtgaaatggttacatgcttctaaagaactgagacttgaaatacaagtgaatccaagtaactctgctgataatgcaaaggcttattcttgattaacacaaggtctgaagcatgaaaggcctaaatatgatggttaatctgaaggacaaacatcctcccagccagaagttttgatttatataattacatgtgcaagaatgtttggaagatctaaaatggtaaaataaagtatgattttttcatcgatgaacaatgtggctatcttgaactaatggtgtattttaacttcatgaaagttttagaagcaataaaacaaacaacaggatcatggaattgtaggatacctctctaccattttcactcaaaaaactgagaaggaaaaacagaagacaatgatgattctttacacaagtaagattcacagagtgccttcttttcatcctttactgatgctctagtatcattgtattatagctgtctacttccgtaacattatgtatcagtgcatcttatattattttcactctactgtgcagtgcacgtatagtaataatggcaattattatactagatagtaatataaagaaatgcaaatagtaccatctctagattttctttggtgacattaagatagcaacccttgtgagatggacggaaaacagctacctgaaattaacaatgaaccaattactccatatactaagttagtttgccaacaaaagaaatcctttttcaccacaacaccttacatttttcagaacaatgcaagaccctacagatacaaccatgttatcctcctttgtaaatactttctggtgaactgaagcaccaaccgtaccacttggatcctatcaagaataactcaccattatttcccaatcagttagcattcaataaatattccgtactcagattgtaaagtaatatttatggctttcggtttaattacttatctgaatgtctcttaatgtagcccactctacatgtaagatgcaaacatgaagagatgcagataatgcaataagaggtgataagtaatcagaagaaaaccaaccagtacatcaatcaaagaccaaagtccctttttccaattttaacacgagctaattcccgcatgacgcgaacatgataactcggccaagtagggatgcaaagtgggtagtcccgctacccgcataaaaacccgcttgctaattcatttttcatatggcagtataaaatttagaagaaaaaatgaactagaagtgggataagcgggttaaaaaccccgcttgcccgctccgcttgcatccctacggccaaggaatccaactcattccacagtacacacataatcatgccatgatgctttgtgttcgctcaccttgagagaaaggaagagatcaccgagcctgttcggcgcgcacgacgtcaccacgccgaccacctgatcacaaccaaacgccccaagactaatcaagccatcagcaaagacacgcacaaaactagcgaaacaggtagagccaggagatgtccacactccgcacgcaccagacgtgctcgatacaatgcccggtcgccacggatggccgcgatctcctgccgcttccacgcgcgcgcctcgcctgcatacccacgccacgatgagcaaccgaaaacgcaaaaccaaacacggaatgtctgatccggtcaccgcctccactccaccctcaccgagggaacccagcgcgtggagccacggggcgagcgagaagtcggggtcggtggcatggccgcgggcggcggggccggacgaagccaggtggggcggggagcggaggccgcgcgccgcgccctgggagagcgaggcggccggcgcggggtcatcggggcgaggggggcggaggcgggagggagaggaggccgggccgcggcggaggaagccggagtcgtcgaagtccagcgcgtctgcccaggcggcgtcctcctcctcctcctccccggcggcggcggccgcggcggcgctcgccggttgggacatggaggtttgggcctatggggaattgggggttttggggcggcagcgccggatttcggtttgaatttgttttttcttagggagtatgggcttgattgtttgataccaacttatcgtcctactaaaattttgataacttcaatagtagcaaatgccaagttgttgtatttctaacaagttgttgcatttatgcgatcacttataaaattcttgtactaaattgcacgtacatgccaaggtgttatactaaacgctcatttctcaagttcttacaccaaattgtacccacctgccaaattgatacactataggtgcaatttactctaaattttacatacaatagttcaaattcaatactaccgaaggttttggcactaccaaaattttggtatggcaaaaattggttctaaaccaaacaagccctattccatattagtattatcagaaaaacggacagacggaatccaatggggcggggggcatgagagcacgggatataaaagatgtgagcgttatcttccatattcgtttctcccatcaactcatttttctcctccaccaagcaacaacgctttgccttcctcctccctccatccactcttccatcccagtgatcatcctcctctctccctcctcgactcaagactattgtctccaacgctgacgacatccctatcctcttttcttccttcctataccggatccggagcatgtgacggagtggaggttggagagggcatgagagggagctaattatggctgtgaggtttggggattgtcgtgtctcatgtgtgagaaggaaaggtcctgggaaccgacaagaagatggatgcagccggtctcgatgtatagtgaccgtggagttgatgaaatggatgagcggtcattggttttcttcattactcatcactgttgtatacaggtacgttgcaattgatacccttggtatcaggggattattagtaccaaggtctggtaccccagatatcatgcctgatacctaggtactagggtttggtacctcgagtatcatgcctgatacccaggtacaagcctaccagggtctagtatctcgggatatcgtgcctgatacctcaggtgctaaccgatacccatagcaattaggtctgatacctgtggtatcgagtagagttaaggcgtggagaaggagagcgcgttgtcgtcgtttggctggccagtaagtcaactgttgttgtctcatcttctcttctcccttcctctcatcgacgccttcctccttcctgtattgttgctatggttggtgggggcaaggcgctaggggttgccgttgcttcaacgttggagcttgaccatggttcctctttgctatgtatagcagcttgaaggttttatttactatgtatagcagctgaatggttcctctttgctatgcacgtccaggctccttagtccatatatttggagggcagaaaccatcatcttcgtgcactccatcattcctacgaacactcaaaagcataggctcatctaaagtaatttgattatttaacacaaggttagcattcacctgagagtgaatttccttccccaattgtttggctctgctccttgtaattggacccactatattagatgcacttttattaggaggtggggaagagtggctactagggatgtcctcatcagcctccccctcttgagaaggagtcgtcctcgactcagactcaccaacaaatggacacaaatctttgacattgaatgttgcactcacattggtatattcttgagggagctcaattttgtaagcattatcatttatcttctctagaaccttgaatggatcgtcaccccgaggggataacttactcttgcgctattggggaaatcgatccttgcgtagatgcaaccacactaagtcgccggcttggaaaataacagttttcttacccttgttcgcttgccttgcatattgtgcagttttcttctcaatattcctccttgtgtcggcatgtagcttcttaatgaattcatatctcttggcagcatccaaattcacctgttcctgtaatagtgaaggcaaaaggtccatgggcgtatgtggtttaaaaccataaacaatttcaaagggacaaaatttggttgtggaatgtactgccctgttataagcaaattcaacatgtggaaggcaatcttcccacatctttcagttctttttcagcacagcccttagcattgtggatagagtatggttgacaacctcagtttgcccatcagtttgtgggtgacaagtggtggaaaataacaacttagtgccaagtttaccccctaatgtcttccaaaaataactaagaaatttggtatcatgatctgaaacgatagtctttggcactccatgtagacgaactatctccctgaaaaacaagtcagcaacatgtgatgcatcatcgctcttatgacatggaataaaatgtgccatctttgagaagcgatcgacaacaacaaaaatggaatccctccccctctgagaccgaggttacctcagaataaaatccatagatatatcttcccaaggtacatttggaatagataatggagtatatagaccatggggattaagacgggacttttcaaacaggttatgcaccgctcaacgtgtcgctggacatcacgtcgcatatgtggccaaaagaaatgatcagaaagcatgtccaaagtcttttttacaccaaaatgaccagccaaccccccagcatgtgattcctgcaaaagaacatttcgtatcgagcaagctggaatgcacagtttgttagtccaaaataagaatccatcatgcacatagaatttgtcccatccttttccagcaatacaattagagaaaggttcgttaaaatcagggtcattagcataaagttttttaattgattccaaaccaagcacttttgtatctaattgtgtaaccaaagcacattgtctagacgaagcatctgcaacaatgttatctgtgccacacttatgtttgacaacataggaaaatgtttcaatgaactcaatccatttcgcatgtcgacggctcagtttgccttggctttgcagatatttcacaaattcatgatcagaatggattacaaattctttaggtaataaataatgttgccagacttccaaaactcgaactaaggcataaaaatttgtgattagaatggattacaaattatttaggtaacaaataatgttgccagacttccaaaactcgaactaaggcataaagctctttgtcatagacagagtagtttagatgtggaccatttaacttttcagaaaagtaggcaacatgtttaccttcttgaagtagcacacctccaatgccaataccacttgcatcgcattcgatctcaaaggtcttaccaaagtttggtagttgtagcagcagtgcttcacaaagcttttgttttatctcttcaaaggcatggtcctgttcagctccccacttgaatggaacatcctcctttgtcaaattgttaaggggtgtagcgatggtgctgaaatctttaacaaatcgtcagtagaaacctgcaagtccatggaaacttcgaacttgcctcacattttcaggtgtaggccaatcctttatcgctttaatcttttcttcatcaaccttgatgccagctgcagtcaccacaaaaccaagaaaaacaacacggtctgtgcaaaaggtgcacttagcaataattccatacaatttctctgctctcaaaacagcaaggacttcacagatatgatcaagatgttcatcaattgatttactatagatcaggatatcatcaaaatatacaaccacaaattttccaatgaaagctcgtaaaacatgattcattaaacgcataaaagtggaaggagcattcgtcaaaccaaagggcatcacaagccattcatataaatcaaatttagtcttaaatgctgtctttcattcatcaccaattttcatgcgaatttggtgataaccgctatgtaaatcaatcttggtgaaaatggttgaacctatagatggccatgtgggccgcccggcacggcccgaccgacgcaccgggccgtgcagtgccagcccacgtgccgcactcacagcccaggccggcccgaaggcacgatgggccatcgtgcttttcctcagaataagtctaaattttctccctcctattgggctgtgacattgtatagctaaaaaaagtctattttacctccctcttctttgtgctgtggtatataaatagctaaaataagtctatttaaggtccctattctttagacattgacatttatatgtctatttttattccctatactttgtgtaccgggtctggcctgccagcccatcgtgccgggccggcccgaccgtgccgggccagcccagcgtgctggtggggaggcccaggcacggcccgacagtcgggccgggccggcatgggcccgacccaagtcgggccgtgccgtgcttgggccgggccaaaaaggcgtgccgtgggccgggccttcgggcctcgggccttatggccaactatagttgaaccactcaattcatctaacatgtcatcaagcctaggaattgaatggcgatatctaacagttatagcattgatagcacgataatcaacgcacatgcgccaagacccatctttcttagggaccaaaagtacaggaacatcacaagttgagagagattcacgaacatacccttagtccaaaagctcttttatctgtcgctgaatttcttttgtttcttcaggattggtgcggtaggttggacgattgggaagagaagcaccacgtaccaaataaatttggtgttcaattccgcgtatgggaggaagtctagctggaacctcattgggaaaaacatcctcaaaatcctgtaataaatcaagaacaacactaggcagcgacaatggtaaattgttagctgaaaataggacctccttgtgcaagagcacaaagaacgaggctatggtgttcctcacttctctcaaatcactctttctcacaaataaaaaatgttgtcgtggcagttttgtattttcaggaggctttatgtggctggatggtttaggagtctctcccttactatttgtgtggctctctcataattttcttttctcactctcatctcttttcatgcgagcaacatcagaagagcttatgtcttcaggagataatggaacaagaaccaccttattctctttgtgaataaatgtgtgtttgttcgactggccgaagtgcacagaatccacatcaaattgccatgggctacccaaaagtaagtggcaagcttgcataggaacaatatcacaatcaaccttatcatgatagtcaccaattgagaatgacaagcggaccatagatgaaaccttcacagtccctgaattattcaaccattgcatatggtacgggtgtggatggcgacgtgtttgcaggccaagcttctcaacaagcaaggcactaacaatataatattgttgcagctctcaccatcaattataaatttgcacacctgccgtttcactttgcatcgtgattgaaacaaattatggcgttgcccttgctcagctgcaactaattgagtagaaagaactcgtcgaaccaccaatgactggtctggtgcattcaaactataagcacgcacggtggaagttgtagcagacccaaatgaactatcatgtcggggcgaaataggagcctccaaataattaatatcaacaagcaaatcatcaaaatcggcactagtgatttcctctggatttggaggaattatacgaaaaaaagatcaaatctataaataaatcatatggagaaccaaaggcacaatgctgctgccgaccagtatatactttgcaattacgtaaaagaatatatatatatactttgcaattgccgtcttttggtgctttatcttcgtaaagcttttgttccggcggtttcctaggagcgtttgttccattttttctgctacactctagtggagttatatagaattctttgtttcggcattgtgagaaaaaaaaaagtgagaggttaacggatggcactgggacaacctagcaaaatcggaagagaaacactcccataaatggcatctcatagaatttgcatttatcaacaaaacaacttaggatattcacaatataaaaataggatcggtattaagccttgtatgatctacttatatatattacggaagtggcttttataaatgtccttagtatgagctatccatatgcatatgaactatctgtatagaataaattaagtaatacatcgatctctactcccatctctctctccttctaatgctacaatggcatgatatacaatgaataatgcaatagttaaagctaatatgtgtggaccccatctatatggattatatattttgttgatgctctacatagattccatcaccaacgataaaacacataatttatccaaataacaacaacaacgagaagaattaatcatcggtgtgatgatgtattaataatgctggagcacgactctacgcactatactcgctacaaacagttggattttcaccaatgtggcctatatatcccaggtggttaattaattagtgacattaaaaacctcattatatatagaaagccaaggcgatgccatgagaagaagaaaaacaagaacacacacgtttcaattccatcggaaagaaagaaaagaaaagaaaaaaaaaacaagaacacgctgacaccataagcagtacgtacgtcgatccgtttcatccgtctgggtacgtcggtgatgatcgatcgatcgatcgatcagccgcggcatttctcttttgctatgcatggcctcttggtaacggcgacgcccggtggaggcagcttcgccttgaggttgccgtagtcgaggtagccggtgcccgatttcgccgccggcgagtcgctgctggacgatgccgcgtcgacggtggcctcctgcaggatcgccgccagcacgacgcccaccagcaccagggccaccatagtgcccaacctgcagctcatcctcaccttcgtctccatggaaaattggtgcccaaaaaactactaccaacaacaacagcagctagcagctgcagctgccttcttatgccttattttttttgtgtgtaattattgaatttctcttatgtgttttggaggttgatgatggcttgctgggagagccctttttatgggagactgtttgcctataaatatcaacggcggggctgaaatttagagccggattaaattataactagtcacgggctcgatttttagcttgtactaaatttggtgatcggactcgacacagggaataaccgatgacctaaatttaattataactagtcaccaatatgtatatttgcatggccttagtcttggtactgtttttgggaaaaaaaacagttttagcatgtggccggaaaatgacttgccacactgcctgtgatttaaggcatgtgaaaaaacaccttttgcagatggcggacggccgcctagcggctatgttagcgttatgggactatctacacaaaaattcacagtagtgctgaaactaatttctataggtcctcaaatgcataaccgaataaaaagcgaataaaaattcacaacacaaattaatagaacaaaatattaaaatttatagcacaaattcatgaaactcgtagcagttgaagacgtggttcgatcatgttgctgcatgaagggttccccttcatgacctcatccacctccgccgctgtggacggcctctcccctcttctggatccgcacgccaccgccatggacgacacctcctaatctggattcgctaagtcctcctcatagcctttatcatatgcatttacaacccactagtttgctataaaattccatgtacattgaaacatattatcttatgtttggtatataagcatattatcttatgtttggtatataagcatccaagtatcatatagaattacaatttcatattaaccactatagaacgcattatcaaataagataatatgagtacacgagatgattatcgagtacacgagatgaactggtgtctagagccgtgctaactaaaagactgctagcacggcttcagacaccagcttggccggaattacatgatgttgttcagacaaattcgataatcatccagcaaattcggtaaatgaacgaagcaaaaggccggcagatgcaacaccatgataaagagacagcaatacggtactgtacattccagttttcttctactacctggtagtagattgcatgatgcatctaccaatttcagtccttgctcttttcggtacacactccattgcaggcagcatcatcagttgtcctggagcactcggcagagctgagctcccagtgccggcagcgtgaccggtttctggaccagcccgttgatcccggcacgctggcacagctcctgcacggcgccgccatcatcggtggcgacgacgccagccgcgacggcaatgacgatcagcagccagcagctgttcctgagctccctgatcctgagggccacctcaaaccggtccatggccgccgagggcacggcgcgatcgtcgaggtcgaggacgacgagctggaaggaggcctcggcgctcgccaggaggctcaggcagtgggcgcccgacggcgccgacatgacctggcacccaagcctctccaggatcttcttggtcaccccccggttcatggcgtcgtcgtcggcgaggagcaccctcaggccgttcaagtgagggatgtacggcggggatgcttcgacatgtccctgctgcagcttgaactgcaggatcagggtgacgctctctccgacgccctcggagtccgacgccgaccacatgttaccattcatcatctgatcaagtaatacataaagtaaattcatttgtttcctcggattacacaactcttacaggtgttaaagaacctataattaaactgagaagttttatcaacaaactactgataagtgatgataattctagcatttccagaacgctttctgtcggtgagtcagtgtgtgttaaacaatggctgtgttaaacaatgggatatgtaggtacttgctatgtgcttatcaacagaggccagagagatgtcaaccatttctattacttcatccgtttcatattataagttgcttgatctttttctacaaagtttgattaagtttatactaaaatttagcaatatctaaaatattaaattagtttcattaaatataacattgaatatatattgataatatgcttattttgggttgaagatgctactatatttttttataaacttagttaaacttgaagaaaattgattatgaaaaaagtcaaacgacttataatatgaaacggatgaagtatttaaaacagagcataattgagtacagtaaggcagcaaaatagatttggagatctgcttccagtacttgtatgagagtgtattgtgagtgatcccatatacctgcacaatcttgttgaagtagccgctgaagatatgccccatctgagagctggtagtggccgcagaacgacgaggcaattcgcacggcaaactcctctcaatagcacaactcctagatctcccgatcccgaccttgaacttgacgcaaacgttgcaaccggagaaggtcggtcgcatcgggatccagtcaaggctatacctctcttcacccacattgcagatcctgaccgagaacgagaggcggcacgccccggacccggtgttgcatcggttcagcagggtgcccaccatgtcaagcagcaggtggaagaccctcctctcgtcgccgacgacccattcgggcagcgcgcattccggctggtgcaggaacccagctcccccgcaatgagacaggcagccggcgacgctgatggcctccttgatcagcgcgtgcaggctgaagggtttcctctgcacggacaaatgctgccggttcacggtcacctcgtccatgagcgccgacaagaggttgcttgttcgggcaatggcgtcgacggcgagcctctgctccggccgcattgtgtctgcctccggatgttgcagcattgagaccagcccgactacggagtgcacgggccttcgcatggcgtggcacatggcgctctggatggagctgaacgccctggtcgccatggcggcccggtgcttggcctgcatcagcgctctgtgctgctcggcgaacctgtcccgcatcgaccgcgactcctccagcaccgcggcgtgggagagcgcgacggcggcctggtcggcgacgacctggacgatctccaggtcgtggctgctccacccgccggcggcgtcgtgggggggaagaagcagcaccaggatggcgtagctcgcctcggtcacctccggcgtccctcctccgtcgtagatggacaccctgaggatggggatccgaatggcggccaccgcccccgccggcgccgcgccgacgctgctcgccatggcgagcgccgagtccggcccgagcaccttggcgaccttgctcgccattacgtcgaccacgtcggggtcatcggcggcgacggtgcacgcgtcaccaacctccagcagcaagtcggccgcgtcgtcgggccgggaggtgaggtgatgcaccagaacaaggtcgtggggccggccggcggcgggcatccagacggcgcaggcgtggaggccgagggcgtctgcgagctggagcgcaatggt

SEQ ID NO: 60487 - DNA, 9039 bp, Oryza sativa
acatagtttggctagctgatcaggagctgtgtttgaaatggacctaacagggagatgaattttgcatgagatgggtctagatggaaagaatgcggcaaccaaacacacccattcctgcacacaacatagcatctgagccaggctcatgcagacatcgatccaaacaggctctactgcgaggagagtgtccagtgacatgaaatttcctcatgtctctcaggcctacccacaaaattgtaacaagcttgcactggagtgatcaatctctttcttagaagcttgttgtgctccttggtcttattttctagagtgattttatagtccttgagaaggtactatattttctaatgtaaaatttaggaaaaatttcacaattcttgagagataccgagaggtactaaatttggtacctcctagtaccaaaggtaccaagagatactaaattttacactagaaaatatagtagcctccagtaccgactcaaaaactgtaaaatcactcaaagtttagtacctttcggtactccaggtactaggaggtaacagtttgcactaaaaactttgttaccacttggtatctctcaagaactgtaaaatttctttattttctatgtgtggagcaaatagaggatattaccctatatatgaaaattcactatatgctaactatgttttcacatttaatgtaccatatctatatatttataccagtgcaatctttttttattagctagtagtatacctcatatagatcgatggtgttggtacttgtgatattctattaccaggagagacaagtgtaaaagtaattaacgagtctagaagacatcaatgagggtgagacgacacaataatttcattaattgtctcacatacattcaagcggttcagattgagttctcatccatgtaacttgccgtccggaggaggacgggaagaagagatcaaattaacaacgtgatcgctcttagcgttcaaaataagagattgtttaggcagcaaattaaatcgtcgttagctctcaaggtgtcacagcataaaaattttcagtggaagaggcaaaattttcagcacaatgtgcacctgacagtacactactgtaatgccattcagatcatcgtttcaggtcaggttgatcaatttggcataaaccacaggcttaacatgtacatcaccataaacagtaatggaagtttacggatttgttatcagcagcattccttgaaagttaagaaactgtcatctctgctgtacatggcattcaggtgatcacatccactcaatgaagagtttgatatcaaacgttcaaaccgcccatgagattcagaaattggttccaagaatcaaaccaagagttgcattgcaaggatatctgctgatgcaccaggcagaatgaatataaattactgtatctaaaaacagtgtccagtgaagtccggatgtctgaaacttgcattggaggaagtatggtcagcaaccagcttaccagttgcatatgtttcagctcttggtgcctcccaggcctaccatatcgtagcaaagctatggactgtctaaaatctccatggttcttcttgtttatctcaattaacatcaagctagaaaaacaagattggctacctttcatgcttcttttatatatggagcaaaaaaagatagcatggcatcatatagtatcatgcatgattttaatagctttcgcgaaaaaaatacacgattttaatggaagtgcatctacattattgactgagcaatcaacaaaaatggtggtttatgatctttaacgatccatctcaaaatcattcacccagtcatacaactctacacaatcaagtaaccggatggagtcatgaacttaattcttcatcaattgcatttgtggcgtcaacgagaaactgacacaattccattgccttgtcacacttgcaggacccaccacatggccctcacaagaatgattacaatgccaccaaagacatcatgatgcaatagttcgcaaaacttcatggtcttagcggaaggtgaaaaatgtctgaatctgctataattgtttggacgatgagagttatgctgagatgcagtttattctgaacttgtgaacatatttccacagacaaaatggcaaacaaagtgggtcaatcatgttttacaattccgcatagcatatttcaactacagtccaattcatgaagtgtacgaatagggaacttagtttttttttaaacgaaaagcggcaaaagacttaccgaatatattagaaggaataaaagtcacagtacagacagggaaacaaagaaagcaactagcacgttaaaagagtcatgctatgaattcagaaggtcgaacattgactcttaaaactctttgggccatcagataggccttttagatagatctatttggtctatatttttcctttactaaaaaggccacctgattttcattccgcgagctttgctgaaaaattcttcgattgcgctcaagccgaacgttccactaacttgatggttcccgaggatcttcttcttcatggtccctgacgaaatgtggcaatcccaatagggaacttagttgatggccttctgggtgatgacgaacctaagaagcctaggagatgaaataactcaattttatagatgtttcgtaattaaaaaaatcaacgtaaaatggtgagggaagaacctacacgaggtgaccatcgtacaaagatccaatgttgaacggtgaccagttacatgtactctctcccaaaaatctcatatatcattctttggtttttccaaaaatctaagtcctatttgtagtcactttgtgctaaataaaattgttaatcggaaaccaagaagtcattctaatacttattggttgcatgttcattggtttgccatatggtgagtgagttaattgcttcttggtattgatgcaaaaataaataggtctcaaatttttggaaggagggagtataatgtaatatgattcctggagagatctgaataacttggttaatcatgtctactagcttgagaaatggtgagcaaagaacttagcagattgagactattttgtaattgaaaaattcccggtgcttcctaggccaaactattatggcgataagccacttgaaaaatcttatctccatcaattctccttctctttctcagcctgagatccttattcatattgccttttataggtcaggaaaagggatatggtgatgtaataagtgagctttagtgcaccgtcagatgtggagaatgggatgtttccattgtcttataacgaaatcgttaaattatatatggcagttatataaatattaaggataagatatgtttagagtccttcattattagcgaacagttgactatgcattgaaatcagctttcttgtctctatcgttgtactcctatatatacaattcacgaggctccaaaacaaatcaaccaataatcgcagtatatttctcttcatggactatttaacacaaatgtgatcacatttttttgaaaatgcatttcttaatgcttcttacagttattcaagaaatgaaaggtggagctgatttcaatgcatagtcaactgttcgctacgcaatatatattgatgcaacagaaagctgaagatctagctaattaacgagttacatgttgcattagtgcaaaattcattcaagtggtgttttttgaggacgccctctattaactcaaaaaattgcacttacccacctagataaaccaggtcggtcatctccaaccattcgatcgcgatcgggcagacatgatagtcgaagccagcttgttttcttttttttggtatgacaccttcctttaatccgtatttccaatcaccaagtgctatgtctccccactcatcagcgacgaactacgatatcgaacttgcttcctgtgttgtggacaaacacactggcatcgatctactgttctctcccttccaccaaaatggtccatctggtgcgtcgacctcaacatcgcgccatcgatggctgcacttacaaacttacagaggcagagttccatggaggccaaccttggtcatggcccctccagctttagaaatattgcattattggagtccccaagtctttgatactctaatacttcacaaaatagcacaataaccgttcaaagaagctatcacactgtctctctccaatttattgttcaagctccgccgctgcaagcggagcaagttgctgcgcggtgtttcttttttttttcacgaacacgcagtgtgtgtcagcattagaagaaaagagttttagttatacaacacaataagcctgaccggcccttgccaagtaacaagggagggatagcaggggttgaacaaagagaagggatacaaactaacaaaattgctgctcctagacagaggaagaaaaaaggaaaaggaaccccctatcctcccaataggtcccaaaacgaagcggcactagctaaagactagagcgctgtttctgttaattatcacaaactaaagtacccatgtaactcgccagagatagaagggaagatgaggtcaaatcgtgatatattgcttagttatgagcatttaacaagagatgcaaggaaggtgggaagtctctctttgttttctatctcgatcgtgtgaatgaatctggacaatatttatgaaagacggcacacgaatccaggcagatgtacaagggattggcgtgacaattttacacaaaccaacggctaaaaagggattgcaccacatgtacatcactggagcaagtgaaatttcaccataaaagcagccagctttacgcgagataatagcgaaaggaggagagatttgctccggtccaacaaaaagtacatcgaggtaccagtacctcacggtaccaagtcgtttctgatcgttggatctaaaaatgcccattctatccagctagattcaatgatcggaaataatttagtaccgtgaggtaccggtacctcgagataaccggaacaaatctcaaaagatgaagccctatcgcgaccatgaaattcaggtgaccaaatccactctagaggggcttcatcctgcgaccttgaaggtgcctgccgcaagatacataataaactggttggttgttgctagcattaaaatcaagagctgcatatatgccaaattaaacatgtccactgaattatgaaagtctaaagcttgtttgagaggaagaattgggtcaggcaacagcttaccaataagatgtatgagagctcctgacgtcttccaagcctaccatacaatagcaagccaaccattgggctggctgaactccatgaaatattcttgtttcatctctcttaacatcaagctaaaaaaacatgttgctgctacttcattttatctactcttttatggaattcagcatgtcaactatctagttagtcatgtcaactatcttgagaaatgctgagcaaaaaacttagtagcaggaggctagtttgtaacaggaaagctcccgatgcctcttaggcctaactattatatatggagcaacaagccactggagtggtctatctcccatcaactcttcaatatttgtttttcagtctggtgtcctttctcttgttatatgtggaacaaaatgatacggtcatgtagaaagtgttatagctttgtgcatctttggatgccaggatgtaattattctattatcttaaaaaaataaaaaatatgatcaagtatgatttaaatgctcatcagttactattagctaccacacactgatgcaatagaaggttgcagaacagacacgatttggtttggtggcaaattaatttaagtggtgtttttttgaggaaacctacatttacgtcgaaaaagttagcccattcgataaaccaggtcatatccaaccatttgataggacagatatcagatagctttgtggaagccatggattgttatttttttcaagaagaaacctccttttgtccatatttctagtcatcaaattggcggctttgtactttgttttttcttgatgaaatacagaatacacatttcgccacttccaaaaaaaaaaaaacagagtgggtgaattatgtttttcagaaattcagcatataccattccaaccacagtcatgaagtgtacaggcaggcaacttcgtcgatgggcttctaggcgacgaccaacataagaggcctgagagatgcagtaactcatttttatagaagtttctaagaaaactttcaaggtaaaatggtgatgacgagaacttatgcgtgtgagctgatcatggtacaaagatcacatataaaatggtgaccagttacatataaaatgcaatatgtttccttgatgattgaggaccctgtagctaatcatgtctagttatccgataaatgttgtggtaaagaagttgaaggaatgggctattttgtagtgggaaagctcccggtacctcctaggcctaactttcaacaacaagccactgtagtggcccatcaactcttcatctctttctcaacctggggtcttggatcctgtcttttataatgtcggaaaaaaggataatctgtactccctccatttcattttaggtgtagttataatttttcatgcccaactttgatcgtccgttttatttgaaaattttttaaaaaaatttaaaaacttaagccatgcataaagtactatttgtgttttatcatctcataacaataaaaatactaattataaaaaaattttaaataagacagacgattaaagttgggcacgaaaacttatggttgcacttaaaataggatgatcgaagggagtaataaccgatcatgactttgtgaatcgatcgtcagatgcaacgattgcgatattattattacactatgtttgaaagattgagtgtcatgtttcatacagtcgatttcaatgcagcaaggcaacattcacgcaaggaagagctgcagacaaaattaacgaggcgaggatttggatgggtgcgtcatggattaatacaatggaatacattagcagcatgagatgatccagcaataatcaagagtgatccaaactaaagagttggaatgcttttctttcgtgtatgaggtcctcttttcagtcgaaatactacctccattttttaatatatgacacatttgactttttgacaaacatctaacagttcgagaattacatcgctaactctagcagagtcaactacaactgttcaaccagatcacccgtgcatcagcggaatcagcagttgaactgttgaagttaattaccagcgtctaagaagatccacgagacaacagaaaaggaagaagctgcagtttgctccctagttgaggatatagaccagattgactggacaataaactgttctgcaaccttgaagaagcctacgagatgcagaaacatgtgtcgcatgccaaaacatgtccactgtgccactgcaccagagttctgaaactctgaaacttgcttgagagcagaagtgaaacaacggttatgcaacagtttaccaccggcgtatctgacagctcctgatgcctcccagacctactatacagtagcaactgggcgatgagctccaagaactacttcttttgttcactgatgacttgttgttgttttttcactaccgctgtcaatatatgatcaatgtttactgatgcccatcacttcccaaactaagaaatgatgtcactgaataaagacggccagaaggtgaaaaatgcatttgattggttagttatttggacaaacagaagcacgctaatgcgacagcaggagatgcatcgacagatgcatggtgacctgttacatgttatcgagtctatatagcatctgattgaagtgatcatttaaatacagctatattccagttcaatgcagcacataacttcttttgtactggtggctaaaatgggtttgcacaagcggggacaaccgcctttgagaaaatgtctgtgaaaatgctatatttccataggccgggaagcaaccagctgaggaaatgcatttccacattttaatttttcaggtgaaagaaaggtaaataaattttgtattttagtatgtgtctatacatggtcaatttttcatagctatgcaaaataaatacgaatggtttggtggttatagagagtaaggtgaaaatgcgtgaaactggtaattatgtgaacgaacagaagttcatgcaatttactctgaacttgtgaggacatttgcaaaaacaaaatgaacagagggactgtgaattttgtttttcagaagttcagcgaagcgctttcaaacaacagtgcaattcatgacaatgctgacttcgtcaatgggcttccagatgattgatgatggacatagcactagaaggactgagcgatgcatcaacccatttgtaactatcaatgtttctataaaggggggaaaaaagatgctagaggaaaaatggtgaggttaagaacttaaatgagcctataatgagagaaagatctatataggcaaggtgactagtcacatgtagaatgtaatatgatttcttgatgcaccattcctgtgtggttggtatcttgaaaattcccaagacagttagcaaagaacacactgggaattgacccattgacaggacatttcccggtgtctcccatacctaagtgtcctagaagagatttgctccggtccaacgaaaagtacctcgaggtaccggtacctcacggtaccaaatcgtttatgatagtgactgttataatgctatttttggataggccgggaagcaacctgctgaggaaatgcatttccacattttaatttttaatgtggaagaaaggatgataaactgtgtatcatagaaattggttaaacgggccgactgttccatagggtttccgttggaccataaattattgcggtttatacgacagaaggccaaattgcaagcaactgttatttctctcacaaacaaaggattttgccttttctttggcctccccagcttttttcttattcaaatgaccgatggactgtgaatttttttctgaaaatattttacaaggtttaaacttcagcctttttc

SEQ ID NO: 60488 - DNA, 11067 bp, Oryza sativa
  unsure (1)..(11067): unsure at all n locations
ggagggcaaatcgttacggtcaaaaagtcaatagatataatacgtttttggtggcgattaatcgcattgaatgcttaagctaaattacacctggtatgcgggcgataaaacttgttcccgcaaagcaaaggtccaattagggggagtggatggggcaaagctatttataaggggtcgtggcaacattgtttgcatgggagggaagaacagcaccaagatatgaaaatgttggagtacttggcatacagaacacacggtttcaatggccatgaggaagtatgaaagctgaggtatgaggatatgatgtgtataagtgagcagtcaacggttgctgatataataatagtgcaatgtttgatggcagcatgggtgtaagtgaatatcaaacttccataacttcatgtgattccttagatcaggagcaagacgtaaaatttcaaacaggtatctgtcagcaattcaataagttagatagaagactagtacagaagtacatggcgtaaagagcatatagagataggctngtnggnnnggagcaaatctcgtactagaatgatccacccatatattgatctccatcttcgtcgtctctctctctctctcggcagctttatgtgctgtttaaaagatgcactgtgcatctcttgctagcttctattagtagttattcaagacctgcaactgatgaggttgatcatgagatgattcatcagtagcgaccccacccggaagaaaaggaggggtatttttcataaaataccttcctattatccttgagcaagatcaatgtatgtgtgattaccaattacatatgaaatgtaatttgatccttgagcaagatgtggttattgaagtctactaacttgagaaatgatagtaaagaatttggtaaaaagtgggttatccataataggacagctctcgatacctcccaagcctaccatggcaaaagcaagcagttggagtgatcaatctccatcatttcttcttcagcctctgctccttgatcttgtctttatattcatagagcaagcaggacatggtcatatctgaaaattgagtgtttttttttcagttcagagagtttaatgcttaataacctactagtattactctcttacctaggcacccactaagagattattacattggagcctcatctccagccattcgatcacgatcaataggaccataagaaaggattagaggatggtggaaatactgcctctgctttctattagaaatgatagggatcaaaggacaacgctgtgaaagatgatatggatatgggccgcgtcaaatacgtgcatattgcgacattgaattgatcagatttgctcaaaatgcagaaacttgtatgtatgctaaacttgcatcaactggtttctaattgctagaaaagcatcagcagtagagaggcagaatggtatggcaacagctcaccaccggtttatctcacagctcctgacgcctcccaggcctatgatattagtaactgcagcaagccagtttcttggttgctgaactccatgagctccacttgttcatctctctgaacatcagtgaagaaaaacaagtttgctgctacttcatttcatctgcccttctatggatcaaaaaagaagacagcatagtatcatacacgaatttattgtctgataaacattcagtaatttaagagtagttagggattttgtctcatcttattattggttgtgtgccttatggcagaggcgggtggagtgattggtctcccatactacttctctctctctctcatttcttacttgttggtgtctcaattgagagccccattggttgccctaataagctaaagcaaaagttaaattttaaattttcaaacttaattttgaagttgatttaaaatattttcaacgtgattctttttaagcgttggcttttaaatcgctaagaacacatacataaaagttttacttataaattaatttttattctctaataagccaaatccaatgggagcctgattatttaatcgtctgatctgatgccatcatttcaaagcagaacttagctcgggaaaaactgacgacatgtaattaatgttattgctttaatttcatgggagtggattatataacactgtgatagatcaatgtccccatacatatatattggtagtgatcaatgatattatgacaaaccaatgaatcattgaattgttcttcctctcctgctttgaatagcgaatgttcaacaatgtcacttcacaaaacatagaaaattaattttatgatccttaagagggtatcggaaggtaccacactttctaatatataaaatttaatacttcttagtatctcacatatcgggagatactaagaagtattaaatagacaccacatggcacagcaattttttctaagtgtcacctctcagctctgttctccctcacctctcctctccctcatctccctcaatgaccgatgatgggggcggcagaaaccggcgacggcgaggcgcggaggcggcggggtcggcggggttggcgacggcaaggcgcggggttgccgacagcaaggcgcggggtcggcggcggcaacagcgaggcgtggggtcaacggcggtaacggcgagacggcggggtcggcgcggctcccctcccctccctcctagattcggtcgaaggggggaggggggaggagaggtggcggcggcggcggttcccctccctcccagatccggccggagggaggccggggaaaggcagcggcagtggcgacagttctcctccctcctagatccagccggagggaggctgggggagggcggcggcgacagttcccctccctcccaaatctggctggagggtgccccggggagggcggtggcggcggcagtgcccctgcgcagttcccctaaccctagatcggccgaaggtgggtaggggcgcgggtgtggtggcggagaatttttcttgttcgtcgagatgattttcacaagcgggtgactgggccatttgcgaaaggcattgacatacaggcggatcgttccccgcctgaaaaaaatcatttgtgtccgcctgaataaaccattttctagtagtgagataccaaattttgtactaaaaatcttggttcctctcgatacctcttaagaactataaaatttcaaataagaaattaaagcactaaataaacatgtttggatcttctcaaaaaaaaattaaagattattgtattccgttgattgtatcgtgggtgctgaatattgtgccttcaagaggccccagtcactcatatatagagatgatgcggggtaggattagaaggtagaaaacttagccatatatggctttagttttctggtctctattttttatttatttgaataggattccataccctatattttgtagtacaagaaatcatactatggcctgatttagttcctaactttttcttcaaaccttcaacttttctatcacatcaaaactttcctacacacacaaactttcaacttttcagtcacatcgttccaatttcaatcaaacttttaattttgacgtgacctaaacacaccctaggctagtttgagtctaccttctatctcctagatcaggcccactctcccttcatagccattaattatgcctgtcgtgtgggtacccagatccatgatcgctacagggtcctgtgacttgcgaaattgcagtacaacctactagcaactggatcggttggttgctgtgttcgtttatcgcggtcattgcttcaaaatatcatataggtgtaggcactatataggtgccgaaagtgctaaaaccaaaacctatagtcatttttccatttttacgggttgaaatctcaaaaaaaaaaaaacctttaaacaattataggtgtcggttaaccgacacatattctataggtatcggtttttttttaaaaaaaagacacctttaatatattaatatattataggtgtcagttaattaaaaatcgacacctataatatacggttttaaaaaaaaagatacccgcagaaatcgagctgggccgacaatcgagccaagccagtttttttttattcttgtgacctcaaaggtgccgggcacctttaaatattcacatcagtgccgcctccgtggtgtcgcttgggaaaaccggcacctatgtggggttcccaaccggcactaatgtggttttatgtggcagtgagttgggaacggtttcctatggcatggaaaacggaacagttcattagtgcgattaattaagtataagtctaaaaatagaaaatagattaatataaatttttaaagtaactatctaccatatataaatacatatatgtatatatatatatatataaatacacatatatatatatatatatggtgtgctacctagttacgtaacacctctcacagagtctccttgcgtgtccctactaggcccagcccacccccgcctgcacccaccaaagtaatttttttactatgattagcaccgtctatttatatgtgtttctatccggcagtaaccatccaaccccttatccccgaaatttttggatcatccactcagccggcgaacgcctcaccctgccgtcaagatggccagaccagctgggatgcggtgaagaaggagcggctagtgcagtcagcacagctaggggtcgccaaactccacatcggagtggcgttagaggacctgccgttgagggggagccgccgtcatccgatcagatctggagccaccgtcgccatggctctccaccgcggaggcctaggcagccaaggacacgaggtgactgccaagctcctccaacgcctgccgcagcgccgtccacccctcccgccatcggcgatgttcatgaaggaaacgggatgtaacccgatccgctgggaccagcgccggtggcaccaggagagccgcgacaggtccggggcatcaggcatggcttcctcctccttgctcatcacggaccagcgctgtatcggtgagacctggcggctggaggctggccgtccctgtgctatgcgtggattccaggcagatttggcgctgatggctgacattgcctgcgcagggccacacctgctgctcgtcaatttcttccctatctacaagctgggtcctcaccaacacctgcgacacttctcatgttggtccctagctctgctctcctttatctcctctctttcaattgaaggggtgggtaccagcaaccttcttcttgccagtaaaacaaatagatttttcctcttcgattgtgcggtcttaatttgcaacagtatttttttattttatttttttttgcatttgctcattgattttgttgtagattgccggcacccaaagacagccgaggacttcctgaagctgagccccggccgcaaggttaatttttctctagacgcatcttgattggtatatgtattcgtgttaatcctgagtaacatgaccacagaagaaataatctgcagctgtggttggtattcacactccactatgattgatggaactgatggtttgggtgttgctgatttgggagttggtgacattgaaacaaccactgattgcacaaacacatcaaatatatgtataagttttatgagtctattagtatatgttctttaggttatttttttttgtactagtcttgtatctgacattctgaattgctgacaaatacatgtatgaaattttaggttttttgctgtgccaaaggaataagatgaagtttctgaaatttgatatccactgacaccctgctgaaatcaaacatggcactattattatagcagcaaccgctgactgctcactcaaacacatcaaatcctcaaacctcagctgcgatgctagctcatggagcttgagaccgtgtgttctgcatgcagagtactcgagcatattgtaattttggtgcagtactacagtggcatggaaacaatgtgccggcgtcccttagtcatggctctgcccagccaacccgacgaagtggtcatatgcttagtgtgtaaaaattttattgttcgcagtgtttgtgtagtttagcttgtaattcaatgtgataatcgtcagtaaaaactttatctatcgatgtattattgcggtgaaagtttgacctcaatcttttcaccccaataaaatagagtaaataaattactcaaacaatcttttgtcccaatagaacggagtaattaaattactcacaccaacttaacatggatgttaaccttagtggaagtaaacaaattactaatataaaccaacctcaacaaaaccgactgacggcacaataatttaccgatacatttatgccagtctacaagtgcaatatttgcctcatgagtccgatagtaattttttaactggagggtgggcttataagaagaaaatatgagtccaatagtaattttttaactggagtgtggactttagatggtgggagaccccacgagtaatttttttacggaaacatgtggacagtgattttttaactcgtggctgttggatatatacatgcgtctgggacatgggaatcaaagtaatttttttactcgctcctcctcgtggatatcggatgaggtgtggcatacatatccaaccgaaacagtaaaaagggagaaattcagggtgagtaattttttcacggacgttgggacgcacggggaggagcaatcgaacgaaaatcaggaagcggtggggcgcccaaaaaaaaaaaagcggacctcgctgctgttgtgagtcgcgctactgattcggtagcgcgtgtaacatgctaggtagcgtcaccgtaactactatatgacaccttaagggtgctacgtagcttcgtggcactcctcacaacaaccccatactatctgcacccaccattcttccctattagtaattattttactctcatctcacgctagcagcaccccttaaacacaatcccataccctttaacgtagtaattttttttactcaaatcctccaacctatatatgtagccattttatacggtaggatagattcccaaaattttatccaatgttaccgtttttctcggatctggagaggccgcggagggcgcatcggcaccgatcgggagaggcggcatgatccggcgtggagttggcaggcggcggcgggaccatggcagcgaccggttctatcgtagccaggtaacgaccaacccgagcatgcgggagatggcgacgtgctgcgcatctaacagcgaggggagatgggagacgggctcctctgacagccaacggaacggcgaccccagcgatggctggatccatccaccatgcgacggtggacgacggccccggcgacggtgggatctttcccctatccagagtggccggaggcagaagtggaggattgatacgtcagatctggcacgagcatcaccgctggaaacgaatccacatcggacggcgacctctacacctcaaaatcgccggtgagttcccgactgctacctcgtccacggcgctcctccaggccggcggctgagatccatgatgcgcctctctctctctgtttccttggcaggatccagtacgtctttggtcgttcctgtctccggtcgagattggcggcgactgctggtcgttggcgggcacacccatctctgcatgtgttggttggttgggcgaggaggatggtgatgtcgtccccctccatccctcccctataaaaatgttgcggcgctggaatctagtgtagcgcttcagtcttatggtgttgctagattgggttccgggtttcgacgcctgtgggaggctgcgatgatgaggaggtgcgtcgtggtggcccaacagaaattataaaaattgtagatacactcatagcatgacacatcaatgatagtaaaaatgtagtaaaagaaaagttagtacatatagccttttccctttcattttttgttaacacgtttcacacacggttaaacagtgtgttaaacaaaaaaaaaagccaagcctctctggtgagagttgacgagtttctgcctcatgcagctagggccgaagaccggggaatctgaggtcaaaacttttcatatagaagtttcttaaaaaaacaaataaacctattttttaacattgtaataattattacttaattaatcatgcgctaatggttcatttcgttttgggtgttgctaaaaatcccaccacgtactacttccctctcgagcatgaatgtattgccgtttgtatgtcatcgtcctatgggctgtcatcttatctgaattcctaatggcttgttttgaaacgcgaagttgtaaaagcatatgaatagaaaaaaaaaacaagaatatcgtataatagcatgtataaaacaaaggatttgagaaaatatagaaatttcgtaggaatggatgttgtgatgaaccatgaaaaaacacaggaaacgacagtacgtgcaaagttaattagagagttagccatgctcttatccctaaagaacagtataaacaaagggaaggtccgatgatgatatgatgcttaagccttgcattagtggcatcagagcgcgatttgccttgatcctacacgatgggaacaaaaacaaggtcatactggatgttttttcccactattttcctgcgaaattagcaccatagaaaagatttctccatttttcctatgttccgaatggatgaatatggtaaccatttcccataggaattggaatcttccgtttttccttcaaggatccttcagtccgaatgaaccctaagcaggcatgcatatatgtgatggggagtacctatgcatctttcgaaagaattttataatcatatcacacagatttttaatctttgtattaaaatccaatagatacaataaaagacaaaaagcaactaagaaacaccataatagacactaattaccatatcttcaagaaaaagaccaaatccaatatatatttcaaaacttacatgcgaagattcaaaaattacactgtaatttacaaaagttacaatgtaagtttcataaattacactgtaaatacactataaatttaagtgaaaaaatagagtgagagataagaaaaaaatctttcgagtgagatatagcaaaatcgattctgatgattcaatgtggccgtgacactactttctctgatctcttctccttttctttactataaagttattagtaaatagttaggaaagggtcatctaagaaatacaatactgatgaagaaagtttatatagaaattaatcgtactttaaaaaagtgtggcacaaataatttggtatccagccggggctatatataagaactgaaaaaaaggggccaattaattgtggggccaagagggaagccaggtaatgttgtgtctatttaagcttcgtctcagctggagtctcgcatccatggaaagaggccggccggtaccaagcgggaaaggtttaggagagcttaaggaagacacaagctagctatagctagtgtgcagtgcaactgaactgatctagctcgatcacagttgttatcagttatggtatatcttaattactatactcgtcttcttcctgctactcgatcatatatctactcgtttactagctataattactgttgaggtgtttatatatatatatatatatatatatatatatatatatatatatatatatatatatatatgtgtgtgtgtgtgtgtgtgtgaaaactattctacatccggcgtatagctattatataccccccctctctcctaagggcggctcaacccacctcccctctctttcaagggttcaaaacccacctcccacctcagttaaaagtcggtcaaagcattctcacattgatcaaatcccggtcaagccgcctactaactcctcccaccaaccacctcttctcagctctcgtctcgcagaacggtgcagtaacacgacgatcactatgtcttacgtgtagtaacgaagttcgaatatagttgaaatatagtcatgacggatctactcttgataagtactttttttagcatcatggtgcaaacggttttaaaaaaatatacatcacgtgagagatattgttctttaaacattgattttttggaatttgactctccacaggtagtaatactatagcattcttgttactattttctgttttacgttattacaatcgcatcacgacgttactgtaaaagtgcaatacagattataaattttatagtaacaatgcatcttactgtaattcttgggtagtgttactgtattttttatatagtgttactgcataaatatatggtaacgtgtgtctatcatgtagtaacactttcacttttgtgcagtaacaagtatatttagcatgtaaaacttttatatatgtgtgtattattattaattaatttggcatatatatgcaggatggacgtcgacagccccagcccggaccagctacagtgtggcgaaacatggacgaaaaccaatcgttccggcagcaaatcgatgcccttaacgaaaggataagaatcctggagaggtacattgaagaaaagaagagggaattcgataacctacaacagcaatacgacacgctccggtaagcgcatgcaggatgtcctcgtagatactaaaatgaaagactacgcacatacatgcatgtatgtgcgtagtctttcattttagtatctacatgtgtatatatatatctacgtacgtacgtacctgcatatactatacatacatgcgtgtgtatactccaacctagctagtatgagtgtgaagggagtatactatattatattatttgtgcgaataatgaaactctgcaggcatgctgagcatggcttttgctggagctagctagcatatgttaacatgttcctaaacggatcgaaatcctctaacttactttcatctgcacttatgctcaaagtcagatataaaataaatttgaggttccttttccgtacctaaacccgatcaatcacatgtcttttcctgccttggagctggaagcagaccgattggcaaattaaagtggtcagcgtaaacaaattttgtaaatttgtttgtggctcatggggccccggcaccattggtgaaattgtgttattacc

SEQ ID NO: 60489 - DNA, 10627 bp, Oryza sativa
atatatatatatatatatatatatatatatatatatatatatatatatatatatatatatatatatatatatatatatatatatatatatatatatatatatatataccacctatttgctactaccgggagtagttactctctccgcttactggatcgggttagtggaataacccataatccaataacgggtgggagtattcgattcattagacccggtaacagtcattggcattagtagcgatcgaattgagggcacatagagagggagtagctactcccggtagtagcatataattttcaatatatatatatatatcaataaatttaaatctttagtgctcacaatacgggccgggtgtttttttttttagaaattagctagtgaggttagggattaacagctaatgtctctctttgtgtgctttaatttgtgcttgtgttaaagggacacactagcttataggtacttctgcctatattgacttgtgcactcttgcgtgtctaccttacaatatcacaaaaaattattttatatatttacattaactttggcgtatacttatgaacacctcccgtagctggtgctactgtcgcacctacctttatgctgcaacatccatagccaaatccctgtgatatcacaactacctagctaagaaaatggatctttctcgcgatgggccaggctaaaccatcaagaaaatagggaaaagcatgattaaatatttgagtaaattttgtaaaactataaatattttgatcatactatcacaaaactacatatttaagtagtatattacagcactattgatttaactgttataaaatcagtccaaaatcaccattagaaaccaaacgcaaaagtaacatcataggagaaccaatcaagatgacgacaccgagacacaatatttgttaatgaggtttagcaaaagtctacatgcctatgacactgattacggatactcatttctgatccagcatattacaacgtttcaaagttacaacgaccctctgtcaatgccgccgacaaccgttcccttttgtcgatatgggtacaataggtccgaccttctatgagacgatgcatgcactggatgcctcgtataggacagcatacaactcacgcctcctggtgcctcccaagcgtagagatatcatcgcaataacaagtcactggaatgatctatgtccatgaactcatattgctgtcttatttgctaatcattttgccctgtccactcatccatcatccattttgtatctgacggacagttttggttgttaatttcagagaagaaaaaaaatgggggattgaattgttaccttggataagctcaaagagcacatataaattgtgtacaataggaggaggaaattaaatactaaactgcccttagcatactaactcacacatatatacttaacattattggtgaatctgtttgaatcataatttggcttgtagttagtttatttggccatgccaaattatttagaatagctatcgtatttgttgagttatagatttgggaaccaattaaatatctagacgaagcaggtatatacactatggtctatagagattaggtgcaggtgattgatgggcatgtagccaagatggagaagcagtgatgggggtcacatagtgcatggcctgatgggagtttattggttgttattagctgttcacatggagatatatatatatatatatatatatatatatatatatcaatctaacgttcttttctattttatttttatggctgagttatagcgaccctagaatttagttaatctttatcgttttgcgctaaaaaacggttgtgcttctctacaaaagcgagaaggttatcatttgctagtttactcagaaactagtcgttcgtcgtcatgtaagtacgatatttatcttctttactaatctgctcgtaaattagtcgtttgattccacgaaagtaaattaatcttgaaatcggttccgctagccggttttgatctatcgattttggcggctctgttgattacaccataaatcgttaggtgatctcatattggccatgaaaaagcgtcaatagaatcccagaagacattttcgtagaacgacatgagagcagtaggagaactactcccaagcagagaactactactatacgagtaagggacatcaccttccaattcttcaactgagctgagcaccatcagttctctgtacagtagtaggtgctgtagatattgaagtggaattacagtgttcaattatcgcatcaccatctgagacatgcataaacttttgttcggcaccaggaggcgtgagttgtatgctgtcctattacgaggacacacgaacacacgaacgagaagaaaaactctcaagatgagagagatcgcatttcttgcatattgttcggcacaggaggcatcaggacttaccatgctacatgctttggggagagtaagttacaaaattgccttaattatcaccatttggcttcagttccagtcaaaattttgctctgcgtgcttaaactaaatttagagatcgaacatgctatgaagattatcgaactaatggctactatgtgctaacatgcagtatctgcatagcgcggcgatgactgaaatatttgagcacattggtttatcagagaagcagacaatgtcctctcaaaagaagaatcatggacaattcacccgaggaacacaacgatcagggcctgattaagtcataaacccagtgctcaacaaaatctgcttggtaaagacccatcttccaaaatccatggattataagtgtcaggaataggagagtgctccacgacggttgcaacagtcgggatgccatatatcagtattcagggttgttgtataatactctaccattgccgtgttttactgttgagatcatcacaacgctatcttaagtcctatctggccctgtttgtcacaattttccttccttttgtactcgcacaaaaaaatgggagagggttccctttgtttttcagtccacatgccactaattgctggtgctaaattcaatataacccgcacatcgaccattattgcgcaaggaatcctgcatctgtgtgtgacatggtgatctcactttcatccatcttgtttttttctactcaagagcaattgagcaaagagcagagcaagatgaaaacatgagggcagaacagaagagcaaaacaaagcattttttctgtacttgttttttttttttacataataagtgatgattgagtccgcccaacaagaagcccatatttcaccgggcgatatgttttggcccatactttgccgtcagttttgtgggcccacttaaagtgatgggccgatttaactggcccacgcggtgaaggagcagcccatatatataataaaaaggaataagttcactttaggttcctcaaaattgacattgagtatcaactttgatcttaagacagtatggctcttggttttattcaatactacctttactcttttagaattaatatttgaaaatgtatttgtaaatattgtatgaaataacacaaattaaagttgtatagttgactgaaagtgacatattaattagctttagaaaatttagggccccaatttacattttgttccgggccccaaaatcctgaagacggccctgctgcctgcctactttaagttgtggagaacacaaaacaaatacatgagctgatcatcttcttaatcatatatccttcaaatcatatgcttgattgatgtgccacgttggacgaaaccggaagtcgtactgcattgagaccaaagttgacacgatattgggagttggggaatgaactgtgtctggtatttcggttcaaagatgaatttcatactcgacgttaaattgaaggacctaaagtgaataaaaaaaccaccaatgcctcccaggcctaccactggacaggctcaactccatgagctccccttgttcatagtctctaaatatcaagctacaaaaacattcatgttgctgctacttcatttcatttgcgctttaattgagcaatggagataacatagcatcatacaggaattagtcgttccaggacctgcagctttcttcaatgcgcagttggtttgattctgatgtttgctcatcaaaagcaggggggaaagggtgtagttacacagcattgtgatgaatcaatcaatgtattgaaatggatctcatccacataactgactgagcaatcaacaaattaaataattcactcagtgatacaactctacatcgtcatgtcatcatgtgatgaaacaatcaaatctttaaaggtgtagaagctacgaggggagcaggtgataaacaaattctataatgaaatgcaatattggagcaaagcatgagcagaggggaataggaaatccgttaccatgagttaatccattaatagttagtattacttagcagtttattttgtttcactctaatctcatctttatattgcacatttcttctatcaatacagcacaagcggccctacttgttctccagaaataactcatgaagtttagaagttgcatggcttatttcatggacctacaggtgatcctaaaccaaagaaatgtgtggcttctttcacagatcaccatcgtaacaggacagctcttgattcctcctaagcctaccaccgcaaaaaaacaagccactcggagtgatcgatctccatactacttttctctcatatcttcctcaacccgtgctccttgtcttgtcttttatatgtagagcaaataggacatgatcatatatgaaaattgagggggggggggttcagtactattagaataagtgtcgaatatactagtcctatttgattacagttagacttggagttgtaataggtgttagggggtagagttagagtcggactctgtaacccggcatttctcttaaatagagaaggggcaccacaatgtaaccatgcgactacaacgtagtacacgcagggagatgatggcggcgtggccatggactcatagcggctaggtgctatgttggttggggaggagcgcccataatcagagccccggggatgtaggcttcggctgaacctcgttaaaaaatatcgtgtgttcatgtgtcatcatctggcatgtcttgggtggtcaatgattgaaacgatcgagaaggttagttgtcgttccgctatatcgactaacttttataacaagtacagctgactacaatgctcaatatataaactagaaataggtacactatattagctaggcagtactgaaacaaacagaaagctgagaccaaattaacaaggtgatgattttgatcattgacacagcaatcaacaaatgagatggttggtattatttattctttagcaatccatcagaaaatcattacccgatcatacaactctacaacatctctaatccattccaatcacgatcaagcggaccagattaatcattcgcaagcagaggatgtctctttttcacaaaacaacaacgtgaaaggtgaaagcaggaagctagcacgaacaatttgaggagttcagcaagttataaatcaccagctaaataaactgcatcacatgtacatcattggaagcatctcaacggttactcgggaaaccggacggaggagaagactcgtgctgtgtccttgatgttgaggtgatcatgacctcttggtcttgcgacttggaataagcctacgagatgcagaaactggtcagttgggttgttgctaatatcaaatgaaagaattgcagtgaactactaaaatcagaaacttgactacttgagtgagaagcaaaatggtcagacaagcagcagaagattgcttaccatcggcgcatttgacggctcctgatgtcttccaggcctacctgggctgcctgaaccccatgaactcttcttgatcatcgatctctgataaaaaccaaataatcaatcaagaaaaacaagctgctgctacttcatttcgtctgctgttttatggagcagaggagatagaatgctatcatacaggaattaattgtctgattccatgcaatcactcaagacatgcagccgagatcaatgtgcagctatgcccctgctttgattctgatagttttctgaacaaatccaaagggaagggaaaaataaggaaaataaaaccaaaagtcctgaccatttgtactatatccccactaagttgagactttaatcttggagtacatgttacagaagtaagaaggactaacaagaacaaagagtacaacaaaaaaaaaagattgaaacaaattgaaattttgggccaaatattttcgtgccagtgggtctcggaaattttgaaacgaacttgcaaaccatggttggcagtataagtaagtctagccccttggatttaagatgatgatgggcatggatcacttctactagcagtagagacctctgtaaaatttaccaattttgtgtcaatactaagtaatatttggtctgatgtagctgctcaacaccctcattttttagtacttcaatgtagcacataaatgtatgtccacgtaactgagactggattatctaacattgtgatagatcaatatcccaatacatatatattggtagtgatcaatgagattatggcagaccaataatgaatcattgaattgtactcttcatctcctgctttcaatagtataatgaattttcaccaatgctacttcaccaaactaagaaaaataattttatggttcttaaggagggtactaggaggtacaacactttttcatataaaatttgatacctattagtatctcacgcattaggatgtaccaatttttctaattaaaaatcttggtccctctcagtacctcttaaggactataaaatttctcaattaagaaatgaagcactgaataaagacgtttggatgttctcaaaaaaattaaagatgtttggtttggctgtcatggagaaaggtgaacaatgcatgaaattggtaattgttttttgttcgtgaaattgataattatttggatgaacagaagcatatgctcctaaagtttactctgaccttgtaaggacattttggaaaaatataaacgaacagatggattgaattatgtcttttctgaagttcagctaagtgcatattccaactacagtccaattcatggcatttagacgttcgcgcgcgtgttgttcctcagatgagcttccagttaatgatgggcctagcaggcctgaatgatgcatcaacctaataattgtatcaaattttatagggacaatgaaagaaaatctggatgtaaaatgctgtgagagaaagatataaattgattcctggggcatctctctcatttggttcattgggtatactgaacgctcagccaaaaagcactgcaggtaagcgacctattcacaggacatctcccggtgcctcccatgccgaattaccatggttaaatccaaggtttattttctgccaagaaatttggcatcaatttatcagataatctcattaccacacatcacatctatacatagcactggtttgatcgatcgaaggctgcacgagcacagcagccaagctgcaagcttcaacagcactcgtgctactgatcacaaagcaccgatgtaactcgctggagggcgacgagaagatgatatcaagattaacaacgtcatactaccagttaaaaaaatattcccaccatcccaatttgatcatcgtctttataaagagatttactccagtctaacaaaaagtatctcaaggtatcaatacctcacggtaccaaatcattttcgatcgttagatctaacaatgtccagcttgatccaacgatcggaaacgatttgataccgtgagataccggtatctcgaggtactttttgctggactggagcaaatctcatttataaatgggcatcaagaccaaggcaagaaaacatccttccttaaattaaatcttatcgattaaggtgagcatgtaacgatgctatttactcctgtacagataaatgaattgacatgcagcgatgacattgactcctgctcatataaacaaccagacatgctacaatgctatttaattttgcacaaataaacgaataggcacagttagatgatcatgaatttgggaagacctcaaaaatcttacgagatgatcaatataggatggagggagtagagatgtgtcgggggtattagaggtatttctcatctctattgtactcaatatatgtcattggcgctaactcaatatatacacaacaaatctattccctatttctattattcactagagttaacatggtatcagtgcaccggattcatctgtccagttgacgtcgtcttcttccagctgtgcggcctgaagaagccagcaagatgcagcagcaggtttgctagcatcaaatgatcaagagctcctaccatcaaatgcagaattcagcaaattcgctgtaatagagcagctcctggtgtctcccaagcctactagctagctcccatatcgataaccaactagccattggaatgaacaatctccatctacatgtactcctttatatgtagagcaaacaggagtcaggacatggccgtatctgaaaattgattgttttgttcagtacagctgagctcaatgcataataaaccactagtattattactctgtattagctaggcagtactgatgcaaacagaaaaaaaaactgagaccaaattaacgaggtgacagttctaattggtgccaaatttattttgtgactactaatttatcagataaacaccaataatgtcaggaagtggtgttttgcgtaggaaacccctctttgaagtcgaaatatgtcttttaaaaaagtcgaaatatcctttaactcacctgagaattggaacgctatcatcgatccaagctgtctcattgattgagcatttgagctactggcttataaaccaagaaaaataaagccaaaaaatgaaaataaataattttctagtaagacttttatactgctaagactattcttagcagttcaaaacccaagctgaaaaaaaagggcaaaatcaactttaaaaagttctaaattcaaattttcactattgctccctggtgattcaaatcgtcgccaaccaaatctaaaaaagttaaaaaaaaaactgaagttttcgggcgaaatcgattagtgcaggggggtccgaaatttcagaagacgagatcagattataacaatgtttgccctctgcatttaacaagagatcaaaggatgatggattgatgggaagtctctgtgtctgttttttttctctaatatggacaagattgtgtaagatggcacaccgatccatacagataagcacgattatcagctgaatttcgaacaaaccatgagcaaaaagaactcaactgagatcccctgcagtgcagtactgcagacgacctgcatccaaaagaactgtatcacatgtacaccaccgaattaaatcagtggcatctccaggaaattcttcttgggtgtgactaagtattttataaagtatatttacaacatatttctcatctagagatagtcgaattctgtctggctgtacaatatttaccgtgtagtggattagcaaacaacaaagagagatgtgcaccacacattgccagcgacgacattacccccaatgactaacgtagccggccagctgccgccccaagctgcccatcctcaccaccaacaagccaccttcaaatagtgtaatttgcaactttaccctctcatatccttgattctttggataattattcccttccttgtactatttttaaatgagatggagaaaatagtagggcaaggattcagaagaggagtaaaaatctcagccaccacctatatgggtttgctacattcagttgttcggcagtgtatcaaggtgacatgtgaactcctgatacctcctaggccaacgaacatgaaaatttagtttctagttccatgaacaatgttcctctctctctctctctctctctctctctctctctctctctctctctctctctctctctagcatttgtgtccattgatctatatatcatatgatctaatgccatcatttaaatgcagaacttagctctggaaaaactagagacgtgtaattaatgctaattctttcttgagagtggactatctaacattgtgatagatcaatatctccatatatataaagtggtagtgatcgatgagattatgacagaccaatgaatcattgaattgttctccttcatctcctgctttcaatagtataatgaatgttcaccaatgccacttcaccaaactaagaaaattaattttatggttcttaagaaggctaccgggaggtaccacactttttactttaaaatttaatacctttttgtatctcacgtactaggatttatgagtacaaaatttttgcaccaaaaatctttccctctcggtaactcttaaagactataaagtttctcaattaagaaataaaagctctaaaccaagacatttggatcttctcaaaaaaaattaaagatgtttggtttggctgtcatggagaaaggcaaacaatgcatgaaattagtaattttctttttacgtgaaattgacaattatttggatgaacagaa

SEQ ID NO: 60490 - DNA, 25472 bp, Oryza sativa
cttgagaacaacaattgtaagttgctggacaagtttgtggcgggtggcattattgccaaattgccaccttcttggttggactttgccacttctctaaagcacaagagacaagagttcagtgtttctgatctcattggctctttgggtgttgaggagaaggcgagggcaaaggacaaggcaaaaaggttgagggaggttctagtgccaatatggtacagaagaagaaccctcatacatcccacaacaacaagaaagtcaagcctgatgtcaaacccaaggctgcaaccaactttaagaagaaaggcaagggaaaggcaaagggaagctgctttgtgtgtggcaagtctgggcattgggccaaggactgtcctgagcgcaaagacaagaagtcttccaacatggttattagcgagggcggaggaacatcggggtacggtaaaatattacctacagttctctctgtttttcactcacctgattggtgggtggatactggcgctaatattcatgtatgtgttggcatttctctattttcttcttatcaggtcgggagaggttcctccttgttgatgggaaacgggtcgcttgcggctgttcatggtgttggtacggtcgatctgaagtttacttcaggaaagaccgtgcagctgaagaatgtgcagcatgtcccttcaataaagaagaatcttgttagcggctctctattgtgtagagaaggttttagacttgtgtttgaatccaataaatgtgtcatatctaaatatgaaacttttgttgcaaaaggttatgacagcggaggcttgttccgcttttctttgaatgacatgtgtaataatcataatgttgtgaaccatattagcgagaatgatgagtctaatgtgtggcattcgcgactctgtcatgtgaatttcggttgtatgacgcgcttagctaacatgagtttaattccaaaattcactttggtcaaaggttctaagtgccatacttgtgttcaatcgaaacaacctcgcaagcctcacaaggcatctgaggtgaggaatttggcacctctagaacttgttcattccgatttgtgcgaatgaacagcgtgttgactaaagggggaaagaaatatttcatgacactgatagatgattgcactagattttgttatgtgtatctattgaaaacaaaggatgaagcattgcattactttaagacctataaagctgaggtagaaaccaacttgaaaggaaaatcaaacggttgaggtctgatagaggtggggagtatttttccaatgagtttgcatccttttgcgaagagtttggaattattcatgagaggacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagcataaggaaatgacaccattcgaggaatgggaaaggaagaaattaaatctctcatacctacgaatatggggctgtttggctaaggtaaatgtacctatagccaaaaagcgaaaacttagaccaaatactgttgattcacagtgtgggttatagattcttaatagtaaactctggagtacccgacatgcatgttggtacaattattgagtccagagatgctacattctttgagaatgaatttcccatgaaacatacacctagcacttctagtcaagaaactgtcatgccccatgagcactttgcaccgatagaacacaatgatcaaacgcctgaggaaaatcctgaggaggacaacattgtagatactcgtaagagtaagagacaaagggttgcaaaatcctttggagatgactacattgtatacctcgtggatgacaccccaagaaccatagaagaggcatattcatctcctgacgctgactactggaaggaagcagtacgcagtgagatggactcgattatgtctaatggtacttgggaagtcgttgagcgtccatatgggtgcaagcctgtaggatgcaaatgggttttcaagaaaaagcttaggcctgatggtacaattgaaaagtacaaggcaaggcttgtggccaagggttatacccaaaaggaaggcgaggattttttcgacacatactcaccagttgctcgcttgaccacgattcgagtactacttgctctggcggcctctcatggttttctcgtccatcagatggacgttaagacagctttcctaaacggagagctggaggaggagatctatatggatcaaccagacgggtatgtactagaaggtcaggagggaatggtgtgtaaactgttgaaatccttgtatggccttaagcaagcacctaagcaatggcatgagaagtttgacaccacgcttacatctgtaggctttgttgtgaacgaagctgacaaatgtgtgtactatcgctatggtgggggagaaggagtgatcttgtgcttatatgtcgatgacatattgatctttgggaccagcctcaatgtgattgaggaggtcaaggactatctgtccaagagttttgaaatgaaggatttgggagaggctgatgttattcttaagggaaaagtccattttacaccctctaacttttatgtttgtctaaaatgcacccctaaattacaaaaccggatataatacaccttccaactattaaaatcggacactttaaccccttaagctatttttatggtggttttggtacacttggatgccagctgtataaatgctccacgtcagcaattatttgggtgaaagtaagatgtttctcccttcgggtaccttgcgagcggcgacaactaacataacggcgccgtgaagtgcagcaatcaacagccacgcgcgcggcttgccggaggcagcggcggcggcacggagaaggagcagccgcgtgcagcgggcggttgccggcggaaacgacggcgctgggaaggagtagctccgcgcggggaggaggcagcagcaagcagttgggtcgcagagacttgtctaagctttcatcaaccacttctgcaccttcatgttgtgtttcagaatgttctatatacagtagcatggtgtgtgttgaaaaacagcagtagcaagcaagatgaacaatctatcttgactgaattgttggcgtcggtgccgagcttgacggcgagcccgcccctttggccaatgaagaagaggggatcggcaacaagctcgacagagaccgcacctttggccaagctcaggagaatacatgccggcggtgagcttgccctccttcgctgagctcgaggaagcatgcgagagctctggcctctgagtctccgacgagttctcctagaaaaatattggagggagaaggtataggaaaggagggggaaaggaagaaagagagggagaggaaggaagaagatgggccggtcccccaccccacccccgcgaccacggtgtagagccttgccgtcgaccatgcaatggcagccgccgcaactcgcaaggcaaaccccgccgaacatacaaacatctggcatccacgtgtaccaaaatcaccataaaaacaacttaaggggttaaagtgtccggttttaataattggagggtgtattatatccggttttgtaattcgagggtgtattctagacaaacacaaaagttagagggtgcaaaatggacttttccctattcttaacattaagctacaaagaggagatgagggtgggattacacttgtgcaatcccactatgtggacaaggttttgagtcgctttggatatagtgactgcaagccagctcctactccttatgatcccagcgtgctattaagaaaaaaccgaagaatagcaagggatcaactgagatactctcaaatcattggttcattgatgtacttggctagtgcaacgaggcctgacatctcatttgctgtaagcaagctgagccggtttgtctcaaatctgggagatgattattggcaggctctggaaagagtaatgcaagggcactatgagctatggaattcactataccgggtatccaaaagtactagaagggtatagtgactcaaactggatatctgatgctgatgagataaaagccacaagtggatatgtgttcacacttagaggtggcactgtttcctggaagtcttgcaagcagaccatcttaacgaggtcaacaatggaagcagaacttacaacactagatactgcgacagttgaggccgagtggcttcgtgaactcctgatggatttgccgatggttgaaaaaccagtgccagctatcctaatgaactgtgataatcaaacagtgattattaaagtgaacagttcaaaggacaacatgaagtcatctaggcatatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaataggcttgatacccacctaaagttgcacaatagtggaaacctgtccattgtgatcggagatcccgtgaatttggatggcgaaacaaactattgtgtaactgagagaagagacccttgaaaaaggctcattttcatgatgtatttctcttcttttctgcatggtaggatggctcatgctttaatgtgatccgagtggcttttccaagcagcgatgttgacctgtagaacatctcagaaggaacacacctatatgagttcgactgctagtcacagtctatgagatttgggcgatctctagatagtcatgaaaggcctggagtttgacttatatgctccaaacagaggggatgcgaacggcagctcagtaccagtcaagggtttgagtgaaacctgatcatacaagactgacaattcaagacatagtccattgttcagttgtggtctgatgtagctcatttcctaggtggaagttcaacttaacagtctccaccaaaacactggtatatcaaacaggcatagccttgagaacatttgttttgagctttgaaatttggtggggattgttagaataattgggctagacccgatttattctattaaatctcaaaggcccataataagtgttaagaataataataccacctcaggaattaagcgaggagtatctcaacttaaatagggagttattggagactccctgttgaccggttgagatgggaatcggaaagccacacgcgcaagtgcgccgggccggggcgagggctgggtgaggcgtggctggcgggcgtgcgtgccgtctggcggaactctcctgctatataaggaggccgctagtccgatcagaacgattcgcttgctttcctctccctggtgtttttcctcctccgcgcgcgcctgctgcttctattttcgcttcctcacttctgatcgcttgcgcgcacgagagatcggaaggagcagggcctctggaaccacaccttcgcctgagatctgcaccgggtaggcggatgatcaggtttttggggagtgcttcccgcacgactgctctgttcgttgttgtcttgtcgtccaccatgtctgcgcctagaaccgatggcgtgcctggagtcggagctgccgccggcgccggtgctgctgtctctagagatggcacgccgggagccagagccattgcgagcgtcaacaccaacggaggcaattctgcctcacaatccagcggagggccattctcggggtatgtccttctcctgctgttaactcattcgttcataccgctgttagtcgtgttagtcgcaagtcagttgcgtccttggtatgtgcatgatgcttatgataccttaagcatgctactggttatgctatatgttgtcactagatcaccccacattgttcatgccatgattattgtcttaatattttggattaaaatatgctgatatatgaccatatttccaacaaaagcaatatgtgcccggatagctacttctagtgttaaattttttctcaaaatataactacttttctactcacttcctcatctcaatcaaccatattcatctctcatttaatttcttcacttactacccatctcaaccaattacaaccatttccatttaattctatcctatctccaacttcaaaataaaatgcttatattataagacagagggagtaactcccattgtacgttaataggtggtgacaggatagacgactggtgttgccttacctctcactccaatttcagtaacatttcaatttttcctaaaaaaaactaaagaacttcaagctatctaaatttcagcaaaattacttaacaaacacagtgcaaagcagccttaaaaaaaggctcaagataacaatacccttatttcagtgtttagcaaattaactttggtcactattatatatattgcaaaagataataccgctatgttccaaaaagggtcctattatatactccctccatcgtcgatctacttttgatagtcatatttccaaatctgaaaaatttatttttgataggcatatttcaatccaacaacttatcatcttaatgactttcttagatttaatgcgtgaccctccatttttccacacaagattagctacatggacatcgagaaatgtaaatattaatgaatcacttgtttacgaggaatgactagctagtagcatgtttaaattaatgataaatagaatcacttatccttgatctgtgtgctaagatgaaatatgaccatcaaaagtagatgtagatggaaggagtattacagaagataataccgctatgttcaaaaagggtacagcctggtcaaagcccccacccccaactcaaaatgtaggtttgtctggttttagttcgacgcggtaaataatgtgacatatacatggcattaggctgacaaagccaccgccacgccccctgccccctagtatgaaattaataaagttagcgagcatgcgtgtgtgtatgtgtatatcgctagctagcacaaacacacaatgatgctttcctcctctcttaaccaccctttctcgttgatgctttcctcctctcctatccaccctttctcgtatgccgtcaatgtcggcatatcgatgccaaggaacttgagcatgtagctagtgatttgtggcaaaggtcacaaatttccaaccacgacccaagcaagggtcaaggcacgaaggcaccacccgcgtcattatcatccggcatttgtgaagtgcaccagcggtccctaaacttgtccgggtgtgtcatctgggtccctgaactctcaaaatacattttttgtcctcgaacttgtcttgggtgttatataggtccatccgatgacgtggcatgccacggaggcgcctacgtgtcggtggggaccccacatgtcattcatatgtataaaaataaaattaaaaaccatattttctcctctctacctccgcgtcgagctccgccgcctccactcaccggcatgcgcgcgccggcctacgtgcgtcggctccgccatgctggcctcctcgccgcaggcgatgccgcacccgcctcggcctgggcagcctcagatggccctccgcgtcgagctccgccacctccgccggttgcaccggcttccgtgcaccggcctccgcgccgcaagtgacgccgcactcgcctcgcccgaggccgtttcctcggcacctccgctgtcgacgtcgcgacctcgcgcagctcgccgccgccaccaccacgtgcgactccgccggtcacgcgcggctacgtcgcctccccacccaggcgcgacacggcgaacccctcatgcgaatgcatgtgggtccccaccgaggcgccggcgcggcaaggcggcgttgccgcgcgcggccagctgttaacgaccaaatttggtaatctgagtatcggggataaagattagatcgaagcggaatcgaagatgaagatcgtttcagaaacagagtaagaatcgactggagtccaaatcggctacgacaagggttggttgagttcaagtcagacttgataagccgatacaaccgattccgacaatatgactcagtgtgcatcatcgggttgagttaatgtgcttcatatgaattgccacatacggattgagtcctaagaaggcaattgtatctattaattaggatattttatgtaattttcttagagatatgtttgggcaaaagtctgccgcaaagacttatggtatcttagaatttgttagagataaaagtcatgtccgagatggacatatcttgtaattctcgggtataaatagacccgaaccccatgtaatcgaattaacacacgttcaatacaatcttggcgcattgccaccctttttgcttttgttttatttcgacgagttcttgctttcgggttgagctacatcggttttgatcttcaacaagaggtaaaacttgttatggcggcttgcgttctcgggattagtgcttccatctttatgatactctaattttgtttatgtaattcgtcgagttattatatatcttacataatctccggcaatatcgttatctaacctacaatcggctaacatttgccagtagagggcagccgattaggttaaatactgatgttggcttagattatataaggtatctaccactctatgacactttcaatggcttgattgtctagatattgtctttctttttatacttatagctgcatcagttaagtttgatcttatgagtcgtgagtagaatctcaatctctagcctacttcttggttgtcgattagggtagtatcggggtttcagccgatcttacctgatttaaccatcttttcctcatacgctttatttacatgttaaatctgccctttatgttaagatcttgtcacatttaaatatattaggcttttgtttggtatatttcacttgctttaatatattaacatagagtggtattggagtattagccgatacatgctagatctatctgatcggctatgctatgaacatatatggtctcttgttagcatatatttcgatctaagtgatttatactgtctcggcatggcgaccgatctatcccaatcacttgattcaagtatatatcgacataaggattgcatatcgttaatatctacagccgatcgagtagatttagttctttcttacctattaatgactgccgatcgatgcatttatgacatcggctcaaagataaatgatatgtcatcggcacctagccgatcggctatcgtttataggtttaaccgtggtttctttgtccttctttcttgttgattgcaggatcaaatcaactggcacgctcatacacccaaaggcaagttttggacctgtactggagttaagcagatctcctaggcctcgtgttttcacgtcaacaccagcagatcgcagcgaccgagcgagaccacagtggcggtcccggaggtggagtcgtccggggccttgacgcagatgcggaggtgatgcggcggaaggtggctcgcacgaggccgcgcgtctggcgtcatggcggagttcggcggaatggtgcgaggccacggcagtacctctcggaggcggagccgcggtagaccttgctcatgacgctggaaccggctccgagcaccacggctaaccgggggaaaccgcggcggcggagcgaagctaacgagaaggcggcctcgcgcgagcacgcaggcatggctgcaggttgcctcgctcctgcaccttgccacatgaatagggccatgcactgcatgcatctatccacacgtgctaccaagcagaggctgcggagtcgcgtggtgccagcggagggtgccggttgccgctcatggcggcgccgctaggagctcgcgcaggcggacataagcggactcggctgcggtcgacgcggaggtggctccgcacggcattggttggtggcggaggccagcgagtagttgcggcggtctggccaccgtgtcacgcggaggggttcgccgtgtcgcgcttgggcggggagccggggaggcgacgtagccgcgcgcggctggcggagtcgcacgtggcggcggcggcggcgagccacacgaggtcgcgacgtcgacagcggaggtgccgaggaaacggcctcgggcgaggtgagtgcggcgtcgcttgcggcgcggaggccagtgcacgaaagccggtgcaaccggcggaggcggtggagctcgacgtggagggccggttgaggctgcccgggccgaggcgggtgcggcatcgcccgcggcgaggaggccagcatgacggagccgacgcacgtaggccggcggccggcgcgcgcatgccagtgagcggaggcggtggagctcgacgcggagtagagaggagaaaatatggtttttaattttatttttatatatatgactgacatgtggggttcccaccgacacgtaggtgccactgtggaatgccacgtcatcggatggacctatattaacacccaagacaagtttagggacccaaaaatatatcttaagagttcaaggacctagatgacacacccggacaagtttagggaccgctggtgcacttcactctttctaataaaatgaaaagtctaatataaattgtacacgataaaacgtagcaacggggcaaactatcatgtcagcatgtgcatattattcatcacaaccaaaaactgacacgtcaggccaacatctattgactgggcaagtgtattttgttgtcagctagcagtattattattaactaatttttacgacgcaatgcataagtgttatgcaaaatcatatggacctgttcgtatagggtgcacagacggaagtacaccagaccagagtttcagttgcatatatacttccccatccaaaaaaaacagctcaaaactcaacttagaaagtgatatgacccctcctattacaacgattctagataacactttgtccagattcattgtaacattagagatcacattatcttctaggttgagcttttttttagacggaggaagtacactagaccataatctaagtacaccagaccagagtttcagttgcataccagaatctatggctaataaatgagcacctcgcaacctctcatcagccatcaaacaatcatccaagacaaccaaattcaaatcaaatgaaggcaggcgcaaacaaaccaaaagtttccctaaacggctaaaccagtaccatgaagtatgaactcacaaagtcacaatgaagggcatgtttctaatagtgtaaagttagtcagaaaaataggtcaacaaaacatatcaaattaagtcaaaatttacatgtaagtcattcaaaatatcaaacagttcaaagacgactattaaaatgtaagtgattgagcatgatcacaataatctgaaaaagtccatgaaaccagacaattatagttccaaagtacagcgcaatcatatgcggccacataactgtgcattacatcaaccttctgtcatagaaagtatcatgttaacttgcccgaaaaaactaaaagctttggccatactacatcaaacatgggtatccagttatttagcccccaccaacttgccgtttccaggagtcctctacaatgagctcatcaactccccagtcctcatagctatttcaaaacaaaaaaaaaaaaacagtcagcctacaaagaatgtcgagttgcctggttaaagtttctaattttgtcatctcaatatctcaccttccatcaggtaaataccgcctgattgtgaaagggatcttgcgtgctctcaattctttcatggcaatctgaaatttcatcatcagatgaagataatcaacatttttattttcaaatgaaacttgacccctccaaaaaaagaaaatcaaagggctccacaactttgttttatttttggttgtgcaatgttgtttgatggctactttgatgattttatacaaaagtatgagccatttaaatccatagtccaacccaataaaacaacatattttatcagagatacgataaagtatcagacataaaaaaattaatgaaaaaaaggcaatcaaaagaatacttcaaacaacgagtataaggttccagggaaagatagtaaaacagaggccacaatgatgttcataaaccatgttaatttgtaaaatctactatgtaccaactaccgcctagggcgttactagcaccctgttctttacaattgcatggggacacatttatacttcaaaaggcatatttactatcatggaaacacgtttacagccatgggatgcatttactactttgcaggaatgtgttcacagttgttggggacaggcagtactgcgcccagggtgtcaataagttacaacaataaacttataaccatttctcatattttcatacacaagacttatcagtcagcttaatttctattatccttacagattcaaactatagttggtaactattgcagagcaattagaaatacagaactggtgctgtagcttatgaacatgtaaaccaatgcaacgtacaccagaacgaaaagcaactgttaaatacctaagaacatgatgaaaccacatgataaatgccaaattgaactaacaaaatggcgtagttataagattcagcatgagaaagaaaggttgtagttcgcacaatatattagaatgaaaagaatatatcactatctaaatgactcaaactatattagaatgaaaagaatatatcactatctaaatgactcaaactatcatgaaactgctacaaaatacttcccacagtataattaggttttcaactacgttgacaggatcacatcaatgacaactctcagaatcatattgtaaagacaaactccatagttccatcaacatgtgcacatcatcagccagttaaacatcgccactcccatcaaaacaataaaagtactagtatgttatatacatagcatgagaaggcagtcacataaatattaactattttttctagctctgcccctcactctggtcttaccttgtacgtgctacatagaaatgaagagctcaaggaaatatagaaggtgacattttgtgcagacttgtattaattgaagaagtctatgtctagaaaactgaaatcggaactttacctcaagtggatcagtctccccttcaagctcgaccataacaggagcattcatgctgcataacaatagataagctcgaattttacttaattgatatgattaattaacttaattgatgatatatgaattacattttataaaagcataccttatctgcaaggcacgtgtaccaagaatgcgtgcacgctcgtattttgtcatatactttgatgttttccgtggacgagccgtcttttcctgctccttgtcatcttcagccccaaccacatcatccacagcatcctcattgttattctcaggctcttcctcagctccttcctgttcagaaaaggtaaataagccacatagctcttcctgataaagtaaagtccagaaataaataacaaagcagcagctctgtacctcaatctcaggttctgggggctcatcctcgtacctgtaaaaaaaagtacaagcatctttagttcataaatttatataatactaaaatgattctgcagccatatataataggtgacactaagcataaccaaaaaaaaaagaacataacaatcagcaaagataggtatttttcaagcaacatatctacaatgtctcatcaagctagacatgaacttaaaactatactccctctgttctatattgatcatcatatacgttgaaaaagctaactctaaaaagcaaccagcaccttgaaaaagttccattattttgatccatcaattaaaatagttgggaccaattcttaattgatacaaaagatgtggattatacttaagccaagaaacatcaaacatcaacatcttatcccaacaaagacaaatatcataatgtgcattctcattccagaaggatgctgggtgagctaaacacaagagtccatctaatggctaggaatgctcaaaccccacataattcatggacacctggtcacctagaaatcagcatagtttcttacattccgtattaaacctgattgaccataaacctggcaacagctgcaccatttagccatcccattaaagactaagaaaaaacccaccttttaacaagcacataagcaatcaagcatgggatttactgaagaattaaagaagtcacccgacgatcagcagccaaacatagaatgaggcatgatgatttgagaaagagaagaaaaaaaaacgatgtgtcaatcaaagctcaaagacccatccatctcccaaaaaaacatcataccccctcgtaatccatgccaatgagagagaatagaccaaatactggcctaaagaaaaactccgtactgccaccaaaccagcagctagaggcagagccctcccttgagaaaggagagctccccccacgaatcccccatcaatcaacgtgcccgtaacccacccacgaagatatcggactccctcctaacccccctctccgcccgcgcccccgaacgtaccagtaaaccctaagctaggtgcgaaactgtaacggcggaagcgagcgagggagggtgggggagaggcgaaccccatgtccatgtcgttgtagtcgtcctccgccatggcgctcgctcctcctccgccgccgccgcctgggcgctcgcttcgctagggcttccgaaggcggcgatgaggggagggtagtggaagaggaggaaggaagctggagaaggcggcgtttggtcgggtcgggaaggtgtgtatgtgtagcaaaatccaagggctgtgctgtgcatttgggccgctcgacctgatctctagcggtctggccctctgtcgccgtaggattaagttcactttgactccctttactagttactctgaatccgattcttacccttaaaccgtaatacggatatctcgaccctccaactattaaaacccggtgtaattttacaccctcgatggttttggagggtggtttcgctgatgtgaagtctacatggcaaggttgacgttgatgtggtgcttaggtagcattaaaaataaaaacatatacgtgggacccatttgtcattaacacaaattttttcgacgcccacgtgtcacacactctctctctctccttcttcctcctccccctcccccttctctctctttcaatccccttcggccgtcggagcgagaggatgggcgctggaatagcggcaatgacggtgggcgggcgagagccggagtgacggggcggctctccttggatgttaggatctctaggaaatcgcacggcaaaggagggagaggagcatcggccccatccatcacgaagcacgacagctcgagctcgcagaacccatctaggcaggaggtggaggtagaggtgaaggcgaagagctgccgatcccctagccccatctccaacagtggcgacacaccattccccgttccccgttcccccagcggcacgccaattcaccatcaccctctccgcactgacggcacaccattcccctctctggcggcaaaggaggggccaccggcagcgtcgtcagcaaagccggcgatggagtaaaggcctccctctggcccctccgtcgagcagcgcccagctgccgcccactactgccctctccttcaccttcgccacagcactgcttgccaacgagcggcgccctactgctgctcgctgttgccctctcctccacctcccgccctcaccacccaactgcacaaggaagagagaatggagaagataaggaaggtgagggaggagaggatgacaagtgggcctacattttttttaatgacaaatggatcccacatatatgtttttaatagtagagatcagctgttaagattgttgtgaatttttttggaaatggtggtgaatatacatatgcgatgggaaaaaatcgatatgtcagaattaaaattagacatggaagctaaggtctaattcttttcaattaattgcaatttaaaaagaattcaactaatcacatgtacgtacaaccgaagccgttggctcatcatactcacatgagccttcaaagttcgtcaccacgcacgcgcacagtcgccgctctggaagcggaaggtcgcgcaccatggcggccacggggtggtttctagcggcagcagtagccgccatggccgtcgtcgcctgcttcgctgcgacgtcgtcatcgtcgtcgtcgcagctgcactgcggcacggtgacgtcgctgctgtcgggctgcgcggcgttcgtccgcgggcacggcggcggcgcccagctgccgtcgccgggcacgccgtgctgcgacggggtggccgggctgtacgccgtggccgccgactccgcggacaattggcgcgccgtgtgccgctgcatggcgaggctggtacggcggcacagctccaacgcgtccgccatcgcgctgctgcccggcgtctgcggcgtcgtctcgccctggacgttcgccgcggggaacaccaatagtaatcgtccctactgcagaaggtatggaagaaatcaggttgattttaaatggattcgttcaatttggttgcattgagaataattgagatttgagagaagtatattttacaacaatgttagttttggtttttgaagctgattaatatcggttttcattccctttttgcagcctcccctgacaggcatgagaatttggttaagaattgtgagcaaacacgcgccgatcgatcatgtagagaataaatttagttaggttcggagttatcatatcttgttgttgggcatagttacgtttacgtgtgatttcttttctctcgaatcaataacatattcatgctcaatgtaaatatgcaattcttggatttgatcggttaaaagagcatagttagcagacagagcaaaacgtatagattgccatgccatataggcatcatggtttcaaatgtcgatattgaaaaaaaaaatattggtactaataaacaggaatattagatatatcggagttatattgatgatttggaaaaacaataggataaaaattataaaaagggctcaaactgtttagaaaattacacagattgtatctacaaaattttgatataaataattatattgggatttgctaactggctgcctgctgatttatttttagttgtcagccgaatttttgtccatccgattctgcccaagattcgtgcgtccaatcttcaccacggcccacttgagaaaatctggcccggcccatctcttcgcgcaaaatcacacatccggtctcggcccatctctctgtgggctgttctagcactctcgtcccatctctctgtgggccacaccagtgaagtatcaatttttgtttcccatctatctactagaaacgatttgggcaaaattatgatgtgtgcttttgcttgtttgtggctgaaattacattctgaaaattttatggacatgcaatcctattagaaccggttttgtcttgttttgttgtatacttgtagggtttgttcagtattgtagctctagtttcctttgtcagatctggtcacttgtgtgggtagatgtccatgctgggttacccagtgctgcaaattttgtacagatttcaatttagggtgtgtttagttgacgttaaaattaaaattttggttgaaattggaacgatgtgacggaaaagtttgaagtttgtgtgtgtagaaaatttttgatgtgatgaaaaagttgaaagtttgaagaaaaagtttagaaataaactcggccttagagttttcctcacaagactctgtactagtgttgtggtagtagtactccctccgtttcgaaatgtttgacgccgttgactttttaaaacatgtttgaccgttcgtcttattcaaaaaatttaagtaattattaattcttttcctatcatttgattcattgttaaatatatttttatgtaggcatataattttacatatttcacaaaagtttttgaataaaacgaacggtcaaatatgtgctaaaaagtcaacgatataaaacatttcgaaacggagggagtacctcgaagaggcgagcccggaaaccactcgtttatttttacctgcatcaaccaacagcatacccccaacgaaactgaaggcgatgctattgctacactgcaagttttttatttgtttttgtcactattttaaaattttcaaagaagtggttgtcattttgtatttttttattttgtttttgtaattttttgaatttttcaacatatagagagagcaaacctgatccttttccttccctcctggctcctgcctattgcacttgaccacttgcgatatgaccgaagtgtctatacttttggtcgttgatttctatttttgtttcttttatgtaagatgtaataaaagaattatcggtataaaggaaaagagtgagacaaatcgtgcaaattgactcctggatgatagaatcaagccgacatagttttggatcttatttaattagtacttgtttatttgggaatattcgggaagtaattatatgggtgtgatgcaagaaagagagatctcgcctcatcgcatcagttcattgttaattaccacatgaggggaaattaaagggagattatggttagtctcacttccttttttttttctcgaatgcacccattgttgatcagacttgagaaatcgaagatttttatcagggtagggcgtgccaaattacaccgacaggaaaaactgctcagcatctttcgatttctcaagtctgatcaacaattacgccgcaaattgcgtttggttttcagttactgtattaattattataattactctgtaaaacggagcttgtgtgcgtgctagctcgtgaaataatcgtcgttgcgtgttgttcccaaccccctgccacgtgatgatacggttgcacctaacggtcagatagatcggttacgtagcaatcgtgttcgctatctctttttattagcatgatttttaaactattaaatagtatattttatatagaacttttgtaatgtagaagtatcaaataatttctttaaatttataataattaaaactcaattaatcatatgccattggctttctagctcgtcacgtgtttccttacttcgtcatgttcatcatttacgaacaccataaatcgtacaattttcagcggtctttttgagcacaaaaagtaaattattcttatatgctctttgttctgaatccactgtgcccacagaaatgaaacaatgttaattaattgaatttttacctgaggcacgcgtgaaatatgtgtcctattgtatttgacaatgaatcaattttcgggaatggaactattcaaatattaaaaaacttgtaagatttcctcaatttttttaaaaaaattctaagaggcttttgtacttacaaattacaatctttagtggttcttttatataaatgaaagtccacatgcacataaggctgtttcttttttttttcatcaactcaactcaacttccttgtttttcatgcccacactttataaactactaaacgatacatttttttcgaaaaatttctaaaggtcctattgattttttttaaatagctattacttaattaatcatacgctaataaatcactctattttatatgcgtgaggactagtacccatccttttagccgaacacaatttatgttcaatggcaatcaagttccttttatatattgtccgtatctatatagtaatataacgtatatagttcatcccactaataatatttctctgcatccacaattaaccacgtcgtcaaatttgcactgacactatatattgctttcctctccaacacagctccaccaaggccatttcaattgcatagccatgcattcgacacgctcacacttgctgttgccccatcaattgcactagaaaaatgaaaacgatctctggcttcttcaattactccgtacctccgcggcactagctactggttcaatttaggccgtgtttagatcctattttaaaatttttcaccctaccacatcaaacatttaaatgcctaattaagtattaaatatagacaaaaaataactaattacacagattgcgattaatttgcgagacgaatcttttaagcctaattgctccatgatttatcaatgtggtgctgcagtaaacatttgctaataacggattaattaggcttaataaatttatctcatggtttactgacgaattctgtaattagttttttattagtacccgaacactccatgcgacatactatataatacccgatatgacacgccaaaactttacaccctggatctaatcatctaaacacccccttaatatatgttggacgaaactgttgaggagccaggaagtctaccactccattactggttgcttgtatgctctaccggtaaaacaaatctgcatattcattcagcgagcaaagcatgttattttcaccttcatcattgtcatacctaatcaccaccggtaattcaacaaagtagacgcacaaggtgttaggtgttagcgtggcaattcaacaagttcatactctttccatattcattttcttttcccgtagcaacaagtggggcatctaattaattcaatcttctagtctgtttgcacatgaacaccctgttgtgacaaatcaacctaccggatctatccgtacacctacttctgttcagttgtgcccttttgacagttgtcacattttcactgtcttattgatgatgcttgctagcttgtcgcctaaatttgcaggaggttgtcttaaagaaaaaaaacctttcaaatgcagtcgagtgatgttgaatacggattcatatgtatagtttttccccataataggaactgaatacgataagtaacaaaaataataggaatcatcaattgaaacgaatgtgtttgaactgagtatatgtagaaatcgctccaaacaaaatgatgctcaacatcatattgatactggtttaggtgaagtagaccgatatttatgtccagataaaaggtaaatgcgttaagaaacatatacatttcaatagaaaacaaatagtgatccaagagtagtgtatgattttttttagttgtttttgccatttatggaggttttcccatctttcaaaagtggatgtcttgtgaaatatcaaattggagttgcattattatatggagtactgtttgtgcatacttaaaactacttacatattttttactaataaattcctcaaccgtttgatttaattaattgaaagttataggaggaaaaagattcaaccacagtttgcaatatcaacgtttccaatagactgctttctaacaaatatactttgtccggttataaatatttgacgatatgatttgatcgaacttttgaaactttaaccatcaataattcctagaacgcttagttcaaaaagaaggaaaataatatgcacagatttgcccagaaaagtacgatttttttaacttttgtaaaatagaatttacgatcaaagttgtgggccgggggatatgagaacggctgggtccccatctcccttgggtcactggggcactatggaacacatctagacatacaatatctatatcttcaaggcactaagatcagtacatgtgatgagaacacccctggctccagggggtgccccaagtaggtgaggtgccccggtaccaaggacgaccaggcacaatggccacccagaggtgaagcccaacaatcttcagatcccgagcactcttcatatcccgggagggggcctgagcttgtcccatgccccaggaaccacatgaggagcgcaactactttaaggagaagctgacaggactaggggtagctttaaccactcccttgcattaatgacgatatgatgtacgccttgtacgcatcccgttgacaacgtggggaacataagggtgtctataccgtatgtcacgaaggagggcccacaaaatagtaggggcaaaggtgcttttttcacttcggcgctcctcttccgttagtcaacaagagagaacattcccctcagtcggattgagggacatcaacaaagaccaaccatgacaaatttaatggagtagagcctactcccgcacatatatatcgacattgtagacacccctagggtataaaaagagaatcgatgccaacggaaagagggttcacattccagcaagctagcatacgcccttatattttcagtttcatgcattgtaactctattccaccatccatccataatctaagcacaggagtagtgtattacacacccgtgtgaccggaacctgtataatccatggggtttatcccttgcacgtgatttggaccatggcttgaaaccatctcctggctgaatctcttaagggggagtgctcacttccccgttagggaagttccatactctgacaaaatcttcaaaagtttaaccaaatctttgtcctaaacatttttaagggccttatatatatgactaaagggagtaaaaaacattcaccccaacgaagttttctcatgtgtttaattctctctttttttaaaaaaaaagtcaaaccaacatttgctaaaataattgtaatttggatcaccatggattttacaaatttataatctattaccacaaatttcaaatttagcaacatgacaactcaaacttaacaattttggacctacacactccgtagaaaaaaaagaaaaaaaatccttaatgtgaatctaaaaaatgattgatttgtagttagaggttgattcttttttatagggttaattggatacatgccactgcaaatgtgacaaatcaaaaaaaatgccactactatttacgttattagctggatggcaccgaaaatttttaaaattggaactatgcctctacgtgactctttctatcctccctgtcctctctcacgccaccatcctcaccgtcacgctgccctcatcctaccaccaccgccgcggccgacctcgcgctgcctccttcgttgacaacgacggcaggggcaacgacgcgccgaccagcggagcacggcggtggcagcatgcgggatggcttggcggcggctccggactccgacgagtcggcggcggtttgattccctccaagacccggcgtgcatgcggatggttctcgttagtgaggtcacaaggatggttcatgcacaaggaatcgacacgaagctcaccgaagcaataggaattgaagattgtggccatcggtcggagtcgaggaagaagacgccgatctccctccttggtgcaccgatccatatggttcttggagcatcttgaagaggacatcggggctaggctactggcgaaggagctcggcttggttaggttcacattggccggaatggcaacgacgtcatggaggcggtgttcggtgcgcgctcccgagccgcggtggcgtggtcgcgttcgcgatcatccatagcatgaaaatgggcgaggttagcggggatggaaccggtgtggtgaggagatgatggaacaaggaaaagatgaaggcatccacggagacattggagaatggagacattggagcgctctctccctcgacttgctcggttcgggaatggagtaggatataggacgacacgactgggaggagatgaaggcaagcctccccgtgcgtgcgctgctggggccaagctcgtggagccccatctcgctcctcatgctcctctcccggcggcgacgctatgcggcgtgagagaggacggggaggacagaaagagtaacggggaggacggaaagagcgacgaagtgatatggtttcaattttaaaaattttcagtggcatccagctgataacacgaatagtagtggtatttttttttaatttgccatatttgcaatgacatggatccaattaaccctttttaggggagtacacacaacgactcattttgctatcttcataataaattgagttgtgaacatcatttaaatactataaataattgcacccattgctcctcctctcgtgaagttcctctctaatataaataattgttgccattgattattttccttctcaaagttacagccacgtttagaacccgtgattccttttcgaatatttacgtgtacataacaaattcctgtaaaatttccacaaatatcttactatcaaatctggtgtgacctgtcatctgaaaaaagaaaaaactgccgtgacctgaaatgacaagtggacaaaagacgtgataaataaaccctgcctaaatgggaattaaacaacagccagccagccaagccagccagcgctggatgacgactgtccacaacaccacgagagcacgagcaaaaaaaacccaactaattttcttttcttctcctcaagaaattgatcagaaagagagacaagagaagagctagggtttcatctcatctccagccatggcgtccgccgcctccccgccgcgctccggcgacgcctccccgtcctcccctctcctcccttccccgacgtcccccgaccgccgcagcggcggcggcggaggcggaggacgcctgcttccggggctgcgcggcgcggcgcggttcctgggccgcacggggagccgccgcctgatgcgggagccgtcggtggcggtgcgggagacggcggcggagcacctcgaggagcgccagaccgactgggcctactccaagcccgtcgtcgtgctcgacgtgctctggaacctcgccttcgtcgccgtcgccgccgccgtcctcgccgcctcgctcccggagtccccctcggtgccgctccgcgtctggctcgccgggtacgtgctccagtgcctcttccacgtcctctgcgtcaccgtcgagtacaggcggcgccgggaggcgcgcggcggcggctttggggcggaccagggggctgcggctgatggggatttcaagctcaggtgagggtttgctcggatcaacccccaaaacacttcgtaatcctagtagatatgtgctattaaaagtatctcgaacttatgcattccactctggaatcaagtcgatgtaacagttttttttttcccgttgattcatcattgctataattatcgtattcccatgtcaattatgaattctgttggttttatattttttattcatttctgtctttgaagtgctggtgcagcctgtagtattagttttcgatttaccttcaattcaactaatagtttggcaaatgctactgtgtctacttatatggtaaattctttcttggatttttaacaacaaatttatttgatgtggcaattcgtctttcgtaatgccttcaactcatcatccttgagtacattacattgctcaaacgaagattattctattagtttttcacttttttagaactattcttatgtgatctttcagtgtgctgttgatactattgcatttgcaattttaaagtgggcattgttaggcaatgaatttgtggcatatgttagtataggataactgcaaattgaatgggcaagaatgaattccattt

SEQ ID NO: 60491 - DNA, 15227 bp, Oryza sativa
  unsure (1)..(15227): unsure at all n locations
ttactggtacgcacttagtagctgtggcatgtgaatgatagtatgtattatcattagtggctgtagtctaagatgtttatcttattgcccattattttgcaggctctccattgtgtttctggcatttgatgttttctttgtagtcttctgtgttgccttggcctgtgtgattggcattgctgtctgttgctgcctgccttgcattattgctatcttatatgctgtaactgatcaggtatgccagttcttgtttaggacagatatattcttcaaatggttgtgatgagatttagatgatcatatgatcctgtctctgctttgtgttctagatacattttcttcaaaaacaattttccaaatgcaattgcttatgttctatttgtgcaatttaagcattattactatattacacatacatcactctacttttgtctacagttcattttatatctcttaaagacatccatgtcttgaaagaaagaataacctcttctgctgtggtataaatactttttagtagaagtattacttcagagtggttttgcatgcaatgacctgctatcaacattgttttgaactcttttaaaggtagttttgtttcttttctcactatggcagttagttatcactcattatttctgaatgttccatgctaaatatgattttcaaaagtctggaactgttcttgttaatcagttatctccccttgacataagcctaataaaacagtatgtggactgatacatccagaaataatcatctcacattcattgcactgagactatttgtttgtttttaagcaggaaggagcatctgaagaggacatcaacaacctgtccaaattcaaatttcggacaatgggtgatgcagacaagctggttgctggaattgcagcacctgtgggtggagtaatgactgagtgtggcaccaatcctcctgttgaacacttcctttctgctgaggatgctgtaagttttcagtttcccccctgaaattctgttagcacaactgtattgttattctcactacatagcttgtcatggatactttggaatgtcatggcacttgcctttgtttattggacgtcaaggatctaatttgtaaccaccgaatacttctgtaccaagagtgctgcttgaaatttgttcatttaatcttcacaaaatcatagaagcatttcttagcagctaggcatgttaatgcgaaaaaattgtatcgattgatgcctatctattgttcataaactcactaaccatatttaatactccctccgtcccaaaatataacaatcgagtactggtttggacaacaactagtactatgaatatggtgaggccagatgtcctggattcatagtactaggttgtgtctaatacagtactagattgctaaatccctcgtgcactttatacaaactgcagaagataaacatggttgtttcaggtataaatttgtttagagcttgagattttgttttaccccaacataacagtctgtgactaaccccagccagtgtcattagtctaacctagcaggctaactctagtttagtttagtagcttagttatcccagttggaattatgtgaagtaggtgacttaacagatggtgaagactctgtgacttggtcaagtattaacatgttagattgtgatattttttaagcccatttaggtatgcctgaattaaggaagctgaacaggcttgtggaattgaagccatatgtatattactcttgtaaaaaaaactgtggacaaatcacacggtccccttgctgctgttgaaatctataatagtataatatgtaactaacaattaatttcttggatcttaatttgataccataccaaactgtacaagtgctatacggcacttcaagtactttaccaaaacatagcttggaactgctctggggaaaaaaacttggaatggagcaagttcctgttaagatatctgaaattgtatatgcatcctgtagtactttccaattccagcttttagtcaaattgttacctcatttagtttgcccttcacctgaggaaaaaaaactagtttaagctggccctccatactgatgctggatatcgcaaaattgacttgaaagatggagcaatgccaatattttcatggatggccaaagttattgaaacaaatacaactagtgccattttaagaggtattgtatcttatcgatcattaacccactcttgtacctgtcaaatgcaggagtgctgcatctgcttgtgtccctatgaagacggtgcggaacttcgagaactcccctgcaatcatcatttccactgtacctgcatagacaagtggcttcacataaatgcaacatgtcccctgtgcaagttcaacatcatcaagagcaaccttggtccagaagacgtctaggtttcacaggacgagcaatctgttgaaggattgatatgctccagttgcgttctttagctatgggttccttcaggtgtaagtatggggtataggtgatgcacagctggttgatcagtattcgctcctgaatgaaatgttttagcagtttcttgatgccggtagagatgtacattccttctctctaagtcaattgtgtcgcagattctcattttagccttgtaggaagtatttgaattgaggattctcatgtacgttgtgttagcaagtgttgaataaatacatggaaatgcagaggtttgtaagaagaaaaatggttgtggaattggagctttgttaacagcacatgctgtctccttaatatgcagtagacgtacattctacccctttggtgcttgatacccttgtctgcaatcctgttgaagcaaattttgcactttgttcgatgatgtttaagcgacagctggaaattagaaaggcggagtatgacggtaagcaacgcagccttaatctttcaccgtctcaaatcagagcaattcgatatttccagcaagctgtgtaattactgcttagggggtacaaactgcgaatttggctgataattacagcgtttaacttattccgtcaatgcaatggtacccaatatactctacatgttaaacgtgtaaattgcacaccacaaatacagttattgctaccaatccatgcaattgatattcacaggctcgccacgggcatgatgtagaaggtggctcgagacgtgtagcagagcttattggtgcccttgagcctaaactcaaccgtagtaaccaccacggatctgcccttcctgagtatctgcgcttcgacttccacttcagactgtatcaacagaaagagaacatgggcatcaggaaatacacacttgagatctaaaagccccccaacaagatgtacctaacacacacttgagctctaccaggaaatactactccctcgtatcctttttacttatctcaaggcatcgactgagtatctaacacacatgttgtaccattgtttttctaatcatatatctatgaaaaatattaaaaagataattacatgaatgactagtctaataatctcattttcgcatgtcaaaatcttaatattcagttcatatattgactttaagattttgaggtttaattgcacgcacgtatactggtatctaaaaaagagcagtctgttttttatgttgtgccttgaattgtttgtgctttattgcatgatatatgatggtgcgagttttacaatgctatcttttgctgtgaatggctaatacacattaaaggaaacacgatgcattcaaacccagcaggtctgaattctgaaattatgcaacatcagcatccattggctggtaggttatatcagggttcaaaattccggaacaaaatttctgaaatttcggttccgtcggatcctcaccttcccaatatgatattatttcaatcgaaatttttaattttttatgtgaatttggcaatattttgttcaaaattttggaccgaaatttccaaaatttcggtatatcggcaccctccgatacaaatgccgaaaatgaaagattgaaccctgggttatgtccatatcaagccagtgtgtgatgttcatttcatcgtctgttttggtgacaaatgttgcaggcaagtactttattactatatctgttgaaaaatgtgcttgcttgtgtgtagatgatttagttcatactagaaacaaagttccctcccctgttctagagctggatcatttaccctcttgcagtgttgaaatatatttaccactagtatcttgtacaacatcttcatcctagaacatcttcatcctagaagtgaggctaaaactgtgtccagcttccattccgaaaaatagcgcctatttattgggagattattcagcatcaaatttgcccccaattccccatgtaggaagcatccaataagtgcaagaaatttgtcttgaggatgcaatttttttctgaaaaaataaataaataaacaggttcgccagttgggtgagggaagtgtgtgctcacattgaggcgggcggcggagagataggcggcgctgagctcgccgaggaacatctccttgtcgcccgccgcggcgcgcgcgcacgccatcccgacgacctccgccacggccgccaccatgccgccgtggagcgtgttgtacgcgttctgcaagtcgcggaatcgagcagcgacgacgtcatcacgacacgctagggcaggaataggataggattcagcggaggaggagatgtggaggggtggggggcgcgctcacgacggcggcgggggagacggtgagcgtgcaggagacgcgcggcgaggccggggtggcggggacgacggagacggcggcggagaggacgccgcggacgagcgcggagtaggcggcggggagctccgcggcggccgggagggtcccgtccacgccgaggccgcggaggaagcgccgcgtccactgacgagactccgcgagcgacggcgaccggcgctccatcggcggcgccatctcctgatctcctcctttccctcgcgtttttgcttggttggtttgcattaactgcatgggtaggtgacagtttgaggaatcggagcagagaattgggccggcccaacgcaacggccatcgccgccttcgtggctttgcgatggtgggtaaaacgggacagcattagtaaatagtactccacccattctaaaatataaggcataatcacctctaacccaaagactaagaaaataattattatcatcttgtagtttagatcaccctaataaatataatgcatgcatccaatagaattagagaacatgacagtggatgttttaaaaaagtaataatttaatggagaagagatcatagttaatggtctatatgcatgtatgccttatattatggaacattaaaaaaagtggttgtgtcttatattatggaatggagggagtaatattacaagaaaattaatggattgccacttctaacggtgcgcttcgataaaataatactctaaaatatcagtttatgttacctattttatggaggagactcgcgcccaatgggaggggattaaaatcgggcgctgatgtcagcgtccgatttacgtgcaaaattattttaaattgatttttctcttaaattacttatctaaataatgattcgattgtaccattaaattcgttgcaattaaatcaaacaagactacacatagatatattcggacgaaaaaaaatttagcttattatttaattatttttaaatattgcacgatgttccaccaagtatatcggaattgtttcactaagtagatcgaaaatgtttcactcgtttaaattgggtgttgtttcaccttatataaaaacaatgtttcagcaaatagcgaaataatgtttcagttcaccgcaacattagatctatacatagtgaaacattgtgagtatactaggtgaaacatttttggtggaacaaaaaataaaacgaattcgagggtttccaaaatatgtgggtgattttttgcaatagagtatttcagttcactgcaacattagatctatacatagtgaaacattgtgagtgcactagatgaaacattgttagtggaacaaaaaataaaccaaattctcttaatagaaggtttccaaaatatgtgggtgatttgttgcaatggagtatttcagttcactgcaacattagatctatatatagtgaaacattgtgagtgcactagataaaatatttttggtggaacaaaaaataaaccaaattcctttaacagagggtttccaaaatatgtgagtgatttgttgcaatggagatatgtgtgtggataagtggcaggtggggacaggtgacacgtggtggggaccagagggagctggtgcgcacgtgatgtggtgagggaggagcgaccgatttttttcccctcccccgggcgaccgagaacgagcattctcactattttattctctctctttttacgattattttgattttttttagtttcttgtccataagaggccatgcgagaaataatgctttctcacctttctccttgacctcactccgaggcatctccttggcatcaccgaactagagctaccttttttaggctacgaaaaatcttaaaatatatttttagtctaaacctgaaacggataataatacggatccaaaattacaatatatatttaatactcctaccatccttaccaaaagtcaaatataatttttatcatgctagggatttaaactcgagaattctccttcacttgtacttatggataccaactcacctgaagtcaatctttttagcagatggatatgtttccttttaagcatttctaatcgagatttgaatcatgaatttgagtatataaaataaatcaaatgaaaaaagttgtcaactacaaaatcataaatcttatcgagatctataattttcatataaactttgtcacaatctgtcatgaaaaaaatcaagacaacatatccggaactagcactaatgtgattagggccatcagtgccagattataaaaaataccaagcactgatgtgagtggcattagtatcacgtatttgttgacgaaaaatccgtgcttggccgatgatgcctgatctgtgttggcacgaactaagtcgacgaacacaacggtctgggagatttgcttagctccagtgcagatccaaaattgatgagatacgggcgtgccagttagtttgatcatgcaactaacaagatatataaataacagatccaagagttgatcggctgacaaggcgatggaatagttgcgaccaatgccgatactagccgatcccgaaaccagctgatgttgatagggttttaaacaatcggctatatatcgaatgcatattctgatacttgagcaaataacgatatatagacaatctgctgatgataataaaaataatgatataatccaatataaaccaatcggctaataatgatatgatagaattaagtgaaccgatggttaaagcatacatcggctggaagtccgatatcataaaatccaaatgattagataaataataaaacctttgtcacaatgggctaaatccaacttgtaaataactcatcggctaaaaccccgatgaaacccttattataatcaaagacatgttagcttttatgattctatgcacgactagggatgatgcatcgcaaagtatgcaaagaagaataaagtctaaacaataaagcctttgactaatttttagggtggtggataccttagttaatataatctagcaagataatttagccgataccagcataaaccctaaaacgaatctcagccgatatgatcaaattaagatgttaaattaggttaactaagatatatgataaataagtagacaaatatactaaccgaatcagagcgatccaagaggtcgaatcgatgcagccttcaacaacaccaatatagccgatataattgccaggaccggcgaaacataggacttaccccttcgccgaagatcgaaagccgatgcagccctgcatcaggtgccaagttccgcaggtgataagtaaaaacctcggaaaagagagtggcgaagcggcgagagtaattgtattaatctgtgagagagtttataatgaccacgggtgtacatatttatacctatgggtagatactagtcctttttttgacaagaaaaaaaatttcctaaagataaaaggaaaacataaagtccttatcgggcactaaacacacttccctaaaaataaaaaggaaaccaacagattcttcctaataaatagatgaactgccatgccgcatcctccttgagctcggtcttttctggataaacttcctttaattgattaatttctttaaccgaatctaccaagaagctgactattatattggtgacgatattttccatcggccgatttcaagatgctgaaaccgatagtgactctgagcccatgatgacttaccaaattgttacgttaacggtattctaattaatcacccggcactgacgtcttttcctgccaacaggccaacccatccccattccaatcggtttaaaccgacattgattggttaatcatccatgccagatattcttataaaccagcaatggtatcttctcatcagtgccatctaagcatgaaaatgtccaggtccatatactacaacatcaatattgatgtttgaatagcattcactgtctgttcttcgcttcaaccaacaacgatgtataatttttttcagcgaaaccaacaacgattatttttggctgaaacgaacaactgtattgacatgtctatatgtcactcatccatgctagtatgtctatgtgtagcttaggcataccaaagttaataaacttattctccccagtggtaaacatgtagggccaatcgtaaaagtggcaaccagaaagtggcaagtagtcaaatatccctgagtaaatgcatgcttcgtcgatagattgtcatctgagtgaaatcatgacttcattttttttttctcactacaccatcgcaaggaattgagggtggcggttgaagatttaattgttgcaaagtacttagacacttagttatgattaatgaagaaaatacaccttttatcaccaaggctgcaaaaaatagaaggcgaagaaatcctttcattcgctagacggcactactggaaaactgatctttgctcggtcgccccaaaaccacaatagtcccggttacaaaaagaactgagactaaagatgatctttagtcccggtttaaaaccccacagccattctacgatctttagtcccggttcatccactgtcagtcgcttgacagaggggcgggatctttagtcccggttgacaccactttagtcggggagtaaagatctcctagatcaaatcacgcgtagtatataatccctattccctatcctctcccctacaaccagcctcaatctcctcaacaaccggcctctcctctccttaaattcatctccctctcctcctccccctcctccccttcctcctcccatcccggccctctcctccccctcctcccttcccatccgatgcccagcaagggccgcctcctccccctcctcccttcccgtgcccagggccgcacgcggcaggcggctggcgggcccacgcccggcggggccgcacgcagcaggcggccgcacacgggccgagtagcgagcggcggcaggcggcgctaccggcatccattctgttttctttttctttttacaatttgtgattcactgagatgtataattttgtgatttgttgtatggatctgagatgtataatatgtgatgtatttggtttgtgtgtaatttttttaatatttgtgatgtatttgatttgtgtgtacaagtaacttaagatttgtgatgtgaatgttctaggatgttactttgatttggggtttgatttggtaatatgtatcccactcgatttgggagaaaatacatggattaaactctggctaaaaaataatgaaaaaaagaaaaggagacctaatgagactgccgctgccctctctctttagtctcggttggtgttaccaaccgggactaaagataggtatatttagtcctgattggttatttcaacctggactaaagatgggtatctttagtcctggattactagtcccggttggaaaaccgggactaaagggggttaccaaccgggagtataaatggtttctccaccaatgtgggaatacaaatcttcatcactaatatgactttagagacaaatattaatacacaaagtaattatgcaagagagctatatactccctctgtttctaaatatttgacaccgttaactttttagcacatgtttgacattcgtcttattcaaaaacttttgtgaaatatgtaaaactatatgtatacatttaagtattttttcaatgaatcaaatgatatgaaaagaattaataattacttaaattttttaaataagatgaactgtcaaacatatttaaaaaaagttaacagcgttaaatatttagaaacggatggagtattcaattcccgtattatgagattgccctatggaaagacttcgataatggatcgaatacctaacacagggcttatcttgtagtcagtgaatcctgcctccttgaataccttgcaccattctttctcacctctctgcatgcctggtaatgtagtcgaaataagcagatcaaacaacagttgggttccatggcacattgcttgggtggaggatccaaccacaacatctatgacaatgaccttccctcctgcttctctggaaggaattgcctccttgcatcgttttagtatcttcatgcagtcctcatcactccaatcgtgtaggacaaactgcaatcaagaatgttgttaattaccatctaaaaatgtggtaactaagctagttaatttgatatataccctgtacatcagaagatgtcaatacacatacttttgagcgcttttcaacgcaaaaccggttggattatatgaccattaggcatgttcaaaggcatttctatttagagactatcctcatacaacaattgagtaaacaaaatactctcaataaatgcaccgagccaatttttgtattatctactccctctggcggagggtgatcctctctagcgggaggctgtgagacccccctttgtgagctcggccgggggaccgggtgcaatattgaggaacgtgttctcgcgcgagcgaggtgaatctccgggaatcaagctcacaaggtggaaggcgagagagtgagagagagggtttatacaagttcgggccgctatcaagcgtaataccctactcctgtctgtgtgatgaccttcgtatggttacaaagatttaagatcctcggagtacaagctagggcttggccagcctctttccagaatctggttttctaagagatgtccctttactcgtagggcacggtcctccttttatagacgaaggggataccacatgcattgcccctacgctctccccgcgggataggggcccacattgcctacataaaaagcgtcttgtgccttgggccggaagcgatccatgcggctaaccttgggtggcccataccgaaactttacggctgacacgggagacatcccccatcattccctattaaatgtttggcgacttcgtgggcacacacacattgggcggaccaacctgcaggacccacccctgtgcatgatgggacaaggcatacctgcccccacgccgtctgacacaaaccgggacgtgggtggactgccgcctgtcccatccgtccatcggcgggtcacagaccggtcaaaaagcggccgcaggcgcacgtcgagcgatctgtggcgcatgctgagccacgccgcataaaacacggcgggggcggttgcaacgccgctcataaatgcgcctggcggacggcgctcccgcccgctcaagcccccacatgggccttggggcgatccaacccctcgggcccgaggggtgtgacggggcacctcgagcccgaggggaggggaagaaagctgccgctctctttccaagggcgtggcccattcggggggactgggcccaccgtatgcgccacacaggaagggctttctttccccctagaccagggacccccaggggctttttttcccccctgatattatgacttttttctataaagttagtgaaacttagagcagtttgactttgaccaaagtcaaaacgtcttataacctgaaattaagggagtagttaacaacttgagcctgctactaattgccgtgctattagttgtcatcgtacatacctttaccggaggatcaagggtgaatagccaatacggtccctgaagtttaacttcgggctcagtttagtcctcgatgttttaaatcgtccaaacaagtccaccaaattaatcatttgggttaatatagttcttggacctaaaaaatgccacgtgagcatgccaagtcattctcgcatgcagcggtaggaatgatatgagcattccactcttatataccatatagaaaagaaataaaagacaaaaaatataacaagctagcctaggctcagcattgttgcagatgggtggccgacaaaggaatttatgcgaacagtgcttggctgagcaatcatgagtgacaattataaaacgatcatacacgtgtgaaccattttatcttcttttttttctttcttttctatatggtatataagggtagaatagtcatttcattcataccattgcatacgaggatgacttggcatggtcatgtgggactttttgtgggtccaaggactatgttgacctacatgattaatttggaggacttgttaatttgaacgatttgaaacctaaaagactaaactgagcccgaagcaaaacttcagggaccgtattagctatttgcccaaggatcaatgatttagatctcctgcttcaccactctataaatgtttaaccgtcatttaggaacatccaagcatgcatgccatgttacttttttgacacatgtcttaattttatggtatctcttatatagtatacatctgtaaatattaaggaccgaaaaatgtccatggagagaacacttcggtgtccaaaccacaaatagtgtcacaaattaaaaggctagaaaaaaaaaactcatttgtggtctagcaaatccttttcacagttgtattgtgtggttggcaattcattatataatcccgccatttttaaatatgtatcactgtcaatgttttaaacatgacatttgactattcatattacatagaaaagtatgtaaatattatttactttgttgtgatttattttatattaaagatactttaaacccgacttatatttttatacatttgtactacatttaattaaaacatatttacactaaatcttaaataagacgaatgatcacatttatattaattcaaaagtttattagcatcgttattaaaaacggagggagcacatttcatataactcaccttgagcaggagtgcatcagctcgggggatgaaatccatcatatctcctgcaacaaacttaacaacatcgcggccgcgatggtccgccggaatggaatcgatcacgtgaggaaggtccagcacggtgcacttgatatgcgggaacgcggcggccaccaccctcgccgccgtgccggtgccacctgcgacgtccacaagagaggtgatcttgtcgaacacctggcggcccgcgccacggatggccacgtccatgatgaaggccgagtcggccgccatggcgtcgttgaacagctcgccgagctccgggtctcggctgcagacggtccacagccccgcgccgtgcgtcatctcgaacggcgtctcctcctcgccgctcgtgagccactcggccatgctcgtggccggcgtcacgtagatcggcggcgagagctggaggagcacgaacggcagcaggctcctcccgccgttgccgccggtggcggtgacgagcagggacgacacgggcgtgacgcggtagatatcatcgtcgtcctcctcctcgtcatgcgcgaagacgcccgaggcgaccagcacgcgcatgacgcggcgcaggaagtacgggagcttgctcgggtggagggacagcgcggcgcgcaggtcgtccatggtggcgcggccgccggcgtggtggatggcgtcggcgacgccgagcttggcagcacagcccagggccatggacctgatgtagcccaggctgtggttcatgagctccgtgctggcttgcagtagctgctcgtgctccataacttggctacttgggcgagcttggttcactacaatatctataagctaaaaaattacgggtaagaatgggcgtttggttacccgtctcactctcctcacataattatattaccacatagaagggtgtccgtgtgtgtttgtagggataaaagtgcgcatgttataagtgtctatttgtactgtgtttcccaacttacacttccacattaaacggttcaatttttgtaaaaaaaaaattacatgaaaaatactttaaaaaacacattaatccattttaagtttttttaacaaatacttaattaattatgtgctaatttatttttttttcgtgtataggagattagttctaactcacaccgaaaaatatgatcttagaccccgaccacaggacgtactgatagtacaatatgccaacgtcaatgaagttacacgacttttccacatataatatagtattagacatttggacaattgcagatagcaaccaaaaccatcgctttggggtgctagatgtcatcgtatctgatactgattgttttgggatcggtacatgtcatcatacccttgtctagaaggtaggggcgacgagcgcagctagggattcttccgaaaattgcgggccacgcacctcctacttttccaccgcccactactttctgccacgtatccatctaagattaaataagagtaactggctatggttatatctgttctatacgacgagttttttttccacaaaacacacgccattttttattgtttgaacatatgaatacacatgtataccatattcttataagcactttcagaaggacgcgactagactacacgtgctagcgtaatacctctaaccagcgatgcgctactttttttttttttaaaaaaaaggttcattcttttccccacgtgagtgtgtcttgctaaaaaaaaacatgcgaacgntacactcattagtactaagcagagcccacgttatttaaaaaaaaatatatgatatcctgtctttcctcatgtacatccttccaaaaaagaca

SEQ ID NO: 60492 - DNA, 1719 bp, Oryza sativa
aactaatttaatgttattttatgaaaagttaattcctttcagaattgagttacttctataatgtgagcaaatcacttttaaatatttgaatatatttaatattgtactcatcttgtcatacattttaaatagagtaagtgttaacagcaaaatttggtaagccccgaagtcattatcggccgatgggaattatcaagtcatcaatagtcggattattgctatattcagttaaggaaattaatctaccaaaggaagtttatccagaagagaccgagttcaagtaggatgcagcatagtagtttatctattaattaggaatagtctgttaatttccttttatctttaggaaagtgtgtttagtgtccgttaaggactttatcttttccttttttatctttaggaaagtttctttcttatccaagaaggactagtatctacccatagatataaatatgtgcacccgggtcattatgaactatctctacgatcaatacaaattcggcgcatcgccataccttttacttttctactttttcgacgagtttatacttgtcatggttgctttgcatcggcagggctagggctttgacactctgatctcgtcaatgtaagcacatatttatcatatatattagttaatctagtttggtagttgaatttacttgtatcggctaagattcgttttagggtttgtgtcagcatcggctaaaatgttgtactagattaaattagctagggtatctagcaccctgaaaatcaatcaagggcttgattttctagatattatgtttcctttcatactttgcgctgcatcagccttagttgtgcttagaaccataacctctagcctgctttttgattgccaatacggatttcatcggagtttcagccgatgaggtatctagacgttgcatcggcttataacgattacatacaagttggatttagccgatcgtaacaaaggtttcattgattatatgatatcggacctctagtcgatgtctgctttaaccttcagatcaatatttattctatcatatcattattagtcgattggttcaatggattatataattattgttatttatcctcatcagccgattgtctctatatcatttatttactcaagcatcagactctgcattggacatacatccgattgatcaaaaccctattagcatcggcatcggctagtatcgacatcgactggaattactccattagcttgtcagccgatcggctcattgatctactatttgtatatcttgtcagttgcaggatcaaactgactggtacgcccgtatctcatcaacctttggacctacactagagcttagcagatctcccaggctgttgtgttcgtcgacttagttcgtgcccacacggttctggcaccattggccaaatgcggatttttcgaaaggggactgtctagccaatagacagctgaaaatttttatggtttcagccggatttttccaccacacgataaaacacgtgtcatgatctgccgcctgccgcccacctctcgcgcgccagagagcctgacgctgttttgtacgggttctttcagactctaagctttgtcccatttgtttggcacacaacaagtccggcaaaacataatctttagcaagaaaaacaagggcagctcaaagtaccaacagtgcaacatgaatacctctgcctctgtctccttatcctaccaaaacacggcat

SEQ ID NO: 60493 - DNA, 35245 bp, Oryza sativa
ctcaccctcatcgacggcttgaacgacaagttcaacaacctcaagtctctcctcccactgcaagtcccgttccccacctttgccgaagcccgcgctcaactcctcctcgacgagctgaccaagggacatcagcctaccggcgctgccacggctcttctcgcgtcgtcctccaccaacatctgctcgtcatccaccaactcctccaacggcaactcccgcaacaacaatcgtcgccacggtcgcggtaacggtagtagcagcggcaccggcggcggcggcggcggagcggcggtggcaccccccacggcggcggcggccaaggaaaccagggttccaccgcttcacaggcttctgctacatgggtcaaccagggatggcccacggcctttaatccctggactgggagcattcacatgtggccaggctaggctggcccaggtcttctcgggccacggcccggcttcgcaggcgctgccctcaccaacgcgccggcccacgcctacccgccgtccttcgttgctgcgcctgggccggcccagttcgcggccccctccacggtgccgccgactcccatggcgccaatcgccaccacgccgttccagtgaaacggcccctctcagtgggacccacaggtccttgcaggcgcctacaacacgaccacgctgactactccgccttctactgaatggtacatggactcaggtgctacttctcatatgacgtctgacactggtaccctctccatcccccaacgccccacccacaatactcactctcacattattgttggcaatggctcccttcttcccattacatccgttggtcgtgcctttttacattatcccagttattcctttgtgcttaacaatgttctggtttcgcctgagattattaaaagccttatttccgctcgccgtttttcttgtgataactgggttctgttgaacttgacccttttggcctctctgtgaaggattacccaaccaagaacgagatcgtcaggtgcaatagttccggtgacctctatcctctcccggcgtatgcgtactcctcggcgtcctctgcacgtgcctttgtcgctacctccaccaacaccgacctatggcatcgtcgccttggacatcttggtcatgaggctcttactcgcttggcgcaggcgtctgtcattccaccaccaaaagtcaccacctcgctttgtcatgcatgtcagttaggtcatcatgtgcgtcttcccttccccactagctctagtcgggccaaggcaaattttgatttagtacattgtgatctgtggacatcaccaatacctagtgtgtctggatttaaatactatctcgtcattcttgatgattgctagcattatgtgtggaccttcccactccgttttaaatccgatacattttctacactatctcacttctttgcttttgtgaagacccaattttccacgactattcgcagcattcagtgtgacaatgatagagagtttgacaactcctccgctcgctctttatttctcaccaacggcgtctccctctggatgtcctgcccacataccttcccacagaacggtaaggccgagcgtatgcttcgttctctcaataacatcactcgctccttgctttttcaagcatgccttcccgcttcctattgggttgaggcccttcacatcgccacccacctcataaaccgtcatcccacaaaaaccattcagcatcacacccctttctttgccctccatggtgcacacccctcctagtcccacttacgagtgtttggttgcaagtgttaccctaacctatccaccaccgctccccacaaattagccccacgatccaccccgtgtgtgttcctaggctatccccccaccataaagggtaccggtgtttagatcttgccaccaacagggtgatcacctcacggcatgtggtgtttgatgagtcagtttttccttttgctgagatgactaacaatgaagtggctactgatctggagttcctttaggatttctcagcttcacttccgacgccgattggacgacgcccctgccctgaccacatcggtccggcggcccgcttctccacgacggccccgcacaccgaccccaacaggccggcctctccgacgcgcaccggccccagcaggtcagcctctccgactgggcttgcctcgcccagtcccccagctgggcctccttcacctttggctaggttgcccagcccctcctggtcggctggcgcgccgaccgggcctccgccgactgcaccatcaccagctcagccgcccctcgctcggttggtcggcgcaccaaccaggccaccagcacctcttcggcccccgccgaccggcgcccccacacgcccccagagtgcgcgtgtgcctggcgtccgcataccgacacagctcggtctctcacccgtcgtcaacgagcactctatgatgacccgcggcaagaccggtcttcgtcagcccgtccaccgcctcaatctcagtgtggctaccctctctcctgtgccgcgcacgtatcgtgccgcacttgccgaccccaactggaggtccgccatggaagaggaattctccgcacttcaggccaaccacacctgggatctggtgccccgtccacatggcgccaacgtcgtcaccggcaagtggatctttcgtcacaagtttcaggcagatggtagcctggacaggtacaaggcccgttgggttcttcgcggcttcacccagcgtcccggcattgactacgacgagaccttcagtccagtcgtcaagcccgccactgtccgcacggtccttagcctggcagtctcgcgtgattggccggttcaccagctagatgtcaagaacgccttcctccatggcactcttcaggagacagtttactgcacacaaccggctggctttgttgactccaccagacctggcatggtttgccgcctcaacaaattcctctacggcctcaagcaggccccccgagcgtggtacagccggtttgccagtttcctcctatcacttggttttgttgaggctaagtcagatacttctctgttcatctaccgccacggtgctgatatggtctacctgctactctatgtggatgacattgtgctcatagcttcctctgatgctctccatcagtggacgatccggtcgctacagttggagttctccatgaaggaccttggcagccttcatcacttcttgggcatttctttcacacgccagtcttctggtctctacctcagtcagcggcagtactgccttgagatcttggaccgtgccggcatgtctgactgcaagccgtgtgctacccctgtggataccaatgccaagttgtcagctgttgatggtgctcctgttgctgcccctaccgactaccgtagtcttgccggcactctgcagtatctgaccttcacctggcctaacatttcttatgccatacagcaggtgtgccttcacatgcatgacccgcgggagccgcatcttgccgctctaaagcgcatcttgcgctatctccgcggcactcctgacctcggtctccacattcggcgttccactccggtcgatctcaccgcctactctgacgctgactgggcaggttgtcccgacaccagaaaatccacctcgggttacgctgttttccttggtgacaaccttgtctcatggtcctcgaagcgccagcacaccgtgtcctgctccagtgctgaggcggaataccgggcggtggccaacgctgtggctgagactacctggcttcaacagcttcttcatgagctccatacccctccgagtcattctacactggtctactgcgacaatgtgagtgttgtttatctctctactaacccggtgcagcatcagcgcactaaacatgtggagattgatctacactttgttcgtgactgtgtcgccgtgggttcggttcgtgtgttacatgttcccacgacatcctagttcggcgacatcttcaccaaaggtcttcccagcacgatcttctcggagttccggtccagtctgaatgtctgctccgtcgacgttccgactgcgggggggtgttagattgcgattgtgtatatttgtttccctcccttccttatcccctccgatattgtttctataaatcggttgcggtagatatggaaggcttgggcctatatgtactctgtcatatcgataatgcaatctatcgtgttgagccaatcacactttcaatatattccaacctggtccagaacctgcaattgatagtaccagatgattcagatgaatatacctatcaagtatcaacaggagtagcaaatatccatagaactaaccccagcttgagcgatgcgatccaaacaagttgatctagccatatgggcgagggcatgcactggaatgtgacaaggtgtggcagcagcgggggatcgacgacgttacttgacggtgagaagggaggagatcaccggcgaggaggcccatgtgatggggaaggagcagggagcccgacgaacttcttgggcgacaccgtgagtgatggcgatctaccagggtggcaccatggggtggggggtaggcagtgggcgacgaacgacgctcgagctccgctgacccatcggagtagaaaggatgcgcgaagagggggtgcccggcacggtggagggggcggttgaggtgtagtgggagggatgacggggcaacggcggctcggcgcgttggcaggggagaggtggcgtaatttttgggtgagctgtggtcgccgggggggttgggggggtggggagggagggggtgatgggaacggggaggagaggctgagccgttggattcgttgaattgatagatggacggtaggatttaactggttgatttcacctgtaggattggagggggcaactccttctttttatattagtatagaaattggttattagatcggttataggtgaattggagcttgtaatgggctatactattaaacttgctcttatatcgaactagcctataaagaacgggaaaactccttgaaaaaaacatgtagaagattgcaaataatattatcatcaacacatgaggggtatctctaaggcaagtataataacatcatgcgagcatactattagccggtccaacttagcattaatgtgctatgggtaacctttgtaaagcttaaccgagcatcgtagggcttacttcatcacacatagctgtctttactttagtactttagaaggggagctcacatgaaaattaatgtaacttcttttttaaacttttctttgttttttcatggtactatcaaagggctcctattatttttccatattttttaattcctttaggatttgagaatcgtctacttcaatttttatgtttttttattcctagtttttttctatcctgtaaataaaagagaccttaagattaggaagaggtcttaaacattatttgcgtttaccacaaataaaaataatgccctgagaaccagccaccatggatgatggatgggatagatcgatctccaaatacactatgaattattcaaagaagcgacatcctatgtataaccgatcactacgggagaagttatttttgctgggtcaggctatttccacaatagtcccggtttaaaaaagaggccggccatctttagtcccagattttccctcccggttcgctacctaggggttacaaaccaggagagataaagggtttctccggtggctgtaattttcaagcgatatgtggcgacctcactacaaatcgggcgcccctactactgtgtgctgcctgacatacttacatgcacaacctccatgcatgtgaactaacgtactacctctattttttaatagatgacaccgttgactttttctcacatgtttgaccattcgtcttattcaaaaattttatgcaaataaataagatataaatcacacttaaagtactatgagtgataaaacaactgataacaaaataaattataattacataaattttttgaataagacgaatagtcaaacatgtgagaaaaagttaatggcgtcatctattaaaaaaaacggagggagtagctatatcccctttcactcatctcacttgtaaaaacaaacttttaaacgatttttctattaaaacaattatacgatctaaatcgttatattccctataactaaatccctacaatcagatctcacgcaagtatattttgataaaaaaatcaaccattgtttcactctttatagaacattgtttcagtttactgtataaaatattttaaagaaatacaacatttaaaacggctaactgcaacatcaacaaacacttatatgaaacattaagtccgaacaagtgaaacacaaaaataatcatatgaaatatatgtttttttatgggaaagattgccatgcatttggccaacaatataattttataacaaaaagagttatttacagtaaaggaaaaaaagatcaaagttattataaatttgtaaccaatcaaatactatttgttttcgaagcatttaacacaaatacttaatgttttgatgcatttttatatatctatgatttcattaagttgtcactattaaaacattatgaaatacttactaaaacatttcagaatatcatgtgcaacttaaaaatccgtttaaaaaataaatattttttcaacggaatataactacgtgtgatcttgttgtgaaatatttactcgcaacgaatttaatggtgcaattatatcgtagattggaaaaatagtttagaagaaataatagttacatgcatgcatatgaaggattactacacggcataaaataagaataagagtaccatgtaaagaaataagcaacaagacgagagggcgcccgatcttttaggcatggattgggcacccgatgggaagcattttcggatacgttgttggattcaagtgttgtataatgtatagggcacgaaacatgataaatcattacttcgttaggactcatacatgtttaattttgatgctggattcatttccatataatactttaaaaactttaactatactattaagcatttaattaagccactatttctagtgatatttgtgcttgtcacctcacctcttgggcaaacagtctattttaaataaaaatcattgaagggtatattttcaaattttgaaaagtacaagtctaattctaaagaagaaaacatagcatccaagacatgtccacatgtgagtaatgttatgtacacagaagggaaaattatattatacttatgcaaaacatataatcctttattttttaatctatgatgccgttaattttcgacataccgtttcatcgtattaaaaaactaataaaaatgtcacttattatgttgtggcatcttttgtcgttaaagaaacttcaaatatgacttatacttaagtatatttatattgattttaaaataaaatgatatggtcaagcgttatttaaaaagttaatggtattgtctgtcaaagaacacatatagtttgtaggattagtaccagagagctctctctactatgataccctctctaaaacctacattgtggatgctctaagctagtactaagcagtgtacgggtgaagattcgtaaccaaattggaggcttttcacttagaattgaaattttgaattgagacggtattcgtcaggtcacaatccgattttggccaatccaaaatcccaaaccgtgtccctctcactccgcgcgtgcggctcactgctggttgtgacgggcggcgatgccgctgcgccagcgccaccccaccccacccgttcgacgaaatgcggcgcgccgctgccctgctccgcctcctccgctccggggccagcgccggcgtccgcggccgccccgcctgcgcggcggtccacccgctcgccgtcaagtccgggagcggctccgacgcccgcgtggccaccgcgctcgccgacgcctacgccaagtccggactcgtcgaccgcgcccgcagggtgttcgacgaaacgccgctccgggaccaggtgctctggaacgtcatggtctcctgctactcttcgcacggccttgtgagggagtgctgggatgtctttggctccatgaggcggtctggttttcccggcgatggcttcacgttcagtgccttgctcagtgtgcgtgcttcttcttcttcttcgtgctatgaccatgccaacctgttgctggtcctgggaagctcggtgcatgggattgtgatcaggttgggtctccacctggatgtggtggtagccactgcgctccttgatatgtatgccaaatgcggccaagttgctgaggctagccgggtgtttgatgccatggtgctgagaaataccgtatcctggaatgcaatcattgtttgctatggtaagcatgacagaggcaaggaagccttcgaccttttcgtgtcgatgatgagacatgggttttgccctgacgagcttacgcttgccagtctacttagttcctgtgccgacatggcggctgctaatgaggctactcagcttcatgcttacactgttagaagaggcttgcaagactttctacaagtgggcaatgcccttatcatggcttatggtaagaatggttttgttcaagaagcaaaacgaacatttggtatgatccataacccagatctagttacatggtcatcaatggtttcttcttttgcatatcttggacttgccaagagtgcaatcgacctgtttgacagaatgctccaacaaggcatacgggctgatggcattgcatttcttggagttctttctgcgtgcagtcatgctgggctcattgaagatggcttcaagtactttcttctaatgacgagggactacaaaattgatccaactccgcagcatcttgcttgtctagttgatctcttagggagagctggtaggattagagatgcctacgaatttttggtcaatatgtcctgcgacgcaaatgttgatgtcattggagctttccttggtgcttgcagaatgcgaggaaacattgagtcagcaaagtgggctgcctctaggctatttagtctaaagccagatgatccaatcaattacctgcttatatctaatacgtatgctgctgcaggagattggaatgagcttgcaaaggtaagaagtgtaatgaggaacatgtgtggcaacaaggtgccgggctgtagctggatagagataggtggaattgttcagacatttgtatccaatgatatgatgctccatcagtcaagagagatgcaaagaatgatggaacttcttgtttcattagtggaacaagattgcaatggtgatgacacaatttgcaatgatccatcatcgattttaaaatggcaagatttttatctggcatttgattaattcagctgtttgggataatttcacaatggaatactgtcagagcttcctaatgtgactattctcaggtcattccgagatgtatctattttactgtttttttatcctttgattatatacacaaacataatatgcttactagaattaccttgtgcaggttttcacttaccatagacatgagataatgtacacccaggaaggaaggaagtctaccgtttcttctaggtaatccatgtaaatatcaaaatatggtataacagccacatactgatttttgtatgtaagcaaccatatttgttttgggcaatcatgtgtaccagtcaactactaactcgggtcagtaagtaatagtaattattttagactggaaaacacattatgaacttaccaaggcaagggtggatagtcctgaccaaagggagggaggggactaaacaagtcaagggactgagagtcgcatgcatgaccaggctcaggatcctctctgtgtatagtggcatggtacctctgttgtgtgccttggtaggacagtggagtaggtaacttgattgggttgcatcagtgttgcctgttcatgagagtactgcaagaacgctgtaaatacaagccatggacctgatgcacaggtggggtgaacattgggtgtagcacatcatggatttaaggatttaagtggtacgataagccttaaacacaccaaacaaaaaaataaattacttgtgaaaaaggccccaaatgttgctgataggagagtattacttatggaacttcagatgttttgctgaattgtttcaatactgttagtttataacaactaaatgaaagctttattgatttcatttccttacagctggtatgtgcaaaatcgcctgcattggaatttggaattgctaaaattccttcagcatttattggttaatggtggccaagcagaataaggtaaacctactataagcagttcagcagcaaataccaatcccaaagctcatagcttaagctatgatcacccagtacttcacctctttagatagttttcattaaatatcctgatactccgaagtagagtgtgaaagagaaggaaaaaaaatgaatttctaccaagaagtacaaagcatcttgccattgatctagtccattcataccttggtcacggtatcactcctttctcacattgcccacattgctctattcatacatttggaataagggaattcttaccatttccgatgggaattgaactgattcttgtgcatttaaaaggaaccctacatgattatattatatttttcaaccattcaatgttgctgaagacaaaccgatttaagaattatctaaaacattccaaactgctacaatcataggaataagacacatttaggaaatttgactacctctctttcaatcatgcacaacagcccaatctgatgctatggagacagggactttctgatgcaagtctggtctgtatacatttaggcacttgaccgtttcaagttcagttacctgcttgtgagccaagagatctgtgcggctcaatcgtggttgcttgcgctgtgggaaagtttgatgagccaaacatccagatgcaatgaggtgtgtcggccatactacacttcagtttctcatacttgtacgtaagcaccaagaaaaaaatataacaaagttaaagcgatgaatatagaacattatgttttgggttcagatcgaatgaagaataactcatacgtgctcaatgtataatgattacttgagttataaggtattctccagtattacctatggtagttgccatccaatctcaaaatatagcatcttaagataacattggacataacccagtataacgaattcggaaaggcctaggttgctatattttaggaagaagggagtatatagcaataggaaacattagactaggtctcattcgtcctgctcaattatatagcaaaagtagccatgtgagagaagaggagagagaagataaaaattgttgttattttattttttggctagcctcatgtatattggtagttcatatactaaggacgaccatatggtctactcataatatataagctaaactctagaaattgatcctctctggtggctacattgtggatggcctaagaatataagatgtcaagaatattctgattaattgatgggccgcaggtctaggctcaagtttattgcttatttttcactacttgttccttccgtgagctccagtgtccaaaggagatatgaagcattcacttccttttcttgactgagacttttttttaggacaggcttaaagccatcttgactgaaactagagtgcgtgggttaggattcatcgggatgttcatccgctcgtttcccttccaacattggtaggctgtcgttttggtaggatgacgattctaatcccttgagtccccttgtagctttttcgttcaaattcagtgtgaatagttatgaaaaataaaaagaaaatgacaatgtagactatattactaatatctagagtgaattgcactttgggccatgttttattgtcaaagtttcactttagaccaccctgtacacaatcttttcattttggactaggtaactttacctttcttgcgtaatggaccactctaactctttacgttagtgatgtctagcgtctcttttgacaaaggtatagcaagcatttaggtatgaaaatttgttggcatgtcgttaacaatttgcttgaaatcatcgaaaaactgaagatgtggtttggggtggttcattgtgtaacaaaggtaaagttacctagtccaaagtgaaaagattggacaaatggtagtttaaagtgaaactttggcaataaagtatggcccaaagtgaaattaactctaatatctatcactccaccaaaaatcattttcaaattctatctactccctccgtcccaaaaaaagacatcttggttttccgtgtccaacgtttgactgtccgttttatatgaaattttttataattaatattttcattgttgttagatgataaaacatgattaatactttatgcatgatttgtctttttaattttttttcataatttttttaaataagacggacggtcaaacgttggatatgggaacccagagtttgtcttttttttttttggacggagggagtacacattaagaaacgaaaaagacaaaatcagacatgaatagcaccaatactattcatatgctggatttatctttttttttatttctcaatgtgtgagttaagttttgatttgatttttgtgcagtagtttatatatatggtatgaatgttgtcaatttttaacgatttttgaatcacgtttgagtagacgaggggacattctcttaagagtttaaaacaattgttcccaagatatacacagtggtagtaaaaatattcaagtttgtactatcaatatttttgtgataaaaatattgtaaagtaaagtatatattttggggcaatttttattaaagttctatcagcatgcaaataccacacacccaaacaaattttacaaactttccgatactgatgttttggttttttctttatccaatttattcgtgtgagatgacgtcaacattgcctaagaaacgagaataaaaatagatgctttgcttgtaactcgtatttaattgtttccaacaaactacaaaatgatgcagataataaaggccaagaaattacttctccgacaaatatatacagtatatgtcccaaccaatttgagatccatgagtacatattaggtgggttcattagtgtttttttcttatgggtgataataatatgtgcaaactgccacagtttcttatgggtgagatttatggagccaagtacaatgtgccacaattaaatttcttccagactagctctatatacagtacaaaccatttccttctgctgtttctcaatcattcatgacttgagattgtgaaagtttacaggtcaaagtaagatcaccgacggacgaagacacctccaatcattcgtcatcgatacccaagtatatatataggattaggatgcatctgggaattcgtcaattggtttcaatttctctaaattccagtagcacgtagccgatatgcgcatagcactggcatttttttgaattggcatatttgcattgccatggatccaattaacccatatcatctgtagttgtgtgttctcaattgattttttcagctgcaatgtggtatcgattttctaataatcaaacgctaccaaaactcccaaacctttctttaaattcatggcgttgcattgttttggcacgtcggcattacacttcatttgtcatgcctagacacaataaataaataaacaagtaaaaaataatgaagtgatgaaagtaaaatagtgcatccaactctcggtatttgattattacgaatttcataattcagaaatcagaatgaacctaagtaccctgcaagttcgttgggggtgcaagttcgttgcatatttaccataccctatactttatgtaaggtcccattagagctttttcaatgtaaataaatccaaaaagaagtagcaaagtgccaaagtggcggcataattgacaaaattggccatgacacatccgcaaccaaaggcttgttccaatcatccttgcagacatatcctctaaaaagtcaatcataaacagtcgtgttctatcatcttcaaaattttcacattaaactcaggtctccatcggttggccatgtcttattataagccataacggcttattagcgattaaaaaatgatatgtgagtaaaatttttgtatatatgttcttagtgattgaaaagttaaagctgaaaaaaaaactatgttgaaaagcatcaaaatcaaattcaaaatcaagttttaaaatttaaatttttgccttctgacttactgttgccaattacagtaatgggagagagtggcaaagtactgaacattatatgacctagttaatcacccaactactgatgtagctcttgttgaacaccttgactgctggcaactgtataaagaaatgctagttgtacttgtatcgccaattcaagccaaaatgctcatgaattgaatgcatgagaccgtccactctaaaggcatttttgctagctcttgatttgtgtttacagagacttcctacatatatcccatgttatataggattagaatgcaacaggaaatccaaatgcctggattggtacctgccgcagaaaatggacttttgcaggcggcaagataatgccaaccgctagagaaaatgattttccagaaaaaaattaaatccccaaaatccctttctaccatctcaaccaagaagttgccaaaaaaattgaaaatgaacatgaacatcattcaagcatcaatccaaatacagagcatcacaaatatcaacattggcatcattagcataacagattaacaacaacaatctgccggctgccgttggcccaagtgaacccgctgccggctttgtcacactcgaagttgtcgtcatggccacggtggactcatggtcgtcgtggtcactgtggactcggtgtcatcatcgttggattcgagcaccaccggcgccggatccacctcttccgagcacccccgccctcccgagcaccgccaccagagccaccactgcctgcacgagccacctcactgccgccatccctcatcttcgccgctgccatcagtggggaggaaggaggaggcaccggatctgctccccgtcactccctccccccgcgccgttgatgccgaaagccaccagcaccgcttccgaggcctagtggcgctggatccgccctctcaaggcccaccgacaccagatccaccctctcgaggcccaccggcaccgtatccactcccaaggacctccccgttggtcgatgcggcgacagtggaggcaatggcagccggcggcagtggaaaagggaggccagagaagggagggagaaggagagaccgagggacaagcgagaggcgagtttggtgggcgatggattttattcacctcaaaagttttttttttttgcagcggtcctcttgtcgatgtttgagatcacgactacagtatttgaatggtatggggatcgttggtaccagggtatatgtgagatcgaggtaaaagagatggagacatggatttttatacaggttcgggccccttatctgacaggtaatagccctactcctgttgaccgaagccggtgttgcttctttattcatctgaatcacacaagtacaataattggataacccgtctagctgtcgtcgacttggcggctagataaccaacttgtagtcgacggcagggtagtcttcctccttgaacgaactcatcgagatcagagatagtgctagatctcttttgccggccttcgcaggcaccgtattgggtttgtctaggcttatctctgatgttgatatgtggcagcgtattggtttgtgttgatctatatgtcttctggcttgtctcctctcctcctagggggttgtatttatacccatagatgccccctgtcgaagtaaaactagcgagataaatatggatacgatcctagtagtcctggttgtttccatatagaactccttttgtcattccttattcggaactccttctatatatgaggtttgttttcgtataagatatggtatatggtgggtcctgccgagcttagtcgattattattgggtatgtggtatccataaccctaacacctctttacctaccgccggcgaaaacgcgattttcattggtgtacacttagaggttcgcctcgaaaaatagagttgttttttatggcggacctcttagtgcggccgttaaatcggttttcattggtgatccgtagccccctatccctcgatatgtttgtgcttgcggttttcgcgtacggccgctagcaaaaattatagggcgacatcatgaaaaatcgttttttatagtagggattcttccacaagacaaattttgcaaatatctcgcaaatgttataaaatgtgtctaaggctattcccagtgtgcaggttccacaagagtttccatctcattagatgagatgtcatatagactaaacttatgacatgtcaatgattttatgaatagagagaaaaagttgagtatcgtctagatgaaacttgatttgcgcacttacctatacctcggaaacataatgaaatcccactgaatcatttcatcctataccttggaaatgaaatgaaatccccactgtgaccaaatagtttcataataccatttaataattaaatgtcatatgtagcatatgaaaccactaaatgaaactatgcattgaaaatttttctttcattcatcaaaccaaatgtttttagattatggctgcgttcgaatcttataaagattcacaaatacgggcatgcaaaacaagaaagctattagcatatgattaattgagttttaattattacaaacttgaaaatgatatatttgatactttgaagcaactttcatatagaaagttttcgcacaaaacacgccgtttagtagtttgaaaagcatgctaatggaaaccaaggtaaaatcttcatcttcatgataaaagaacggtgcctatgtgacactcttagaaatcataatatgaaactctctatttggaatggcctgaaatgtcttgtaggttgacttttaaaataccacttgaaagtgtctttagacgaactatggaactcctgatattacggatgatttgaaaaccatctctgttaagatgtactacacggaaggtttctgttgtaaggatttgatttatcttcgttcatttttctttctgtttttctatatatccaattgtcgacctcttcttctcattcaaaatatcttattgaataaactaggattaattaagttcatccgacatctctaaactttcatgaaaatctagaaaccaaccaaaaatgcacggttcaacgcggaactgttaaaaccatagagtagttcttgacttcttggaggagggttattttctagactttccagagtaaaatggacttctctgttgaaaccttggtaggtccgagaataatttaaccttaattgcaaaaaaaaagtttaggataatatgctagcacaaataaaaatgttttaccacgcaataaattatatatgaacaaaagtagccaataaatatatgagttgttgtaaccaatagtagcaaccatgcatcgatgctatggattgtaagtagccaatcttgtaatatccttccagccgtgttcattgtttcctatgcactctaagaattccgatcgacactcctagcaacaatacttttcttcttcatcgcacttaattagggataggaagcatagggaactagaatcatacatcctccatgagataaaggatcagctccagccaactgatgcataaggttgatacatattgcgatagaagttcaattcggcagccatccgtacctgccttacctgcgacttgttcccgcaccacactgcacaagggaagaaggcaacacagacatagctagagaacaacagcgatccttcttctcgggcttctaaactatgttttcacgaagtttattcattagcatttttttagaaaacgtttcaaatcattatcaactttataatatttgtcacttttaagatgtgaaattaaagatttatcacttacagtctatgacatgtgagccctcatgtgtctacgacatgtggatccagtgacaaatctataattaccacttgtaatagtgccaaataattaaatatctcagggaagtacggttggcacatacacacaagtggagggggaacttacatcacttggatggagggtggaacgcacgtgacgggaaggggtatttttaagatggatcaaaaataaaaaaaaaagtatcgacatatctaatggttgaaatgaattaaatatcaatggttagatgtattattatttattatagagtgaagtgcacagacggtctctaaacttgtttgagtgtgtaatttaggtccttaaactctcaaatagtttttttttaggtttccgaacttgtcatgtgttcatataaatccaaacaggctctactctacttcgtgagctaatgtggcatgccactgtagcacctacgttagtgggatccacaagtcagttacatagaaaatataaaattaaaaaagagaggagaaaaaaatgttcttaatgtttttcctattggtgatagacatgtgggtttcaatgatacagacgttaccatgacataccataccagcacacaaagcgggttggagctcgattagacctaaataatacacgatgcaagtttagagatcaaaaatgcattttgagagtttagagacatagatgacacacatgcataagtttggaggctatttgtgcactttactctttcttataatatttttttctaatttattagagcgttacataacgatttaggagcgtgtacaagatgtttaacgaagtcatagtatataatagatagacaaataaataaatactactatatatcttataggtggaagacatgcatgtaaatagactttaaaaacttataccacacaaaaataggaaaaggaaaaggtacatctgagatccctcatctcgtcaccgagttacaaaatcgttcctgaactgaaaaaccagatacaacgcatcatccaactttcaaaaccagtgcaaataaggtccgtcggttgtattgtccttggttatgactgacatggcgcttatgtaacacttcaccctcggtggtattatccctttgcctaggtcttcatccacgtggcattgacacgacggttacatagcaatttggtaaaaaaaataataaaataataaaaacaatggggcctactggtcagatccccttatccttttctgtctcttcttcctctctttcttgcgtcaggcatggaggaagggcagaggaggggacgcctctccatcggctgtgggcaacctcgatggtggcgggaggtggccccggctccggtggcggtgaggccagcggcgtgtataatggtgtctcgggctcctactcactctcgttgccggcgccggattcctcatcgatgatgtagaatcctccaaatgcagtctgctcatgtctaacacagggcacgcattcgtcaatacacaaacaaaattggccatatccaaatgcagtctgcactgaacaaaatcctccaaatgtagtctgcagttctgcactaaacaagaacgattcccaagttggatattgggtaaaaaacgattttagcaccgtcaattttcctagcgcggcaggcgcatcaacaacgcaaatttaccaaaaccgaaggaacgagaccaccgacagagctaccaacgatcttcccttgttcctcgagaaggacaaaggcatcacaacccccaagccaggaggagcagcagtagcggcaaagcatcagaaccttccggagctaacccaagggcagcaacctaagaatccaaccgagatcaccttcctcttcgtcgacaggtatcgcctgcttaccttcctccccctgcgtagcggcggcgggagcatggcaggaggcggagcagcgcggcggagaggagggccggcatgacggcggcgtcactgacgcagcggggagaagggccggcgtggcgagcggtccttggatccacctgctggtggctaccactccattccctaggccctagcgacaccgcagccgaggccacctcccgccacggctgagccattagcgcataattaattaagtattaactattttaaactttaaaaatggattattatgatttttaaagcaaatttcatatagaaaacttttgaaaaaaaacatacaccgtttagtagtttgggaagcgtgcgcgtggaaaccgaaacaaacaaactcactttcacctcccctagagcagagagaggaagaaggggatctgatcagtggacccccagcatttcttattattttttctagatcaaattgtcacgtcaatgtcacatgggtcgaagacctagtcaaagcagccatgtagacgccacgtcagccaaatcagggataaaactattgaggatcttgtttatattggttttaaaagttggaggatggacgaggcacctcaaatatacttttacccccaaaatatacttaaaagatactaccttcatcttaaaatgtaactatttctagcacaataacttgtcctaaaataaagttttttctccacctacctcctctcaaccaatcacaatcattcccctttacctactttctcttttcaaccaatcacaccatttttttaatcattttttacctatatttatatttttaatagccgtgccgtcggaggaagtaaatcagtactagacctgtttaaaggacagcaatatggacaatatcaacctgcccactcacaatatgtgtgtgtgtatacagccataggattcattcgtttattcacaaacttcacttggtcctctcaaaatgaaaaaagaaaatgcatgcctacagttcagcttgattagatgcctcaaaagtaactgaaggaaaaatacttcctctcttcaacgtggcaccggcacattacacttgtattatttagaaagcaacggtccaattttaattgttacactcctccataataagattaggatgcatcaggaaaatagtatcgactttttctgcttgatttcgtcagttctttcatgctgaattcaccggtgcccaaagtagccgttgccgatgggtcgtcaggtgaagatgtttgctcatgttggtactttggacagcgcacactacgatcgatctgtcgtaggcattgccaaaagttttgctcaaaaatcaaacaagattagcattgaactgtgcgactatttgagattttttactttccccaaaatctcaactggaattgctcggtgtctacaaagtttctacgtagagggctaagtcaaaactttaaagtcgttttactctcgatttgccccaaatggtggttcaaactttacagtcgtttcacactcatcacactcaaatcaatggcaacattcaagaggtagattcaacatgaaacagtaatttcaaggcgatttaggcagtgagataatagcttggttaacttggaacgtcatggcaatgtgcagtccaataaacaaaactaaccacactagctttgtttttttcttactttgatgtcacaaggttaactgtaatgaatcaagaaggctcaaacttaacatacacacaccaaagccatccattcctcaaaataaatttaacaagcttatgcacatacaatcgaaagggctaaactacggtagacatcattcacctgatcacccctactagttattccaacaattgcaattttacaagtggtacagacagcatatactagtagtaaaaacattatcactgaccttctaccgatgatctaacgaaggaccttctccaccatacctggaaagctctagtaaggttcgggcactctgatcctttggatgcaaaacactgaaaccactcctcaaatagacactgctgctgcttgagtgggagggttagtagggcctgtcctagattttcctccaaagatcttacatccagacctttggagcatcgctgaagccagccgaaatcaagcaacatcgggctgaaccatccgtagaagaggaggctcctcagctctccacggcactgaacttttcctttgccgagtgcgatgaaaacactagcagatattcggcttagttcatacctcatcatgggtgatgcctgctcatgtatcctgatgagcctgtcttgctttgcccacagctccacaaactcttcagccatgtcaatattcacaagaatgtccaagagccagttgaggttctctgtctgctgagagattctctcaataaatggtttactgcccttgataactaatgcttgagcagtgtggtttgtagcctctgttgcttcgtcataaagatccactagtgaatttaaacaggcataacagatattatacaggctctctctgtttagccctgccatgtctttttggtagacagaacttttgcttagaaggccatttaccaaagattgcatatcttttcttgcaccactgttggtgctgctcgtgactgattggataagatgcactgtgaggtcttctgagctgctccagctgtgaggccgcaatctagccagaacatcttgggatattgcttcatcaaaagtacatcttgcaaagagattcttgagcttctcctcctcgttctcattccatggaactgcttctatgtatgacaaacacaatttaactcctctttcaaacatgattgatgaagacacctgcaattaaagcattaataaacaaattatgtacgtgattaattagttggcatttaataaactcattaccaatgcaagaaagaagcatttaataacatattattctgtaaatccccacttgagaaatatacatgctagaattgaaaagatgttacaaagatattggacagcaatggtggctgctttatttggatcactagatagcaattatgggcaacaggaatacttgcttttaattgcgggcctagatgcattcaaaccactaaatgcatttgtagctgactttcatagctgtagaatgtgatctaatggacatcaagccatagaatgtgtatggttacaagacttatagtgattgtattattatctaatccatgatttaacatattaaacaaacaataccagcatgcaaacaattcacatagaaagtgagtgatctacaacatctaatatggttataattatatacttacatatcactttgcataacttacatgaaagcaatggtttaataaaagcattagatgatattaaatcactaatatcccaggtcaaatgcttctcacacaatcatatcatattagtttcactcgaatgctagagctatcgttgtttggcatatgctgattataagccgtaacggcttatcagcgatcaaaaaatattccgttcgtaaaactttatatatgtgaactagttagcgatttaaaagccaatgctggaaacataaactacaatgaaaaaaacctcataatcaattcaaaaattaagtttccaaattaaattttggcagtggcttataagctgaaaggcaaacgctggggctctaacttgtgcgcctatcaaaaaaaaatgtgaaaatgagtattttggtaacaccacactggatatctaccaccaaaatggcttcggaaaatgaacatataaggaacacaacatcaatgtaccgtgaatgattgtttggttgcaatgcccactaaatttcctgccctgttgtgggtaacaaaatgccatccattattgcaagtagtactacttcttttgcaaccacatcatgctactagtaacacaaaatcaattaagagaagctgcttaagcttaattcgtttccctcacctcgagcacatcaatggagcgcgacacgccagcggcggcgagccaccgcagcggatcaggctggtacatgagctcgacggcggcgcggaacgcctccacattgtccaccccgtccacctcgatcctcctgccgctccctcctccgtcaccggcgggcccgcgcggcggcgccatggcggcgaagaaggcgctgctgtcgcagagcaccccggagtcgagctccatcaccacgcacgtactcccgtccctcccgcgaaggaaaagcctcagatccagcgcctcgtcgcccgccgcatccgcctccgccgacgccaccaccaacggcgccaccgccgccgacgtctccgccgggaccaccaccgtctccgccgcgggcgtcaccggcggcggcgggagcgggagcgggagcgggagcgggggcgcggagtcatcgaggtcgatgggcgagacgcggccgggggagaggatgcggcgcgggtcgatgaggccgccgaggccggcgagcctcgacgacgtcggcgagctgtggaacgacgagatcgagggggacttgggcggcagcttattcctcccggcaccaccacccggcgccggggaggaagacgccgccgtggccggcggcgcgagggagggagggaaggggcggaggtcggggctctgcgggacgccagcgaaggagcagcaccagccccggggcgttcgcgcggcggaccccgccgcacctcggcgccgcccgcggtggtggcgctgagccccgccgccttccatccttgccgtcgccggcgcagatctgggtggggcgcgagagagagagagagagagagagagagagagagagagctagggttcggaggcggcggccatgagaggggaggagggagaggtgtgatgagtggaacaacacgggacgagagctctctctctctctctgctgcttctttctctcactctgtgctgtggcactcactgtgcaccgcgtgggattggtccatgggacaagactggtaggtggggtccactgtaagtggggtcctcttcctcggataccgcgggcgtggtgtacgggcatcacgagaggagctggcactgcactggcaactcaactgggcaagagagggtttgcgatcgtctgcgtccggggtatgggtatgggcgtatggctgtgccgctgccgatcacacggaaaacggtcctaaacgatactcgggaggttccaactcccccacacgaaaaatggtggtacccgttaaaacgtgattaattaactattaatctcaaaagctcgaaaactcgattattatgattttttaaaacagctttcctatagaaaacttttaaaaagaatatacttccttccgtcccataatataagatattttaagtggatgtgacacagacatgatgtgtcatatccacctaaaatccattgtattatgagacggataaagtattgtttagcagtttaaaagcgtgcgtgcgaaaaaaaagtgagttgggaaagaaggagaaagaacacaaccttactcttataaaaataactttaacttttacttccggatatagtccctccttcctaaaattatttttaacttgttccatacatatgcatatctctctactattataaaaattaaatatgtttttgactgtactttggaacatcatccgtgtatgatcggtttctaagtccttttgctttttaaaatatagatatgtatttgagtcggattttaaattcattcgtttttggaaataatgaggaatcttataagaaatctctttaaaaaaacttgcatactaacttaaaagatgatcggacttataattgcaactcatgattttctagaaaaatatatatccaagtgaattctcacaacgaaactattatatatatctctactgttataaaaattaaaattgaagatacttttgcatacgttatctttctttgagttggtttttaagttcattcgattttagaaatacagatccatgtttgagttgaattttaagattatttgcttttggaaatataaaaggagacgtataagaaacctctttaaaaaaaactcgcatactaacttgagatgaaatatagactcctaattgcagcttatgattttcaaagaaaaaaatatccaaccgaattcccacggtgaattttaccatagctaaaccttataacaataataaaattaaaatagtatttaccgttgcaacgcacgggcattttttctagtatgttataaaaattgaagatgtttttgttggtactttagtatgtcatccatgaattagtcggtttttaatttcgttcgcctctgaaaatataggagcagtattataagagatctctttaaaaaacttgcatgctaactttcagactcagctcatgattttctagaaaaaatatatatcaaagcgaattctcacagtgaatctaaaccgtataacaatatttctcacttcatttacctgtaatgcattattctctactttcacaaatagaagagcccaaaaaataacttattttgggacagatggagtaaaaaaatattagcctgtttggtagagctccaactcctaaatttagctctaggagttgggtctggaagtggagtcgtggagcaacctaaacccagctctaactctctagttcattttgtgagagagctctacccagctccgctcccattttagatggtgctgaaactatttggctgagttctagcttcaggagaggtgaaggtggagttggagcagtagctatgccaaacaggtcagactatcttcaaaacacattattaaaaaaagagtaaagtccatcaccggtccctaaacttgtaccgttgtgtcatcccggtccctaaactcgcaaatcgaccgttcaggtcctcaaacttgttcgactgtgtcatcccagtccctaaacttgcagatcactcgtttaggtcctacaacttgttcagttgtgtcaccccggtccctaaacttggatttgaatatcatctgggtcaaataagacagtctaaagactttatatttaaaaataatttataactttttcatgtaaattctaatgaagaaaaactttatatcaaacttgtagccctcgatgcgatctacaactttgtagttgaatttttttattttaagtcattttttgtcccaaaatgtaattttaaaattaaaatttcaaaatatataaacatgcaacaatattttgggacctaaacggttttaattcaaaaacttttcaactacaaagttgtaagtcgcgtcgaagactacaattttgatataaagtttatcttcattagagttcacatgaaaaagttatgaattattttttaatataaagtttttagaccgtcctgtttagggaccggggtgacacaactaaacaagttggagctaaacgagtgatctgcaagtttagggaccgggatgacacagtcaaacaagtttgaggacctgaatggtcaatttgcgagtttagggaccgagatgacacagtggtacaagtttagggaccagtgatggactttactctaaaaaaaaatgcacgaaagccaggacctaagcatagacaactggctaagagcgaggccatcctttcatgctaggcatgatttggattcaaacaggtgaattcaatgaaattagatgataatcttgcccatacagcatgtacactttatgtatctatgtacattatactctaggcatacatatgtacattatactcaggccacatgtaaccccgtgtaaaagccacggacactattagggttgtaatatacaaaagtttgcacataagaacaacaaaatatatgcgtaaaagaagaactgtttgtagacaacctaaaatgtataaaagctaagaattcactagtacaaaaactgtgataggtattttctcctatgttccggtttatttaaaaccgacacttattgatcgttcccacctctgtgggatagaaaaaataaaggaccaccaccttcgtacaactatatctgtcggttcaaaatatcccggttcaaaggcatccataacatattataggttctgttcttttaaaaaaccgacacctatgaaaaactaagccgagccattggtcatcgggtgggtattccttttaaccccactgagtcaacccgcgttcatcgtctctctctctctcatgcatcttgtcgtccctatcccctccagcttgccttcgtcgtcaacgccaccacccgtcgtcatgtccccccctcttcctcctcctcaccacatccatgcctccccccctcctactcgcttccacctctatccccgctgccacccatcctcacagccttcgctgcctctaccacccattgtcctctgcaccacattctcgcctgctcccagctgccctaatctcttattgtttaaggtttatgaatcttgttaatgatttactagtttactgatgcatataacatgtaaaaaaaagactggcaatgaaaatggtaatatctcaatgctatacgtgacaaattgaaaacatatttaattactattatattggacgtaggctaccacttagaagatccaataatcaacaatctcacctaattctagaagaaagtaatagcatacagagcagcaggggtgtactaaatttttaattggaaaaatggccatctatataagagagccatagctgtcatagtgccatagctcaagagtagcgagacaacagattcattagggattttttttttgtcattccagtgattagtattgccatatcattagcattcatatagggctgtgaggcatcagtaatacttgaaattgacttgctatgaaacacagtagtctggcaacatttctatgcagtagcacactgagcactcggttggacaagatctggagtgaacaatacctcgctcacggtgagagtccgaccacttacttttgcaaccgttgtcggagtgccgccatggatgtgagcaggcacatgagtcagcgatctggagcgaatggagccttcctgggcaacacacctgcaccgtagttgcagtcttcctgagctcatgatctgcttgacatcgacaggcaatggcagcgcgggcgctcgacggcgtgcaggggtggttggctagggcaagcaaaggcagattaggaggctgttaatctggtcatgaacttttttgattattttgcgatttgtgaagatcgagagaggaagggaaaagggaaatgcggcggcaaatccagccacatcctcttaaattggtatagatatatattgggaattttaatattgtaatttgcaaagtatacagtttcgtcgtgtttgcaaagtgctaactgcttttgcagattgtgagaacatttctcctttccattcgttcttcctatggtctgttaattcactctaccacactggtctataggccacacctctccttttaccgtcctctgccatcaccccttacctgtagataaaaccttcataggtacctgttctgagccctttgttggtgctggtttttttaaccaacatcaatataggggaactagtgaggataaccaatgggcacccaattttatttttacatgcgtgaaaaacctaaaaacatagtattactccctccgtttcacaatgtaagactttctagcattacccacgttcatatagatgctaatgaatctagacattattatatatatagattcattagcatatatataaatatggacaaaagtcttacacactgtgaaacggaggaatgacatatttcactaggcagccatggtcaagtatcgtttcccacaactcacaagattttaataccattttacctctctctccacctaaagacttcttaccatctcaccggaaaacacttattgtcttggaagcaaatactattcttttgatacttctatcattcgaaacatataatccatatttagatctacaactgaaaattttattaactacaaaattatcgatctcatttagatgatctacaactacaaattgttgacctcgaagaaaaatgtaatcaactccaaatttgtatatctcgtcgagttatacaaatttgatataaagtttatcttcatccaacttcatatgaaaaacttagataaaaacagacatatgtaagtggcgtcattataggtgccggttttaattgtcgattggcacctatgaactcatagaggctggtaataaccatacataatacccatatatgacggttcacagtaaaaaccaacacctttaacatcgtttataggtaccagtttattataataaccaacacctatgacttgagaaaactattggtgtaggtttttttatggacatgcaccaataagtaattataggtgttggttcttaattttatccgttaaaagatgaaaaacgcttcatagatatcggttttagataccggtacctatatgaccggtctatgttgtgttctgcactagtggctagcattgtcacagggtaaaatgtgttatggcttcattgtgggccaagcatgatatggttgaacaaggtcgacaaggtgctgatcgagaatgatacgtgaaagccaatctaagcatagtctactggatggctaagagtaacgccatattgtcatgttagacatgaatgcatgatttggaatatgcaaactcgtgacttcaaggaaattagataatgatcttgcccatatatacaacacgtatacgttatgcatatacgtacattatactctaggtcacatgtaaccgtgtgtcaaagcaatagacactatcaaaatcatagtatatataagaacgttaagttctcacataaagacaacacaatatgggtatataactgagaagaattgtgtatagacaacctaactacttatcatgtataaaagctaataatgtttgatgtgcatgaatgttattaacggcttatttgtttcctgatgcataaaatgtgtcgaaaattttgttaggcgatagaaattgtaatatctcaatgctatacgtgtcaaacagaaaacatatttaattactgttatattgggcagtggctaccagctagaaggattcaataatctagtcaactagatgattctccgtactttgctgcggaaattactaagtaacttttaatattttttaataattaagctaaaagtaaaaattatattagttattaacaacaaataaaaactggtttgtcaaactatgttaagagagaaataaatctaatagactatgtatgagattgtagatgaaatatatgatgttgcacgctttgattatatggatgaatatatggtaaatattataaaaatattgtgaaaaataatgtgaagtaagataattgtatgttaatttgtactcaatgaattatagatgatgttgcatacttacataagttttgtatgtaattattgctagtggatgataaggtgccatatttgaatgttgagctttagaattagcgggttataactttatagtaagataggatgtggaataaaagttactattatattgttaacaactcatttttctctattttctttaatttttcctcgtacttttcatacttcccctattccccctaaattcgcctcatatcccccgccttcatgtttttctttcttttttcacctcacattttcaccggcccatgtgtcacaagagtgctcatgccggtccggcatctttttaggttgtgccttgactgaggccttgcacgcggggcggcacggtacagaccgctgctgctgtcatgccacaccactgtagaatcaaggagttgatttagattttgtgatgaaaatattggtggtttgctaatgttaatttggagattttataagatggttgattttgtgaagtggatgttttcggttgaccctggcggtcagaccggccgagtgccgtcggtcagaccgcaggtgttgcggcggtcagaccggccggcccgacggtctgaccggcaagatcctgattgatgtcggtttcgggttgttttgttggatttggatattaccttcggggatttggcttctagatggtttctatgcgtatggatactgttgttatactaatgtgagttaagttgggacgaacttgggctcggaatatggtttcttggttgttgcatgtgcaggtgttgcttgagaccttgggatagtgttgccggtgatagattattggagtcaacttgggagaagttgatgtccagggatcaagagatcatgcgggatactaaaggctagaggacaatgcacgtagtgatgaagaaatccatatggtatacaagagggattgtgtacgtatggaaagaggagtcaaatttggaagggagtccgaattcgggaagtttgattgagataaggaaagagatgagttgtttacttgcaagagagggtttcctacatgggttaggagtcctaagttgtgttagattcgtgggctttgcatagcctacctcatgtataaatagagagggagggtgaggcctcccggtatcgattttagagagactagagttgagagaaagttagggttttgaatttagttcgagattttggtgagaagtgttgttggtgcactttgtaaacactagttgatgcaataaagtcaaaaagtttcaatctacatcttcgagtttgtcatgaatcggtgtttctgggtcctgacggtctaaccgcacgtgcgcgtgcggtctgaccggtgggatagcggcggtctgaccagtgaggagttggcggtctgaccggcggcaggagggcggttcgaccggcggtgataggacttcatcgtcgtcttcgttcgagggtaatctttaattccgcaaaagatttttgggtttttggttttccttaccattcacctcccctctgataggttattttggtcttgtgtgatcctacactctccttaattctaagtatactatagaatatataaagaatctatagtatatttagagcctattgtagttcagctctacatcttggtgtgtgttgaaatgaatgatgagagggccatttataggtggaggtgccttgggaggatagagtttcttccaagcatccaatgagcatcttcatcctcctagtgccgggtgtccagcttatgatggttttcaccggtgaaaacggctataaccatcattggggagcggattgttgccgaacgcaacctgggcctagggcagcagcctctgtcatggttcggctgaactctggccagcttctttggctccggttttcgcctggacactcatttcgggcccctcattatattggtatggatgtttgtcccatttgaaggtgtttaattgggtttttgggtccaaaactctataagttcggatacgagtttgattctcctcctccttcttgtatatttcttctcgacttagatagtttgtcacctgcattcgaatatacaccaacactcatagaaattgttagaaataaaccctaccactatgttggatgttttatatttatggtcttatgcaagtattgacggtgttaatttggtacttaatagccatcaacaaacccacacacttagctctttactcgtcccgagtaaatgttgaggattaatgtggaacaaaattttcaaaaatataataaaagtacacaaactattctaagccataactgtacctataaactttgcagtgtataacttaccatcttgggtaactgatgaatggaacggttgtgactcaagtccttcatgtttctcctgtcaatctcttgagttttcatatgttttcacaaagtatctatactcctcaaatgactttctctcaaatcacgcatgtggtttaatttgtggatcctcaccaaggcatattttgccgaattgtccctattctaaaaggttgtatatgtggagcttggtagggatcaatcggggcatacctgcatcacatattttgcaaagccaaaaggtcggacccaaggagatagcgagttatactctctgatcaagaatgtgcatgtgtgtgatatgtgtatgggtatgtatgtgtatgtgtatagtatatttttggatggaaaaaggaaaataaaaaacaacaactcctttggtataccgcttcctccaattttctctctttggaaatttgagagagtgcatggctatctcctttttttttcatcatgccccatactttgtatgagcagattttttttctattttctctctctcatttttttttatcaatgctccatacttatatgagcaagactttatttttccttcttgtgcatagtcatgcatctctctttcttttttctttgaaagaattttggaggaagagacataaatgacatggagtatttattttgtggataatgaatataataaatgatggatgagagatgctaacttccagtgtagaagtttagcataacgtgcgtatgaggagtgtggtgtgatcttgatcatgaaagtatgaaaagtatctcacacaggtcacaataatttgacaaagctcaatgtaatgtcaagcggcctatacacatataaggttttgcaatgagaatcatatatggccttggtaggtaataatatagtcactaaggagtattgctctaaaagaatttttaattttcacaaaataaaatcccaagtatcatgaaagttggacatgaatttctttcgttcactagcacagaacctttcatctgtgatagccactaacatgcctggaattagcgggccgtcacaaggaagtcatctcaatcgggccaaaaaagcattcgattaagatatggtcgcacagacatattagatgggcataaaactcaggctcgtcatggatgacacctatccgtgacgggccgtagtttaggcccgattgagataacattccatatctcaatcgggcctcaagttggctcccatcacagatgaccatcatccgttacgggcaccaacttagggcccgattgagataacaactaggcccgccacagatgactcatccgtaatcgattgagatgacttagtatttttttctatttttcatatggaatgtttatatttgtgagtcgacctgtagcaaaataattaactgcagtataataattcattttattagtcaaaataatttttcgagtagtaaaggatttcaaatggaaaatttgtcaacaacaaagttgtataacttatcaagatttacaacttttattttggtcatttttctgtgtaaccttttttatcagtttaaatttgaatttgaaaatatgacaactttaaaacaacattttcaaatactaaaaagtcatcaacaaaaaaaaagttgttataacttatcaagatctataacttttatttttgacatttcttaatcgacaaagtgttagtaacattgttcacaaaactcacatatctctcatctg

SEQ ID NO: 60494 - DNA, 756 bp, Oryza sativa
cccccccccccttgagtgcatacactactcgtaagggcgcattacgacataataccgcatgatgcgccataggccattctggctgctgcactgtgtgggaacggcaaacggtgcatttctcttcgatagaacaccacttagcgcaaggggtgtttgcctttatgcgagacagtcggatcacacctgtgttattccttttgcgaagatgcaaaagtactggtttagagcttttatttcttaattgagaaactttatagtctttaagagttaccgggagggaaagatttttggtgcaaaaattttgtactcataaatactagtacgtgagatacaaaaaggtattaaattttaaagtaaaaagtgtggtaccttccggtagccttcttaagaaccataaaattaattttcttagtttggtgaagtggcattggtgaacattcattatactattggaagcaggagatgaaggagaacaattcaatgattcattggtctgtcataatctcatcgatcactaccactttatatatatggggatatgatctatcacaatgttagataggcccactctcaagaaagattagcattaaatacacggttctagtttttccagagctaagttctggatttaaatgatgggcttagatcatatgatatatagatcaatggacacaaatgctttacagagagagagagagagagagagagagagagatagagagagagagagagagagaggaccattgttattgaact

SEQ ID NO: 60495 - DNA, 727 bp, Oryza sativa
tttcgtcgacaaccgagtacataacatctaactcatctgcacaaggagctttatagcaaagatcatatgcaatagcaggttgttaaattagcaaactgctaaaacttttgcgtagatttagcatggctagtcgcacatgtcccacaaaaccacgtgagtttccgtcagcatgggctgcaagtgggttacgatctcttttttccggtgctaccacctagcgataaatcaactgctcgtatttctctctcttcttctctcaatcttctacctagaattgaggtaatgtggatcaatttatcacccgctgactcatctttattgtatctgctattaaacttctcgaatgaaattggataaaattctggatactcgtggcacgtttttaaaccgctaaacggtgcgtttcgtgaaaaaaaaattcctatatgaaagtggttctaaaacgtcaaattaatttgtttttcaagtttgtaataattaaaacttaattaatcatacattaataccaccttattttacgtaaaacacttaatctttatcttcaggagaaaataacaccacccgagggcatgcctttacattttcagcagcacttaaaacaaaatataccatcgatgcaaccattatatatttaaaaataaatctatttgattttatatggtttgaggagaaatagttgattcggtaagcctattgcctaattgcacaaacgacgacgagcagcagc

SEQ ID NO: 60496 - DNA, 1252 bp, Oryza sativa
ctgcccttcatccaaactgtatcaagataatccttctatggctcaaactacatgggttctcttcccctattgaacctggggttaattggatccatgccattgcaaatttgcctattcagaaaaaaaccattacaattcgtctatttatagccgtgccattgaaattttacaaaattagaaccgtgacactgccgtcatgttttccatccatctcctttcttttccgtcttcttccttctttctcccgtcttcttctctatgagcaggagcagattttttcgcaaacaggaggagatgctttctgtgaaaacaaattacattcgcaagctgaattacagaggaacggacttgtttgttctgctgatcaggcagccttgggcagccggatagttgtggccgccgacggcagtgacggcctggccgccggcggggacagggatgggcacgacgccatgcgtgagcatggactggtagatctctacgagcaccttctcgccgtactccttgagctgccgcggccgcacgaaggaatactggcccgcggtgcagtagggcgtgccggcgacgacgccagccacagcatggccgagacgtaggcgtcgtggaggagcacgagccactgcagcgacgacagcacggggagcaccctcctccctagggctgtgctgcacgtgccacccatggctccgcgtgtggcgagggccctcctgctgctactgcgtcggcgcgacgctgtgacgcactcctccgagctccgcaatggggagcgtcgctggcggcggcggcgtcgaggcggtagtagccggcgatctgggttccttggtttgctctcttcgccggcgatctagagaggagagagaagactggataaagaagatgaaaaatcaaggagatggatggaaaacatgacggtagtggcacgattctaattttgtaaaatttcagtggcacggctacgaatagacgaattgtaatggcatttttctgactagacaaatatgcaatggcatgccatggatccaattaacccttgaatctgtgccttacctgaatctcgagttggcaaggttggcatctcccttcacctttttttttttcaatgggattctaaggttatataagcattttgcatgtgttttattgtattgtttatccaatttctcgttccattctactcataagatagattcttgcagtatttcatcataaaaactaatgtcttgatgtgcaaagctggatctacatgaattca

SEQ ID NO: 60497 - DNA, 19513 bp, Oryza sativa
gaattgaactcgacgatagatcgggaattgagatcttgagatggcacggacactagacaacaatcaaagaaacaaatttcgcaattagggtttttcggagataattttcccgctaggcgccacgacggaacgggcgctacaggatccatgttaaaaattcccacaattaccacgttctacgctgactgcatgtgccaactgctaccggcaacaaataattcttttctcagttgagttcaactacagtttagacttcgatttttcctctgacatgtgccacagtaaagtatatcaatctcatcgtttggctgtcacaaacggaaaataatttgtgaataaaacttttatatacgtgttcttattgatgtaaaagtaaaaactgaaaaataaactttgataaaaaaacctaaaatcagttttaaatttaaaattaaaaatttaaattttggttgataagtataaggataagcgacaaggcaaggcagtatattccgttctcatttttcatagaatcgattgtagactcactggagcagctattagaaaatgcagctagcttatcaacgggcaccagcaccaccaccttagtcctgccgtcgctatccgcccgtggctggcgccgtaagctgtatcagccacccaagaggcaggcaggaaatatggattatggaataagcgtggaaacgagagtaaccccgaaggcgactgatcggcgatcggtcgatcgatcgggcgagaggaggagagagaccggttgtccattgtggtttctgtcgcgacgaagcatccaagaaagagggagataggcatcgatcatccatcggcatgcgtccgcacgaggtcgtccggcccccatgcccgcgacctcacgctcaatttttcctccacgaatggtcagcacaacacgtgaggatttgtcgaaaagtctatccagaaccctttttttttcattttccttcgtttattgatcggatggatagcgacagcagtttgttcttcctcctctggtcataactcattaatctctctatataggttttggtttgatcattcgttggatccagggggcaggttcagtgcacccagagaatggttgggcccaggcgcagctgggaatccgtttcggtgtccagacggggcaacgcaaaggcaaacatcttcttctgtctttctttctcctttccttttttttttttttaagaaaggaacatctgaactcttcataaactgacaaagttcttcttcgcaattcatccattcagatactattagcgtagtgcaatcaatcgatattgaggtgcaattcgaagttctcaaaaaaaaaaaggtgcaatttgaattactagtaggtgctgagatgcaatgtcaacccctctgaacgtacgacgttgtaaacttctaaactttaatggagaagagcagcgatgacgatctctctctagaagagtccacacctcaagttttactggtggtattaactggcaactggcaagcaggtagtagtactattcaatgacaacgatgctgtcgcgtgtaaatccacgtggcatggtaattttccatgaaatggtagtttgagcatgtggggaagcgtacgagctcaaatcaaattaggaaatcaccctgaagtttcacctgtcgcccctccctctcgattgcgactagattgccgctggtttttcttcaaccgtggagcattgacgggtggagtccggcgagtcatagacgaagaattgaatcactttagattcggtaatctaaagtgaaacaaattcgctttcttgccctctctcgcgtggcggtgtgtcaaacctggaaagtccagtggaaagaatttcgtgcgtgcacacattttaatcgcgttcgtatatgttctgtgagaatagtttcgtccgtcttgttttctcctgcgtcacaattgtcccgtattatctcatacttcatcagtgaataatttcatgagtattgttgactgtagtatatacattagacagggtataagctactaaagaggtgccccgtacgagaaaatctaaaactaattaacacttaactcaaaagctataaaatcatttgtcatgtagttagatgctgacgtttaggctacagtgttgcacccaatccaatcgcaaaacaatttagaaaccattaattaaatcacgtgggggataataacgcaggaaagttcaacgaaaccagaagcgagacgacaaaagacgacgcactcccactctactatatattctggcgcgaacccgactccctccacaattccgctagtccgagtcaaaacaaaatcaaattcaaattcacgggataattcaaagatgctgcttaatccggcgtcgagagaggtggccgcgctggacagcatccggcaccacctcctggaggaggaggaggagacgccggcgacggcgccggcgccgacgcggcggccggtgtactgccggagctcaagcttcggcagcctcgtggccgaccagtggagcgagtcgctgccgttccggcccaacgacgccgaggacatggtcgtgtacggcgccctccgcgacgccttctcctccggctggctccccgacggctcattcgccgccgtcaagccggagtcgcaggactcctacgacgggtcctccatcggcagcttcctcgcgtcgtcgtcgtccgaggcggggacgcccggggaggtgacgtcgacggaggcgacggtgacgccggggatcagggagggcgagggctaggccgtggcggtggcgtcaagggggaagcactaccgcggggtgaggcagcgcccgtggggcaagttcgcggcggagatcagggacccggccaagaacggcgcgcgcgtgtggctcggcacgttcgactccgccgaggaggccgccgtggcgtcggaccgcgccgcctaccgcatgcgcggctcccgcgcgctcctcaacttcccgctccgcatcggctccgagatcgccgccgcggccgccgccgccgccgcgggcaacaagcggccatatcccgacccggcgagctccggctcttcttccccttcatcctcttcctcctcgtcgtcgtcttcctcctccgggtcaccgaagcggaggaagagaggcgaggccgcggccgcgtccatggccatggcactggttccaccaccgccaccaccggcgcaggcaccggtgcagctcgccctcccggcccagccatggttcgccgccggtccgatccagcagctggtgagctaagtggcgatgtggtagtggtagtggtgatttagccatcttgtgcgactgtgcgtgatcgattgctgcttgatgggtcgagcaagttcagaacagagcatcactctctgcagaatagaagaagttcatgaacagagcaatgcactgctccaagaaatgtgacgagttccaggcaatcacgccattgttcttggatgattgcgcagcaccagaaaaaagggaaaaaaaagattgtttgtgaaatgtggtgaggttttgtaagacttgcacaaaatttgagaaaaagaaaaagatcaatacatataaaatcttactagaaaaaagactttctcaaaccgtttctagaagggagaatactctttggtctttggtataacagtcgcacaatcggacattcctttcaaactatagcaggttgctgttttatcgtttagcgaacgtcagatctcattaggctgcgttagagtgagcgagggtgaaacggaaaaaattttcattcttttttcgttttgtggatcttcttctcttttcacttccattcaaacacaccctaatttcaaccatactatgcaaattttattttgaatcaccatttattatatttcaccttctgttattttttaaccaatgttttcaccaaagactagataaatttgtcctttttcactttggactatccaattctcttttaagcatgtgaacgatctcgtcaattcttactcgtcaatgaacttttacaactatatgtaaaatcatttatttagcatatgacaaattgaatgaaataaataaaagaattaaaggtggtctaaaatatcgtatagataaaaaataactgatttaaagtgaaaacatttattaaagggtgatagaaagcgaaacatcaataataaaaagtgatcaaagtaaagtttactcttaattgcaaagagaaggcgcaacaaattctaaatgagacaattgcgaatctccatcatgatgtaacaaacattacatatatcaaaggttgcaaatgaattgtcagttgcaataattaattactaccaagtgagattcagtccaggcttactggggaagtaggtgctagaagttcagagcgttcatctcactggtgcattgatgcaaaaattaaatttatgaaaccatgtttgaccgaaatggaagatagcttgtttgactgataaaccatgggatgagagaggagaggaggtacccattgaaactgaagattttgttggggtcaacagatggagacctgaacctgaacaacaaaatcaaatcgaattagctaatcctacatgtcatagcccttaattaagttaattgcaaaacggtcggcacgtgcaatactggcacgcactagcggattaaccattttttttgaacgcagcgaattaactaatcacccagttgctgactaaaagccgtcgttcggtgcgatctggatggttggtggagcaagagggcaagttgatgagcacaaaggactgaagatattctttgtaattacgccgtataaaatatgattgacaagaaagcggccaaatgcaaggtgtttaaagaactagcccttgtgcttatccatgataatggagtgtcattaacagtttgatgtaataggattgcgtggatttgatcccagtcgtaatcaggtgtcgggcaatatgcccactgcccataacaagttcaaggtgtcgagtaggaacggattaattctctggcttaactgtatgtcagttgcagttgagtaggatctcccttggtgtcgagtagtattgtagtaagacatttttctttgagaaaattttaaaaaataccattaactaatactcaaatccaaaaaatgctatcgatgaatgcgagtttcataaaatgtcatcgcaagaacgattctctcataaataccatcgatgttagggtttcattcatcacacgccgttcaatgtattgttcatcctatagtacttaatgaatgtctgctaaaggagctctaacgacgattgcatttctgggacaaagttacttgtattttgatatttcatgaaactcgtacttattaatagcattttttttaaattaaacgtttgttaatgttattttttggattttttttctttttctttcaccggctacttatgagtttcatagtgctagtgcaatatgactctcacctaaaatcatgcactaacctggtgatgaaaaattgccgaaaaacaatgtatatttatactcggataaacatttagaggccgggtttggatactttgccccacaaacgtgtagaggccgggtttgataatcctttatctaaaaaaaattatactcggataaacagggaaaatgctttggatactttgccccttctcttaagcaagagggtgcagttgcacattggatttggatctcttccaaatttccaagttcacaacagagattactctcgccatcaacctagctagccggtcttagctagttggtgacgcatcaaagtgatggcgacaagtgatgaccagtccatggtggtgcgcacgtgcggggagccgaggccgaggagcaattgattggatatactccctccgtcttaaaaaaaaaaaagcaaactctggatttctgtgtccaactttgactgtccgttttatataaaatttttttataattagtatttttattgttgttagatgataaaccataattaatattttatgcgtgacttgtctttttaatttttttataattttttcaaataagacggacggtcaaacgttagacacgaaaatcagggtttgtctttttcttttttttttgacggagggagtactgatgatcacgaccattgacgggtgctctttgtcatgaggccagccagtaggatccagacacgtggataccctacactcccgtcttgttcccaactagagagaaccaaccggggcaaagaagcaggcagcaatttcaccaaacgttccaaacccaaatcgatcaccaaacgcccaaacccttgtgggcttgttgctgcgctgcacgaggtgttggcttgtttgccgcgcttgggttggtttgtgaattgtgatgattttgcggcttaatgcttctggaaaaagaagcttttccaggtccatttcagtttcagcggtggcatggctagctagctttccagggcagcaaaccgcaaatacggagtagaactgtagaagtgagtaggcgtaatccgtggccagcaatatccgagtcagccgcgcgtaatgagtgcgtggcagggcgcaggacacgcacagcaggcagatcgacgagggtcgaaaaaggacaagtcaagaagcaccagagtgactgggtataaactggatctaaaaaggttgagatgaaatttaatactccctccatcccaaaatataaatattattagcatagttacaatttaaacatttataactttaatcattaatagaaaaaaataaaaaatatcaaacatgtaaaattgatttacattgatgttactagatttatcattaaacaaactatcataatatgtaactctttttatttaaaacatattatttttatagatattgttggtcaaagtagcatctcgtagaccgtgtcagggtataaaaatacttatatttttggacggagggaataggtttttgagctaaaaatatttgagagctaaggtgatttgtgaaagggctcataggctctaaccagttggatggtgtcaaaacttatatatatgtaaaaaaaaagtttgctaattggaagtgattttactttctttttgaaacataaacattcatcaataatgacagatttagtggacaagccctagttgtcagagttagctcctttcaaggtgaaaggtatatatgggcatgtttgaattgaggtcaattgacctaccaatttatttgtttgttttgaattgtacttgctagctatttggattgagaccaaatcttgctaattcagtaaagttgaaaattttggtagtaccaaattttgtctaagtttcaaacactacaaaattttaacaggacttcaaaccaaaacaaacctatatgggctgatgggcttttgattcagaatcgcgaagcgactggtgtagtttagaattttagacaacacatcacacagcgttggatgggagagatatgtttaggaccagagagtatttcacgattcttgagaagaatatgaaaaaacatcttcaccatctccccaaatagaactgagtacgcgaccatcacctagcaggctagcacgatttagaaccatcttcatttagagaactttttataagttatttgctcgctttctattaatccatatgagctactttattttgtctatattcttttttttaatggaaaacatcacagtagtgccttttcattgaatagagcagaagaaaatacaacccctaagggtaaagaaaagaaactttgagctacacactatacaatgtgcgggacgagttcacgcaatcttttagcccccgctagagcccatagactagcctcctccttgattcgtgttagaagaaagcctattgccgcctctttgtggtcgaagatctgccagttcctctccttccagatttctcagacgactagcaggatgagaaatcggaggcccttttttggacgtcgggtgtatttgccaagctctcccaccattggtggactgaccggggttcctcccactcagtcggctccaattgttgatagcccatccaagtagcaactaggtgccaaattctctttctgtatctgcacttgaagacgaggtgcagtcccgtctcagcttcagaacggcagagagggcaatgtccatttttttgccagcctcttgttgcaagccggtcagatgtctagactctattttggataataagccatgcatgaaatttatatttccccggcgcccagactttccagatcagggagtttagacttgagtttggcacccctaaacactgtgcatgataggccgaggaagctgtgtagtgcccattacttgtgaatctccaggcaatctggtccggttcttcactgtctagttgcacattccgaaccgcttcccacaaacggaccagttgctcgacgaggttgattgtgataggcgaggccgcatcgagggtcaggtcattcacctaggcgtcaccctctttcccttggcgcagggattttcttctatttttggagatcccatagacaagtggcatgagatcttttggtctttgcccatcaatccatgcagagtcctagaagcgtgccgtattcctatctccgacggttatctttgtcgaagcagcaaaaaagtccttgtctaatccatcacaaggcatctccagtcccacccacggtttggttgggtccttccattaatatcataacaatcgcaatctcaaggcccttgtgaacttgtccaagtttaggactcccaagccccccccccccggctgatcggcaggcccgtctttgtccaattgactttacatcccccccccaatcgtcaagttagaacatgctattatttcacaaatggacctcaggttggtgcgcaccaacatcgacatataatgtgttggaaataaggagacttgtatggacctgtaacgcacatatgataactttagccatctgcgttgctaatgtataactctatagaggttgatgctagagctattggtgttaacttcttgtacgttgatgccacctttaggtttatgaaaactaaatatgtagatttatgctgctgtgttctgttgtcgacctcttccctatatgcaggccaatcaccataatagctacactaccaagaaggttgacactaacgatttataggtagactctctggttttgatgtcaatgtgaggtccaaacttggaatatattttgtagaattactttttgcaaaggaccaagatgcaaaaatgtcgctcaattcagcaacaatcaaactctactaaagacaagcgtcggtcgtgctcacgtacgcacaacccactaacccatcttcttcctcgctcatccatttcctcggaccaactcggcacggcattatcctctgcgctccgaaccacattaatcacctaccatggattcaggggcgaagccactttgggcggcctgggtgcccaggcaccccccagattcctaaaatttcttagagatgaacaaattttggccctttaggcacccctacagcccaataggaggcacccccaccagaccttgaatcccacgatgccacttattcagcccacgacgcatcagctgcccaactctttttctcctcacgacgacttcgcgagacgcgccgtatacgccgacgcagcgacgcatcgactgcctgcccttcctcccgactcccgagtcgcgacgccgacgcccggagcgagccgctgcccacgaagacaggactgcacgaagacgaagccgctgcccacgaagacgcatcagctgcgcgtgcgacgatcgtggctgcctgcctgcctgcctgcctcgccggcgttcgacttcgacgatcgacgttcatctgatcatctcgccgatctcgtcctcgtcagcgtcaaagactcaaagagccgctgcctgctgctcgactaactagagtgagtgttcgtcctctgtcctcaaggatcatctcgccgatctcgtcctcaattaattttttctcttttgtgaactgcaatttatttatacaaaataatgaattataggtagccatggagaggttttataaacctaaacggaaagctcaagatatgatcgatggtaacggaacttcatgtccggaagagatcaattgggatgaggagattaaatatgatcccggattgaggaaagaaattgatgcttaccatcctaaccacagagaaaaggtgagaagaaaatacttggagaatggaccttgtcagcctcgcacatttgattttcctattacacaacttggggggaaagagaaacctagaagatttaatccagaatggtttgatgagttctcttggcttgaatacagtaaggaaaaggatagagcatattgcttttattgtttcttgtttagagaaaagaaagatccaggatatgatgcatttgttgtcaacggttggaatgggtatcataggaaagaaaggctaagatcacatgttggtgaggttggtggtttacactataatgcaatgaagaaatgtgatgctttgagaaatagaaagcaacacatagatgttgcttataatcagataagtgaagttgctaagaaggcctattttattcggttgaatggttccattgatacagctagagtattgttgaagcaaggattgccttttcgtggccatgatgagtcaaaagaatcctacaatagagggaattttaaggagttctatgattgcttagcagaacatgatccaattttacacaaagccgtgactacaaatgctgcaaagaatagttgtttgtatgctcctgaaattcagagggacattgctgaatgttttgcaaatgagattgtacagtctatcctggatgatcttggggatgatttcttttgcttgctagttgatgagtcaagagatgtttcttgcaaagaacaaatggctgtggtcttgaggtatgttgacaaatttgggatggtgaaagagagcttcgttggccttgtccatgtgactgaaacaagttctgcccacctcaagtcagccattgattctcttcttgcaaagtttaaactaagtttaaagcaatgtcgaggccaaggatatgatggtgctagcaacatgcgaggtgagttcaatgggttgcagtcattgatcatgagagatagcaaatcagcttattatgtgcattgctttgctcatcaacttcaattagttattgtggcaaccgtgagaaaacataagggcgttagcaattttttaaatatgatttctatcttattaaatgtggtgggtgggtcagctaagagaagggacatgattagagatatcaatcatgaacaagtgcagcaagcattaggttgtgggcaacttgagaccgggacagggttaaatcaagagcaatgtcttcaaagacctggagatactagatggagttctcattataaaactctgaaaagtttgcttaatatgttccctacaatagttcaagtgctcaaggttgttgagaaggatgacagagattggaaaaatagagatcaagcatcaaatcttttggtatacttccaatcttttgactttgtattttatttgcacctcatgttgactacattagctgccacaaatacattgtcgcaagcattgcaacgcaaggatcaagacattgtaaatgccattggatgtctgaaatcaactaaactccatttggatgatcttagaacaaatggttgggaaaagttattagatgatgtgaatcagttttgtgacttgtatgaaattgatatgatggaaatggaaagtacatatgttgatcccagacaacctaggaaaaaatcaggaattacaaacaagcatcactatgcagtggattgctttaatgatgttattgattggttggttcaagagcttgatagccgttttagtgagacaaccactcaattgcttgtttgctcagccgctttcaacccaagagactcatttcatgctttcgatggagagacttttatgagcttagcaaaactatatcctgatgatttcaacaatgatgatctgagggaccttagacatgaccttcgcctttacattggtgatgtgagagaagacaacgaattctccaacataaacactattgctgagctatctcaaaagatggtacagacaggaaaacatcaagtgtatagattggtctatcgacttttgaagcttgtgctagtattgcctgtcgctacagcaacagttgagagatgtttttcgggcatgaagattgtaaaaacaagcttggctaatcgtatgggtgatcaacaattgagtcatagacttatttgctatatagagaaagaggaaatgaaaaaagttagcaatgaggctgtggttcatcgtttcatgaccatggaaggaaaagggcgcaaatatgatctctaagaagtaacacaaatgcaatgcacctactttcgattgataattgtacatttttttttgctaaatgattgacctatttgttctctttttttaggatccatcacatattttgttataagggacatctttgtgcaccacaatcatcaatggtgtattcttttattaatagtgagtattattgtccattcccctactagtttactaatattttcacgaaagtcactttgccattactgaaagtttaattttgatgttaaaaattatgtgttagctatactatttgcttgaacatcacaaaagacattatagtcttgataaagttaggcaccccccacccatttgctctagcttcgccactgcatggatttgcttcgtgtctcagtaaacaccaaccgccacgcacccacaccaagtcaccaactcctcctcggtcctcgccttttctcctcctggcgaaagagctgccttatctagcttccacttccctcgtcgtcattcgtcaacccggccgaccagaagcattccagaagctaattgagcaagcagtgatagagaacaaaacagcggcaaaagattgcaaaaaatcgctttagaaacatagcattaccgcgataattcatccgtgtgtgtgtggattcaaatgccagcctttgtgaaaggtgcggcgccacgcaattcaagcctttttttcacaaagcagacgcactgagacgcgaaagccgggggacagaaggggaacagtggaaggtgacaccgggacacgtacgcaggtccgcgggagctagggataagcgtcgccgtgtttctgtacgtacgtacgtagatccttcgcgcgggtgagtcagtcggtcgatcggtgatgagatcctctcctttttccagttttttctcgacgagccgagccgacagcccacgattcagttcgcaaaggtatcagcgattcagcgtcgacgagacgatgactcggcgagcgaggccgacgaccagtgactgcatggagtgtacactgcaaatggaaatcgggctctttactactcctacctatggtcgaatgatttataactggaataaaaactgagttagccacgtggccgcatggaagcaggcatgagttaacggaatccctaaaatgcatgtgtcgcgttctagttcgtatctacgcacctgaatatgcgacatgctccttcctcctccttttcccaccgccctttcctatcattcgatcttcttttgcctttcttttgttcgttctccattgtgctgtgtccataaacaacaacgcgacgcggccattccgacgagagcgccgataccgataagtacgtgccatctttgacgccacactacactacacctagctcgcctaaaacctatacttagcttaattagcttccctcttgctccatcaaatcacctcccatatttagtcccacatcgaccgcgcaactccactccatccgacctaagactcgatcgatcgggagtgtcgcgcttgcttcccacgccggccgacgaacagaaggaaaccggcagtgatatatatatgggcgccgtagcgtcgcgcgggcaggaggacgccgcgcgggtggccgcggggcgggagcacatgaagcggtgcagggagaggcggcggctgatgcgggaggcggtgcggctgcggcgccacctcgcggcctcgcacgccgcgtacctccggtcgctcacccacgccgcgtccgcgctctcccgcttcgcggtcggcgagccgctcccggtgtccgaccacgccccgcccgccgtgatcgtccaccgccccgtcgtcgcgccctccacgccgccgccgctcctccgctccatcgagcagcagcagcagctgcggcggcgcgcgcaggagttggaggaggaggtcggcgctgctgttgatgatcatcttgttggcggcggggccggggtgccgtcggtcacgcgagaggaaggcggcggtgatgaggagctgaggatggtggtgaggcaccgtagcctcgcggaggtcgcggcggggttggaggagtacttcctcaaggccagcgtcgccggcgacgccgtgtcgagccacctcgaggccagcaacgacgagttcaagcgtaagccactagcaactctacttaattcgcacattcacatttactgtacatgtggccactgcctcactggccaatacaaaggtgtgacattatgatcagttgatcacttaaaagtaaacactgacagagagcatgagttgcagagcagaaagttttcttgccactgatcaccaccaaatgaattgattttgttgcaggtggaccgcacagcatcttgggcgcgctttgctgcctgtcggcgccgtcggttgcgcacgaccgcgtcgacagcatcaatggcgagcagaggcatagctccaacttgcagcagctgctggcctgggagaagaagctgtatcgagaggtcaaggtaatgacaaaataccaaaaaacacatggtcgaatcaaaactactagccgtcataccgtacgtattaccgtgcgtgttgtaacttgtatggccagtagagtgatttgacgttgcaatgcaggcgagagagcggctgcaggtccagcacgacaagaagaaggcggagctgagtgaccaggagtacagcaggaagatcgacgtggacgtcctgaagctcaaggccgcgtgggagaaggcgcgcgcgcagctcacgacggcctcgcaggccgtggccgcgacctccgcgtccatcgcggagctccgcgacacgcacctggcgcgccagctgctggggctctgccacgccacgctcgacatgtggagggcgatgcggcagcaccacgaggcgcagggcctgatcgcgcagcagctgcgcgggctcagcagccggacgtccatggaccccacgacggagatccactacgagaccacgcgggcgctcgaggtcgccatgtcgtcatggtgcgccgccctgggccacctggccaagcaccagcgcgactacgtccacgcgctgcacggctggctcaagctgacgctgcaggaggcgccggccgtcgtcgacggcgccgaggcggtggcctcccccgtcgccgccgagctcgccgccttcgtcgagcggtgggggcaggcgctcgaccgcgtgcactgcgccgacgtgctcaagtcgatcaagagcttcgccggcgccgtccggtcgctgtacggtctccagagcgacgagctgcgggtagcgcggcgcgtcagccagtactcccgcgagctcgaccgcaagtcgcggatgctgcggcaggtggagaagagctactacgactcgtacgtgccgccgatgggcctctcgctgtggcaccgggggatgaggcattggggggacgacggcatgcacgcgcgcgacgcgagcaacgaggtggcgcagcggagggacgagatagcggcgtgccggaggacggtggaggacgagatgcggaagcacgccaaggccatcgacgcgacgaggtccgcggcggtgacctgtgtgcaggggaagctgcccgccgtgttccagtcgatggccgtgttctcggcgtcgctcgcgcacgcgctggaggccgtgtgccggcatggcacccatgtgcagtagttagctacacatagacacagttcattcgtttgagtcggccatctccatttcctttttccattttacttatctatacgaccatacagtatacactatacaccaaagatatactccgtatacacgaaaccctgctaggatgtaggaatgtataaagactaaataaaaatcaaggccctactgagtttttacttttgaccactagatagggcttgggacctttggaaagggggggggggcatacgggttttattttagggaaaattgaaaccatgccattataatttggataagcttgacattgtgatccgttcatcttgcatcgatgtataaaaacgacaaggaaatcatgtataaatcgctctagtaactaagtactccattcaaaaccaaaacaggaagattttaaatctgtgataacctctcgattgacaaaacgtgaatacatcatccaaacacattggtctatgatctaaaacccctgcaaagagcaagcaaactacttttattcaactgtagttcctcatttttcccccttcggtagtatgcctatggaaatgaaaaaggtctaacgctcatttatcttacacaactttcgaaagagccatgacgttgaagttcattgagtcagggttggacgcaattctggctttgatgacttttgcagcatcctgagaagaaatcaaagcaaattaaacttcactcatggttaaatatcaaaagaagaagaagaagaaattagaaaatacaccctaaatccatggatcataagcattccgaatgtaaaaatgctaaaagttaagttcagtgcatatacattttagcttgtgcccccctaagcaaatataatgtataagttccatttgacaaataattacgattattcatttcacaaaaaaaactgcttgcactaaaataagggtagaaatagaatgtacaagaatcatttcaaaacaataggtgataaacaagcaagatacaagaaaaatgcaaaatttgagacctgtaacaaagtatctggtgatgaagggccatgacatattggttgcgattttcgtccatcaagctcataaagttcacctgttgcatgccaaaaaataaaatgttgggaacagattattgatagttgaaactaggatttgttttttgagtaaaggcagtcggatacccaccatcaacacaagagaaacatacaaagtgctcgttcacctcaacattagcctgcaaaggaaagatgattaggatggcagcaacattaaggactatatcatggatatgggcaattagtaacatttcttatcttctcccttttcttttggctaaaggaggttggtccacaagtgcacttatgtggtactgtggtagcatatttggttattcattgtaattgtgatttaaagcaatcctgttataacttataagaacatccctcgtaagttcaattctgcaatatgagcttgtaaaccgagggcaggaagactctagtataatggcatcctaccagcagcatttaccatctcaaggagttattcgaattaaaacagtaagaaattatgatggcaagagataaatttatctaatctactcaacatgatgttgtttaaaactgtattacaaaagtgaacatatagaaaaggggcatgcgagtggttacatcagtgtcgccagccgaagcagcaacggaatgagcatcctccatctcatcatcctcctcaagaaaggcagcacgctgaagacaacaagaactgttcatattaggataacaaaaaagtttattagtgattaacacaatgaatttaacatacagacattacctggactggatccatatcaacagtttgtttataaaatctatcaaaataggatccctcaactgcaaagaagaaagcagacatcagatcttgttacaaataaaaacagtaagaataagactaaacaaattaggtcatacatccatgtttaagccaacaaattaaagggcagcccaataaccataaattgattaagcatgccaaatttctcctagacatgctggttgtctaatatcaatgtccttgtaccattttttcacatcatcgcatcaaagatgtgtacatttcagtaagaaagcaaaatggggaacactatgaagtatcacaaatcaagcaactatattttgctgaagaaggagactgagaagtgaggacagaatagacatggataccttttcttttagaacaacaggcatggatacttgctttttactgttcaagcaaactaacataattggatgaatatgaatcccttgagcaaccttttaaaatatctattggattatttctatctgatagtttttccttatttactactatatagagagcactttaggacagttaatgactcaatattaactaaccggaggtactagctaagcgtggatacaaagctaaagtaattacccagcttgagtttggatgcagcattccctattgcatggataacaccaactgttccgcatgcgttgccaacagtctgctttgtaaagtataccctcttgctcaaatcctgcatatcaaggtattgggttaagaaaatgaagggtatataaagttccaagtaataaataatttaaaatgtgcacatttcaaactggtaaacttcaaattggcatcgtgcattgagtgaaagtagatatccaacatatcatatacgtcaacactcaacccatttaatatgccagatgaaggaaacagaaaccaacaccctaaaaaagggaaagcaggctagtatttctcaattagaatatgaatatggaacaatattaatgaaccaaaaactgaatgcagtacataccataaaagtctcctagtaaaatgaaagctgaaccatagtttcacagtgagtgcaattttttatgcactccctaagaaaaataatggtcaggacaaggaacatgcacaacaatcaggccatcagacaatctatacaatcatcacagttttactataaattctgccacatcttgtatatgtgacaaaatgctttttctgcaaataaaacagcatcttaaccagttgtggaacatctaacttgactcatgactatggtgaagtgactctacatcaggtcatctgcagtagttgtagagtcatactgtacaaattaagatgcagtagttgtagaatcacttgcatgaggattgaacttccacatcaagatataacatgagaattggaactgcagtacatccatagcagcatgtcaattgacaattgatttatagttcaaaaagaaacataaattaggcaattgatctaaaattgattgggcacacagatttaagtgatacagtgtagcatatcatgtttacaaattccaagttacaaaggatagttaagtccattgaccatttgcatgcatcctcattttttttacatagcacagtagttgtatctataagtactgcaagagaatcaatactacagcaaatccattacaaaaatagaaaggaggagaggaccatgtttactgcagagagtagccacacacccaggtgttctgtattgttagtaaaaggctaaaagcacattgatgcaacctataatgtaaaagaaatttcac

SEQ ID NO: 60498 - DNA, 955 bp, Oryza sativa
attcctgcagcagtttttgatgccccatgcatcctctgccttttaaaagaacaggtaaaaattcatatctggagtacttactgtaattgctgctgcaatctaatggctttccgggaaaaaatcgcattaagttaaatgctttggacatactcggtcttaatttttctctgcagtgcgtatagagcatttaacttctgcacaaactgacttgacaaatggtgaccactggtctgcctggccacttttaaatgcacttacattgcacggctttcacttaatatgtaggtgttttgttactgtttgttgatcagaagttcataacacaatcatggctttgcatactactagctatagggggtaaaccctttcaaaatgcactgggagggcacagttgctaccctgctgatctactctgtcatttatgtcttgttcacatcacccgtaggagccaggcggttcctggaactgcgaggtctcccttgcagaaacaaataagatccaagcaagatctttagctttgcaattggtttgttttgaatgaatggtagcgactctaggaactgcaatatttatggtgcaattttatgatcatacgttacccattttatggtcatttcatgatgcatcactgggctgctctgcaggatcagctgaatacagtggtgggggagcagaagagcattcaacaaaatctggaggacgttaagaagaagaaactaaagtatggtaagtctttgaaagctagtgccatgaaaaataaagataagacattgatgcaagacttatactgtatttaatggcatgtttagatccccttgcaaaaattttcaccctgtcacatcgaatgtttagacacatgcatggagtattaaatataaatgaaaaaaataactaattacatagattgcgtgtaaaattgcgagacgaatcttttaagcgtaattgcttcataatt

SEQ ID NO: 60499 - DNA, 669 bp, Oryza sativa
actctggagtatctcatttcaaatcgtggcgtctctgttttattgagctatagcggtatactatagccttctttcccctgttcgcctacagtttttcaactttcaacaactcccgagttgatctttgcgtctcctattagttccattgtttcagcactggagtaatagttctagctgctgttcttgaatccttttatccacgctctctacacattttttttgacgcctctgttcgtggcattcgtcgtgctgcagataggttgattcaccatgggccgcgcgatgaggtggttcaagaaggttctcaccggcaagaaggaaggaggagacagggatcggaaggagcacagcgccgccggaggcgccaatggtggcgtcgcgccgccgccgatggagaggaggaggtggagcttcgctaagccgaggagcagtttcgctgacggcagccgcaggccctcggtcaccgccgtcgtcgccggcgagctctcgcaggtccggccatgcagctgcggccagcaacgggaggtggaggcggccgtcatgatccagaaggccttcagaggatacctggtacgtctcccaagtactggtttggtgacttgattttcccctgaaaatggagaagtttgttctgcagctgctgcatgtgtttgaactttgaacattagc

SEQ ID NO: 60500 - DNA, 9381 bp, Oryza sativa
caattcctgagaactaagaggctaagaaaattccaatttctccccagtcccaggaagtggtggagagattcagcaccttttaagcccaaatgctggtaaatcccaagcacagaacaactataccagtgcaggtgatttatcatatgaagggatctccagttgctacagtttggagcaagaattatcatcctcagtcagtttgccacgctagctatatatgtaacatggagtgttgagttatcacatattttctacgaagtgttatgttacgtagttcagtccagagaagagtttttgcatgtttcacttcctgtatacttgcagcatgtatgtgtagcccatgtgagttgatagaatgacagttgtattctactataattatttgtgatcaatatccttgtaaggaatgacatggtattgtaatattgtatttaagctacggtggcaaagtgaacaagttcagtaataattttattactccattgccaatgtcttgctcagtaagggtcaccaataggtatctgactaataactcagtttgtagtatgctggatctttttttccacatagcagtgacatcgttaatacggagtattatagagcttgtcggaagtcagaacttggaactcagagaacgttccgaatgcctttacacaaagtataaatggcacggttgaaattttttatttcatcacttgtccaaaaaccctgcattcataatgggaactgtaaaattgtttggatttggtgggataaggtcataggaattgggatatatatagaggaaatctaatttatggtttgattgaggaataagggaaaaaagtgaagggttagaatcagtccacactccacaccccatcaccatctctatcccaatagcaaaccggaccacaagtagtagtaagtacctatgctgcaaacaaaaatgctattgtctttggctccaaattctctagctttgcaaaagacagtttagtttaccaatggtgataatttgactatggagttaaccataccagtacaattagacttaaaaaaagaattcaaacctagattatgcacacaaccactaacacaccaagcaaaacaatggagattgccgtttgacaagggagcgcaccaatttcggttcgaacagacgagacaaccagagtggcggcctgctggcctccgcgcttgggggaggcaccggccttctgatcgcgccggggaagaggaggagcccgaccgccgaggcggaccaggcctccctttcgccccccgcaccttgacaccgcggccaccagttgacggccgagcaagaggcgcggtggtggaggcgcaagggctctccgctctccgcactccgccgtccgcagcactctacgctatttgggctcatgggctttggattctttctctctttctttttccattttccctctgttcggctttgcagttgtgccactttgtcgtgattgtgtccgttattttcgtgtcgctatttgctcatgctgcctgcgccaccgccatctcataaattagaggaccaatgttggcttgctcctgcatataagaaacacagtgctaatcaacttgtagggcagaacttctgactgtaagtagagagagcaaagagccgtaattttgacaaattgacccttctataaaacttagtttcaaaataagtcgggtcaaaaattaatttcaatactaggccgtgaccttagcgccattagggttggcgctgagctaagctaaaacgtccaagcgccagcattgttggcgctaaggtcatatccgacgtggaacatattagccacgggctaagcgccaaatgagttagcgctgacctcttagaaggtttaaaattagtgtgggcaataactgacacaagttaaatctagctcagcggttggtcagtgtggctgcaagccagagttccagggttcgtttcttggtaagaactgagaacctaaatcatacaacataaaattaaaaatacaaaattataataattgagctaagtatttaacattttaattaatgttttcaaatttatttattccagattgaacataaaataaaataaataatccccttaaaaagtaacataaaaataaatctacaaacaaaatatgtgattgtttggaaaaaaaatttcaatagaacaagattcaaagaggaagtaagaaaaaacctgaaaaccggctttcccggttcgaactgtgaacctgtgggctggagtagaggggcctgaccactgagctagcttctgcgttatgacacttccagcacacattcttttaaaccatgtaaatatcagcgccagcacacatgacgctgagctcctcttttgtggctaatccgtgccacgttgaacgtgatattagtgccaattagagcaagtttaatagtatagccaactactagcttcaattcatctatagccaatctaatagctcattcgtataatagttatatattatactattaatacctggtcccacctgtcatacacacattgtgtattgaagtccgtgctacagctggctacaaatctgtagcccgctgctcttctctctcatcatttatttccttaaaatatgtttgcagctgacttatagcctattattgtacttgctcttagggtggcgctggtacgttttatctcagcaccattggggttaacgctgaggtcggcctagttttgaaattagtttttgacgcggcttattttggaaataagttttatagacgggtcaatttgtcaaaattacgggagcaaagagtatacaaaagcaagagtatacaaaagcgtatgtggctttatcgtactaaagtaattctagtttggcaaacggcgtcggccttcttttgttcatctgtatgaattagtaggagattgtggtaattgtataacgctagtgtatcgtgattaggatttgtgttacgaactcttcctgggatttctgtcgaacaattggtgagcaagagcgagagagggagacaggaagaatagaagagttcaggacataaagaacaaaggattaggaggaggatgggatttgaattatagagaggtttcagtacaatgtttttcgataccgattcccataaggctaggcctttatatacacatgctagccactctcttacgcaacccagtctggcccaattatacgagtgttgggctgtcgctgtcttgagctcttcggcctggtcttgacagggttggtaacatcctcccctccttcacatccggcttgtccccaagccggagcagcagggtaacgctccttgagccgctccagatcttcccaggttgcctccgatgttggacagcccgaccagcaaaccttgacttgatcaacagccgctgatccccgacgtatcagtctgcgtgctagcactcgcactggaacaggatctgcttcttccaccgctggaggtagggtagctaccgtagaagaagctggttccgatgccttccgaagttgggacacatgcaccaccgggtgaatcatagaagaagcaggcagcgccaaccgataagccaccgcccccacccgagcagtcacctgaaagggaccaaaaaatcgaaaggccaacttctgattaactcgcaccgccaccgaggattgcgcatgaggttgcactttcataaacacccagtctccgacagcaaactgccgctccaaacgcttcttgtctgcttgatgtttcatgcgctggcgagcgcggtggagatgttgatgcaacaacgaagtaataacagtgcattccttcaaccattcttgcaaatccggcactgcacaggctgcgatatcaacaataccaaagtgccgaggaggatggccatacaatacctcaaaaggagaagttcccaaagctgagtgcagagaggtgttataccaaaattccgcaagagccaaccattgagaccatttcttagggcaagcatgcacaaagcaccgcaagaatgtttccaaacactgattgacgcgtacagtctgcccgtcagtctgaggatgataggccgtactcatacacagctgagtgtctgccaatttaaacaaagtggtccatagagtgcttgtaaagatccggtcatgatctgagatcaaagactgaggcagtccatggagcttataaatgttagagagataagcttgtgccacatcaaaagctgagaatggatgagctaaaggcacaaaatgggcatatttagagaacttatcaacgaccaccataatgcaatcaaaacccgaggaagtcggcagaccttcaataaaatccaaggataccatttgccatgcatgatccggaacaggaagcgactgcaaaaggccagggtagcgaacccgttctgttttcgcttgttgacaaacagtgcaattggccacatatgtctttactgctttcctgagccctgtccaagcaaacaaacgcttgacacgggagtaggtaacctgtacccctgaatgtccacccactgccccaacatgtaaagattgtaagatttgagactgcacgtgcgggttagcaccaatccaaactcaccccttatagcgcaaaataccagattccaaggaaaaatgaggtaatgcgtcagatttgagtgtcagttgagccaccagctgagaagaatgaggatcttgatcataccccttttgaacttcctcaagccaagctggaatacaaactgaaagagacaatacttctgttgaatcatcggccactcgtcgggacaacgcatcagcggcgctgttctcactacctttcttgtaaaccaaacgatactgcagtcccatcaacttggttaaggctttttgctgccaaggtgtggctaatttttgatctccgagatgaatgagactacgttgatcagttcgaatcacaaactcagcaccctgcagatacgagcgccaatgatcaattgctaggagaatcgccaagcattccttctcataagtcgacaagccacgattgcgaggaccaagcgctttgcttaaaaatgccaaaggatgtccctcctgcataagtacagcaccaacacccacagctgaagcatctgtctcaatttcaaatgtctttgagaaatccggcaatgcgagaactggagctgaagtcaaggcagtctttagggcatcaaaagaagcttgagtttcagcagtccaatggaaaataacattcttcttgagaaaattagtcagggggcgactcagaatcccaaaatggcgaacaaatttgcggtaataccccgctaacccaagaaatcctctgacctccttgacattagaaggcaccggccactgcagtactgcctgaatgttcttagcatcggttgacaccccttcagcactgatgacatgtcccaaataagtgagagatgaccgagcaaacacacacttagatctcttaacttgcaactgattggcagagagaatatcaaatacagcccttaacaagcgcacatgttcctccaaagtccgagtatagatcaaaatgtcatcaatgaagactaacacacctttacgcaagaatggctcaaagattgtattcattataccttgaaacgttgctggtgcgccggtcaatccgtaagacataacccggaactcgtaatggccattatgtgtcttgaaagcggttttatgttcgtcttctggcttcatacgaatctggtgataaccggctcgcaaatccaaactcgtaaaccaacaagctcgtgccaactcatcaagtaactcatctataataggcagagggtaccgattcttaacagtgatagcattaagatgtctataatcaatgcaaaatcgccaagtaccatccttcttctgcacaagcaacacgggagaggagaaaggactggcactgcgttgtatcactccttgtttgagcatgtcagcaacctgtcgttcaatctcatccttttgtgccggactgtaacgatacggtctcaaatttactggttgggctccaggcagcaagggaatagagtggtcaaaagctcttggtggtggcaagccagagggttcatcaaaaaccttggcaaattcctgaagcaatccctccacttctcttggcagaacaagactgattgcaacagcttcactggcacaaagttcaactgtgtgtaggactgcattatgatggaagagacccttaagttgatcagccgaaataaccgggcaacagctaacatccggcaccacaccctgtaacagaacctgcctgctgtccaacacaaattgtatggtcttaagcttccaatcaatttgcattggactgtgtttctctaaccaatccatgcccagaatgacctcataacagcccaacggtaacaccttaagattagtgctgaaggactccccttgtacccaccaatgacaattaggaaactcctgacaacattgcaagataccaccatccgcgattttcaccttcagaggagtcagcgagctgcgcacaccctgcagtttattagctaacttctcactgataaagctgtgagagcttcctgaattaaccaacatcaagacctcatgtcgttggatcaatccttacaaacgcaccatacgagaagactcaataccaagtacagcttctcgagaaatggccaataactcaccatcatctgattcagcagggggctagtagatgactccacttcctcaggaacctcatcagaaaaaagctgtagcacttcttcaatcacatgcagctgcacagtagggccacaacgatgatcacgactccacttttccccgcaagtgtgacaaagccccttcgctcgatggaaagccctgagagctgcaactttatcagtagcagaaacttcagtagttagcttatcatctccctttggcacaaaaggtccaacaccagtgtgcaagggtcctcgggctcccccagtcggctcaaagcgacgcccctccttgcgattctgttccagtacttcctcttgcaaacaagctaattccacggcagtatccaaatcggttgggcaatgtaaaacaacagcagatctcacttctgccttcaacccatccatgaactgagtaacaaagaaaaccgaattccacgagggatgatgcgcatgtaacccatgcatcaactcgttgaacttttctgcatatgcccacacagtgctagtttgccttaacctattgaactgtcgaatcaaactttggaactcctctctaccaaatttcccacacacccaggcagcgaattcctcccaactcccactaacttcatgagctcgggtcgactgcaaccaagtcaatgcagtacccgagaactggagtatcgccacaccaatccagtgatcagaaggagttccacacagcccaaaataagtctcacacttcagtttccaggccttaggattttcccctgcaaactctgggcactctactctagatgcagaaatttgacccccaaaactaaacccacggcatcccccactcgactcaggaactgaatggaaaggggaagtagagttatacgcacccttgaccgggggagttcgtggggagttgtttccccacacagccttcccccggtgattcgaagcctcgtggtggcaaaattgcctaggcgctcctttgccgaacgccgacgtggaaggtcggttttccaccgtcctcttcggcagccgctttgccccaggcggcgtcggaagacgtggagccatttcctccggcttgacgggatccggcttgacggactccgacttgacttgatttggggacggcgcgggctgcttcaccatcttctcgagctgagcgcggatgtcgcccacctcgtcccgcaattccgccaccaccttctctaccgtcggcttccatcccgctagctccacaaccatcggcttgatttcctcgatggattccaccgaaatcatgatagcctcgttctgcttctgaattgaagtcatcgtagtcatcagctcgccaagttgctgctccatctcgttcgccttgagttgcgctcgcgaatgataccgtggcttctctagataatccagattcgactgctctgataccaaatttgttacgaactcttcctgggatttctgtcgaacagttggtgagcaagagcgagagagggagacaggaagaatggaagagttcaggatagaaagaacaaaggattaggaggaggatgatgggatttgaattatagagaggtttcagtacaatgtttttcgataccgattcccataaggttaggcctttatatacacaggctagccactctcttacgcaacccagtccggcccaattatacgagtgttgggccgtcgctatcttgagctcttcggcctggtcttgacagggttggtaacaatttgcaccttgccactctttctttccagctgatactggatttgtggaaagaatcggcgagttaattggcctctgcaacggacgtagattttgcaaggataatatatagtagtaccacattcttaatagttgcaatatactccatccgttttatattataagttgtttgacttttttctagtcaaacttatttaagtttgattaagtttatagtagaaaaatattgtagtattttcaatacaaaagaaacatattatcaaaatatactcaatgctagatttaatgaaattaatttgttattttagatgtttcttttaatgacaagagcccaattttcactcagaaaatgttgaaatcatgagttcccaatgttttcatggggaactgcagtctgcgggactatatttacgaatctgctcgtaatagcttaacaagacgagcatagtgaccctatacggtgacaaatccagcaaatatcctctaattaattaagctagcaaccccaatttaatcactcttagggcatctcctcagcgtgcctccagtcgcaaaatataattttactaatgactactcctacttcagagtgtgtttcgaaccagagcttgttatatacgcacacaaaagcagccattgcatcgatcaataataatattgcagtttgacaagggagcgtaccaatttcgaacaggaaattaatcggccttgagctacagtggcgtgtcggcatggccttctaccggtgcctctgccatgaggaggtgctggaagctgaagtggacggcgccgccccccttcccccccccaccccccactccctcccgaggctgtggctagctgcttgcggcgaactgcaggagaaaatggacattttgccactttgaaaacatggtttcgctgaaatgctattccgaaaacgtgtttcgctaaaatgcaaatatagagcgcgccatcacagccactttgccattttctccatttttactattttggatattattttctctgcaaagcggtttgaagagactagaatgcccct

SEQ ID NO: 60501 - DNA, 6941 bp, Oryza sativa
  unsure (1)..(6941): unsure at all n locations
atcacatattttctaggaagtgttatgttacgtagttcactacaaagaatggtttttgcatgcttcacttcctgtatacttgcagcatgtatgcatagcccatgtgagttgatagaatgacagttgtattctactataattatttgtgatcaatatccctgtaaagaatgacatggtattgtaatattgtatttaagctacagtggcaaagtgaacaagttcagtaataattttattactccattgccaatgtcttgctcagtaagggtcaccaataggtatctgactgataactcagtttgtagatgctggatctttttttccacatagcagtgacatcgttaatacggagtattggctgtgtttagttccttccaaagttggaagtttgggttgaaattggtacgatgtgactgaaaagttgtgtgtatgataggttgatgtgatggaaaaagttggaagtctggatctaaacacagccattatagagctagtcggaagtcaaaacttggaactcagagaacgttccgaatgcctttacacaaagtataaatggcacggttcaaattttttatttcatcacttgtccaaaaaccctgcattcataatgggaactgtaaaattgtttggatttggtgggataaggtcacaggaatagggatatatagaggaaatctaatttatggtttgattgaggatcaggggaaaaaagtgaagggttagaatcagtccacactccacaccccatcaccatttctatcccagcaacgaaagggcatgtagcctagtggttacagtgacctgagtagtaccccaaggtcctgagttcaaatctcctatggagcgaatttccccttctctaaaaaaaaaaatctctatcccagcaaaccggaccacaagtagtagtaagtacctatgctgcaaacagaaatgctattgtctatggctccaaattctgtagctttgcaaaagacagtttagtttaccagtggtgataatttgagtatggagttaaccataccagtacaattagactaaaaaaaagaactccaacctagattatgcacacaaccacaaacacaccaagcaaaacagtggagattgccgtttgacaagggagcgcaccagattcggttcgaacagacgagacaaccgggagcggcggcctgccggcctccgcgcttgggggaggcaccagccttctgatcgcgccggggaagaggaggagccctactgccggggcggaccaggcctccccttcgcccccacacctcgacacctctctgacactgggcctctgtcggcaaacaccctgcaactccaccgcggtctctgtttggctttgcacttgtgccgctgtgtcgtgattgtgtccgtcattttcatgtcgctctttgctcatgttgcgccaccgccgtctcataaattagagcaccaatgttggcttgctcctgcatagaagaaacacactgctaattaacttgtagggcagagcttctaactgtacgtagagagcaaagagtatacaaaagtgtatgcggcgttatcgtactacagtaatcctacttaggcaacggtgccggccttcttttgttcatctatatgaattagaagactgtggcaattgtatcacgctagtgtatggtgattaggatttgcactttttttttttgaaaggagggcaaaagctttgcctcatatatttatagagatgaagaaaaaacagatcaaaaatatgtacagggattaggatttgcacattgcaactctttccatctggtactggatttgtggaaagaatgggcgggcgagtttattggtccctgcaatggctttagattttgcaaggataatatatagtagtaccacattcttagaagttgcaatatactccatccgttttatattataagttgtttgattttttttctagtcaaatttatttaagtttgattaagtttatggaaaaatagtgtagtattttcaatacaaaagaaacatattatcaaaatatactcgatgctaaatttaatgaaattaatttgtcattttagatgttgcttttaatgacaatagcccaattttcactcaaaaaatgttgaaatcatgagtccccaatgttttcatagggaactgcagtctgcgggattatatttacgaatctgctcgtaatagcttacaagacgagcatagtgaccctatacggtgacaaatccagcaaatatcctctaattaattaagctaacaaccccaatttaatcactcttagggcatctcctcagcgtgcctccagtcgcaaaatataattttactaatgactactcctacttcagagtgtgtttcgaaccagagcttgttatatacgcacacaaaagcagccattgcatcgatcaataataatattgcagtttgacaagggagcgtaccaatttcgaacaggaaattaatcggccttgagctacagtggcgtgtcggcatggccttctaccggtgcctctgccatgaggaggtgctggaagctgaagtggacggcgccgccccctttncccccccccccccccactccctcccgaggctgtggctagctgcttgcggcgaactgcaggagaaaatggacattttgccactttgaaaacatggtttcgctgaaatgctattccgaaaacgtgtttcgctaaaatgcaaatatagagcgcgccatcacagccactttgccattttctccatttttactattttggatattattttctctgcaaagcggcttgaagagacgagaatgcccctccttctccaacgacgagttctcccgtcgagctgtccgacgatgccaccccgatcaacgacacgtccgacaccgccgtcccctcctcctccacaaaaaacccgttcacctcctcctccacagccgccgccttcccctttgccatgcggaggaccttcacgccgagctcgttgcaccgcgccttgaacgccgcgttgcccatcctcggcccgccgtaggagaagacggtgaccgggcggcggcggcgtcgccgccgagacgctggcgacggcgaggtcgtatgccaggagcagcgcaagcgcgccgcccatgctgtggttggcgagcgtgacgctcacgtcctcaccaccggagcgggaggcgacgagtcgggacacctcgcgaaggagctggttgcggcagctgtcggtgcagccgaagcggcatgtctcgtcggcggaggtgtagatgttgagcaaccccgactcgaccttcacgtagccgccgccgccgtcgccgcggcgtggggcgaggcgcgccagcacgagggagctcctgtggttggccatccactcggcgggggtgacggtgccacggaatgagacaagcacgtcgcaccgcccgagccgccgcgtcgtctcgtcggtggacacagcgacgtacccggcccagctggcgcggccgctggtcgacacctccatgcccggcacagcggcgtccggcgacgagtagatgtacctcgtcacctcgtacccggcaccggcgtcctccagcatccggagcttgccgtacttgcagttcatgtacctcggcgacgaagggtcctccaatgccgcgtagcatgcaccgacgagctcgccgtaccgcgccacctctccgcggagcaacgggtgcagcggcgagcatgtcatcccagtcgccggagccctggaccttcctctacacgcgggcgacaaagcccgccgctgccgccgtcatggaccacctcgccacgctcgtcctctttctcccatgaactggatcgatccctttcagctagctagcaaggggcaatttggtaccatcaagccgaaaatacaattgaaaatacacaaaatggtaaaaatggcaaagtggcggtgagtacacgcttcgtattggcattttagcgaaacgcattttcagaatggcattccagcgaaaccgctttttgaaagtggctaaatgtctattttctcgaactgcggcgcgctggcggtgagggggaaggcgacgagcggcgctgccgctacgaggccgagggaatggatgtgctgcccccggacgatgttggacttgaggtcaagagttgagggctcccgttgcgcgtggttgggcttcttgaggcccagaaactctaacaggccggggaaaaaagatcgagaattcacgccaatgcaaaagtattcacaatagtactgtatagagaagtgcagaccgcagaactagattgcaatataaattcagagttgatcaagatttacaccacttccataatttgtgggttgtccttcgttcagatcgctagcttgtcggagaggaaactgtcacgtagtacttgtcaactgtagtcgtcactgccgagtgccgaagaacgtgttggtagaaatgattgcgacttgcgaggtcatcttaccgtgaacaccagggcatatacctggtctaacacggccggccgtagtcattccctcgaagtcctaattcaaaagttaatgcagagcttctaaatgttttaggctaaaaaagtttctcctgtcattccagctggtcgagaggtgcatgctttaatttcgatttatgtggactgactcagctacgcggtggtgttcggatccatgactaaactttattcctatcacatcggatactcatatcacatcggatacgtgtacgctaatttagagtattaaacatagactaattataaaattaatttcataaatgagagctaattcgtgagataaatttttaagcctaattaattcataattagcacatgtttactctagcatcacatagcctaatcatatactccctccggtttcattttaattgacgttttggacaatgacacggtctacaagatatatctttgaccttatttttctattataatatatataataaataaatacatgtttacttttattatagtactttaaaagacaaatctatatatgttgttctagttcctttaaactaaatatttttaaagttattaatggtcaaagttataaaagtttgacctcagccttgtccaaaacgtcaattaatatggaaccggagggagtattaatttagattcgtcgaacgaattagtctaaagttatggaatgggttttgtcattagtatacgtttaatatttctaattagtatttaaacattcgatgtgataggggttttagtccctgatccaaacagggccgcttctaatctctttctactccagtacatttcagttgctttaatttatgatatgtgtagatataataacctaaaataagctagataggaagatttggttaatagtgaccaacatgtgtttaacgttgttttgtttaagccatgctgcgggcggcgtggagccgtgcatctatgtcctgttcttttctcaaaaaaactgtataaacttttagataaaaatggtacgttttttaaattgctaaacggtatgttttgtgtgaaaactttctatatgaaagttattttaaaatataagattatttttcaagtttataaaaattaaaactcaattaatcacacattattatcacttttttttaaaagacacattattaccacatcattttacgtgaaacacttaatttttatctcatctccatttttgggagatttaaacaccaccatagtcaaaagttaacgcagagctcctgaaggttttcagctaaaaatatgcttatgctttcgatctacgtggacttgcttagctatgaaatctctgtctgcacattccagttggttacgtcgaaatagtagccccatattggtggatgaaatagtaactatatacaagtatgcttaaaaataaatttgacagccctaaaagaacgagacatgcacgtgaagaaccagactctgaacatgttcacacctagattagacccatttcatctcagccacatatatattaattttatctggggcaatcaccttgaatttctacgttgccttattttcattccacaccatacttgtccctgttttgcatattaagaattgcgaaaagtctaattaagtaagaatatagtgggagaattggaaagttgggtagaagcaaaggagcgctaagtaagtgtagaatgattcaacatgttgctttctttcaagaattatgctcccttctttttatattataagactttcaaacattgctcatatttatatagatattattgaatctagacacatatatgtctagattcattaacatatacttcctccgtttcacaatgtaagtcattctagcattttctatatacatattgatgttaatgaatctagatagatatatatgtctagattcattaacatcaatatgaatgtgggaaatgctagaatgacttacattgtgaaacggaggaagtatatgaatgtgggcaatgctagaaattcttataatatgaaatattcattaacatatatatgaatatgggcaatgctagaaagtcttataatataaaacggatgaagtacttggaagatatcagaagagcctgtgcaaaagtctataggcatgtcttgtaggacaatctctagttggaaaaaaagatgaattatccctgaactatcgcggtcgatcgaattacccctctgaacccgccagacattgcttaccctaaacctttaataccggacgaattaacaccctcaacccattccagagcggttttgtcctacgtggtgtacgcatgacaatcccatcaacattttttttaaaaaatggtgggacccacatgtcatacatcattttcccctcttcctctctctctcttcacactctctctcgctctcacgaggcggcgcgcaggggcaggaggtgggctgcggcacgagacgcggaggtggaggcctgagctgggtggctccggctggcggtgagcgctacgggacagtggcagaagcagcgtggagatggat

SEQ ID NO: 60502 - DNA, 10684 bp, Oryza sativa
tccatccgtccaaaaagaaactcaattcaaaaaagatgtgagaaaaaaaaaatcaattacacagtttacattgcgagataaatcttttagagagaatcacttatatgccactaaaaattgatttgattccttatatgctattgaaaattggttcttcccttatatgccattaatctaaatttgcacaccctatcatgctactcccgtcagttggccgttaattttcaagaaaaaaagacgtatttacccttttgagtatagggcatgcctaacaactcagagagggtaaatatgtcttttttacttgagagttaacggtcaacacatggtcaattgatggtagtggcatgagagggtgtacaaatttggaccaatgatatataagagaatagccaattttcagtggcatataagggatcagaccaatttccagtggcatataagggattatctcaatcttttaagcataattacgccatgatattacaacgtgatgctacagtaaacattttctaatgatttgttttgttattagtctatatttaatacttcaaatgtgtgtcagtatacttcaaagtttttacacccaaataactaagcacacccatagacagaataactgattaaaaaacatgaatttatttatattattgaagtgaattgtacttcttacctacttgtactcacccatcccctacgagtgtgtttgcataatgggaaatgggggtgggattgggattgggaaataaatgaagggttaggattaaatggaagggggagaatgaatagttagaatttaaagatgggtgggaaattatttccttttcccatttgccaaacactacctattcggttaaacaagtgaccaagagtaggagattgcttaataacacatacttaagccagaaaaacataagtatgaaataatatagcggatgttaaatcttataaccgaaccgaacccggggtttaaaaaaacggaaccaatgtctagtccgacgatataattaacttgagaaccaaaggaaaaatgagctaatataattaacttgagaaaaatcatttaaaccaaatgattttctactgaaccaaagtaaaaatgagctggcttgattaaatccccgatgtacaaggtctgtattttttaaaaccctacctaattcttaaatattttcataccagaaatatataaaaagtgagcacatggcaaaaaagttgggcccgttactacctttactgcatacatgcatgcgcgcctgactatttgggctagtcgctacaatagttttagaaacgaaacaaatatatttttatgtgttgattaaatcaaaattctcaataaaatacactagtactcaacgttacttattttattgaaccggtcggattcaccggttggaacacaggtcgggttcagagtggcaatcagtaggtcgtcccagggccagcgccgatccccatccgtcccgcgagcaagcagaggcggcgccgtcgctcgtcctgctgcttccgccgcatcctccgccaccgccgcctgggccgatcccccaaccgtcccgcgagcgagcgagcgagcgagcaggggcgccgtcgttcgtcctgcttcttccgccgcttcctggttagcacatcctctttcccatctctctctacccaagcactctttatatatatatatatatatcgaatttgcgttaaccctagcttctgttctagaaatttgccttaaccttcacactaataacagtttgtttgttcccaaaaagtttgggggttcatctgaatccccatgtcccatgttagatccgcccatgttgccgcctgctgcgtgttgggaacctgctaggttaattgttcactaacagctagtagtagcatgaaaacactctcgtgcttccctgttgctaagcgatcttcttgactcaataagagagagtcatgtcttgattgctagggcatgtctggttgtttgctgattcgggctatagctcgccgaggtaaaccgaagcgaacctttccttggaaagctatttggttggtttgctttgcacactagcttttcactcggttttgcataaaacttgtgcgagagacgagcttgccatcaaaggcgagccaaatgggctctcctgcgcgagccagttttttcttgcgcgatatggcttgatttttttactgctaccaaatgcctctcctcactgggcaaggcttagatccaaacgagcacgtgctgtcttgtaccatattgttcaagtagccatgcactgaagtctgttggtaccctggtagaggtgaccagactgtggagaggggtcaatatttagaaatgaatttatttggtgctaaacttacccaaaaatagatgcccttttacaatacattcaatcaaaccttaaaaaccttgtccaccaataatacccaaaaatagatttgttatgcgaaaactgcatatgattaaaaaacaattgttccttaaactgcatttgcacacctgtgtgctttgagttggtctcttgttttctttgctttttaaaacttgatgtccattttacttgcaggttgctgttcctatggacttcacatatcatatcttttgaatattgtgatcaccccattttcttgttgagggtacatgaataatctccatttttgcatttcaggtactttaccccagaatagcagtgatgtgtcaaaatctatagttggtcaggtgcaagcagaagagcaggaaggaaatggccaggcaaaccaacaagcagtgcagcaacatatgattttagcaggccagttgtctcagccaaaatcgttaactgaaggtttggaaaataatgtctacccaattaacggaacacgatcaccagccagaacaagaaccaccacattctgaaaaccatctgaaacaggcagagccaaacagcttccagttcgctgaaaaggaaacaggctatgctggtctacagaatttcacaggccccaaggtggatgtgggtcagacttcaggagagcagcagcatgtaaaacagatggtcggtcagcaagcaccacctggtgcacaggacgcaaggaagcggggataccaaccgtctataccatttaatatgttgattccaatcctacaggctcatcttgacagagacaaggatatgcagcttcaaactgtgtgggcaaaacttagggtgcgcttttgtctcactcctctgttgttagctgctgtttttcatcaatttgattggctagggaaactacacagccttgttgaggcgaagtggggagcaaagttaacctgcttcgcacatctattaatttgttcaaagttatatatcctctatgttgttaatatcgttgttagacttctaaaatttgttgctaaaattaggacttagggcgtgtttggtttgtggccgaacccaaccaagccaaaagaaagacatctatttggtttgtggccaaaaaattggcattgccaaattatttcgcttagtacactacataaatgcaactttggtagtaaaccaaacaaaagcctagccaattattgccatttttaatccatttgaataaaagaggcgcctgggatctttttttttctttttttttttggggggggggagggtgagataaatgaatgctagcaaagatgcctcatcatttaaaatggagtttgcaccatttccactgaaatgaaactaactcagctgtaccattctatgtttgtagcgtaatgaagttcataaagatgatttcttgagagttatcaggaacatcgttggagatcaaatgctaaagcaagcagcccataaagtttttgcacaggtgaacggattgtgttaacttcattgctgccatttgtttccctgataactgtttaataaatatcaatcaagtttgatgaaagtgaagtcactcttaattgtcatgttggacgagagatcactgagtaggaaatatctttatttaatttgttttcagatgcaagcccaggcacagagaagtggccaggcaaatgcaaatcagcaggctaatgcaaatcagtattctttacaatcccaagtatcttccagcggttcagctcaattacatgatcagcaagttcacgtgtccaccacacctaatcagggccaaaaaaaccaagcattgtcttcatcccaaacctttgtgcaatctggcactcaggtgcagagcagtatgactgctcatgataattccatccaacggccagatgcaaagggaatgcatgttacgccgaaccgacctcctgttatgaactcagcaatttctgcacaaacaatgaacaaacagcagcaacccacacaagtccagcaagcctcacagcaaatatatggaacaactaatcgccctgaccagccatacactaggccaatcggtggttcaacacctcttagctcactgagttcagaatcagaaataaggccttcctctcatcctgcaaaaatggagattcttccttctcatccaatgacacaacaaaatgcagctgcgcagcaaatgcaacagaacaaggatgtgaagactaatgcttctaatccaaggagtaatgcaaagcaagattcggggacaggtaagggtcgtgcagttggcactggaggttcttcaacgaaatcgcaagggaagcaggtaattcaattcctgcatcatctcacctatctgtcttatgatatattcaaatcaaatttccagattcatatgcaacccaattcctcgatccatctaaatagtctgaattaccaataattttcatttatgcaattccccatgttacaaagggatagttacatgcataaaaaaattcctacaagtttatttgcattccatcacaattagtttttgttggactcaacacaattaattttgatgaacgccataataaacggaaatgatcaatgttagtgagatctgatgccataattcttcaggtagaagattgatcaaacttacctaggatagcctgcacttgattgtatcaatatcttggaggaatggaaatatgtagtaccagaacagagaacctccactgttttgaagttttaatttttgctgttacactaagttgcatacaaattcactcagtaattgccctttttatttgctcatacgaccactcttatcattttgagaatgtggccatctgtagtacatcccgctgttacatgcagggttatttcattgttatcaaggtgtttactaagtagtggccacttgccccaccatctgacacctcacctgggtccctgtgtctggacagggccttaacacctgacacaaaaaataggggatgggggattggttcatggagagggctaaacattagtcacaacttttgggatctttgtttttctgccatttctcttttctcaatctatttcactccagtttcctctactttctgctgcatcctggtcaaccaggtgatggcttgagtgcttttttttttgtgaaggccttattatcctatgaaaataattttgtgaaggccttatttctgaggagtaacatgtgatttagtcagaaaatggctgaaagtgtatttggttgatttccagttgtatggctatgcatgcatacttcaataggttcacagcaaccatgaaactattatatgccttctcacatgtagctgtacgtataattatctgactggactgtcagggcccccctaacttttccacacctcccgctgcaaagagtaacaagaaaactgctgggcagaagaagtcattggaaacatcaggctctacaccaccccctcctaggtttttgtagttcatttcaccccatatgctctttcattagcagattgttcagtacattcaatttttggataatcctaaggtgatttcctttttgtcactagcaaaaagcagaagacttctggaaccttccaagaacaaagcttcgatcaactaaatgatgtcacggctgttagtggtgttaatcttagggtacgcatctccctctatgattctcatttgatgtttgttttatttttgtatatcctctttatattccatcactgttttactttaacaggaagaagaagaacagctactctctgccccaaaggaagagagctgggcctcagaagaagcaaggaaaattgcacaggaagaagatggcaagctttttctgcagaaaggcccacttctgaagaaactagcagcaatcggttaggaccttggaatttcatattgacactgtaaaacaatattacatggcaatatatactatcgaagcaatactaactgatgaaacatttttcacagttcctaaatgcaatttgaagagcattggtggtgatgttgagcattgtttatcaatggtgagctattcatatgattgtccttaagaattttttcagagtaatgcagtatatctaacataaatgccttcagtgcgtggaggagcgattgcgaagatttatcagtactctcataagagtttcaaagcaggttattttacacaacattcaattactaaatttatggtattgttgttattttgatgtactaaccatgattttcttattgctagagaattgacacagaaaagtctggccatcaactagttataacatcagatgttggccggcaaattttgcggatgaaccagaaagctaaggaagaatgggataaaaaacaagcagaggaaacagacaagaacaagaaacaaaatgaggtgttccataatatctatgttatttgcttgtgtacaattttgcatgacatgcttgttccgttgaactatcatgttattactatggcacatcatcttcagttatttatcactacctttatgctgtcctaagtcctaaattattatttgttgttcttttatccatttttatactgaaatatctaaacacctctctctctctctctctctctctcacacacacacacatgcatgcctaccccgcacacatcccacactctcctgtacaacttatcccaaaggaaaactgaacgatttaattaatatatttctattttcaattttgacacgaaacagtttataagcagcttcacatgaaaagggactgtagcagatttctttgtcttctcactgttgaagatcatacattttttatggttacgaaaggtccatcaagttgcgatgttgcagttagtcattctaattaaccatatccttacacacaggttgacggcggtggcactgtggaattagacaaggaaaaggaggaaactcgttcaaagaatgcaaaggtaactttactaatgtgatatttaggtttggtggcagcccttgttttcctaatatgcttgacctgtagcccaacaaagaagaagatgacaagatgagaacaacagctgcaaatgttgccgcccgacaggctgttggaggaagtgatatgctgtccaaatggcaactgatggctgaacaagctagacagaaacgcgaaggccttgatctggctgcttcttcacagcgcgggacagcttccaggtcgcatatggctgggaaaggtcccacagatcaccacgaagcttcgaagaggacccattctgcagcgtttggaactggtaaatcagcaaccttgcattgatttatttcccgccctttcatattatgctagaaaaagctgcaacttcagtatccatgtcatattgctattgcaggaggcatgaacaggcaaggcaggggtaaatatgcagcgtctcatccaaaaggaccacaaagacctatttctatgaagaatgtaatatgtgtcctcgagagggaacctcagatggcaaaatcgcggttgatatatcggctctatgagcggttgcctgtagattccaccagagattaggcttgaatcgtcatttatttggtgtatgtatgcacatttgtgtaacaatatcgagctataacttattgttcacttccttccattttctctggtttggagttgcgaggtgtgggtgggtgtgttgggggaggggggggggggacaaaactagtgttacaagttagctgacatggtactcttagaatatgaacacataagatgtacttccaaacaaatggtcatgtaaagattatacagtgtaacagatggcaagattgcccattgctgcctgctggtgcatgcgcttgctcattgtactgttataattcagtgagataatttggagaaatccattgttctgatttatttctttccctgggttccagagtgttggatacattgcgcactaaaatcgcgctaaatctaacactggttacattgatccaggaaggaacactgcatgcaaaactacaatgagacaccacacctaaaatgcacacactagtgagactgggcattcagcaactcattcataatctaaaagaattcgaagtcgaggtatttcccgccggacctgacctcggcgccgaccacccttttgccgcctccgccgccgttcgccacgggttggccacgccgtacttggccggcagctcggcctcgacatgcctgggcacctcgggaggcgtgctgcaccggatgagcgcccagttgacgccctcgaagaggggtgctgcttgatctcggcggcgccacgcttcacgccgagccgctgctgcggctctttcaccaggaggcccctgatgaggtccctcccggcgtagctcgtcgacggcgactccgggaaccgcagctgctgcccgaccacgttgaacagcgtggcgcggttgcccgaccccttgaacggcgtcttgccgtagaggagctcgtggaggaagatgccgaacgtccaccagtccacggcgctgccgtggccttcccccttgatgatctccggcgccaggtactcgtgcgtccccacgaaggacattgaccgcgccgacgtcggctcggcgacgagctccggcagggcggcgccaccgccctgccccaactcggacctcggcctccggccctgcttcttgctcctctggccgaacagcttgggcatgaagcacgccggctggatgcacaccgaagaaggctccatgcaagcaggctgcacgcagaacgaaccgccggctctcctgggatcggagtcggacgccgacgctctgatgagcgtcggcgacaccgcgcaccgcagagagaggtcgaagtcggagagcatgatgtggccgtcatcgcgcaccaggacgttctccggcttcaggtcccggtagacgacgcccagcatgtgcaggtactccagagctaggagcacctcagcggcgtaaaacctgatcagttttgcacattccaattcctatcagtacttcaactagcagacagtactatgggatggttaaagaagatgacaagaatcagagtatatgctaagcattattactagcagttattgcaagtttgcaacacaagaagttaccaagcagaagaacacagctgtgcattctaaattgtcatgccatcggatgccaaaactatactgcatgtactattgcatactatgtcccaatcaatgcagattgatgtgtaaacatcagggaccctgtgttcataaatactgtagtactgtactccatggctgttagtctggagagaatatttcagcaggccaatttctcaaatatccatcactaaaaaaacaattaatagttcaagaaaattaatgtatcatgggtacaactgttgttaagatggcattgaatttgaataccaacattaaaggagtgctaactaacatgtcaagataaatggcatagaatcataggcaaatttgctcaagaaattcaccttgctgcatattcagagaaatgctttcgtggctgccgttgccgcagagtgtgcagatcaccacccggacagaattccatgaccagacatgagaacctgtcagtctcaaagtgtgtgtacagagttggaaggaatgggtgatccaaaagctgcagaatttccctttcagtttgagctctgttcaacttctttcggcttgctaaggacgccttgtccattactttcatcgcaaagtagcaccttgtcccactcaactctgagaggtagacgctgccaatgtcaccacagccaagacgcttgagcaatctaaaatggctcatcccaaggacattgccccgaccccggacagctagaatagccctccatctaggatcattgcccttgtgaggcttgttagcacttcctgtgatgttactccagttgctgtcatcgctaacgccactactatcactcgctcgactcatgctggtctttgtgctttccattgagttgcctcgggtgctatcctttgcgctctcacatgtcttctccacggtaaggatggattcactagttagaactccacttctacatgtgcttgtggatcttcccctgatgcttgtggcagcgaccgcaccagtgctgtcactgctactgtgtgggctgacattgccactgggagggaaggaggcatcccagacgcaatccttctcctccgaggcctgagttgaggatacggcttcaacagcatctggtgctaccacagcacagtgcaccttcctctcttcaaccaaaccattgacattaactgtgcaaacaatcacatccggctttgcatccatggcatggactgagaggtcctccatagatgctcctttgaccgataggcctcgcatcaagcactcgggtggctcaggcttctcctcgtcgatcgcgacatacaccgtgctcataagatccaca

SEQ ID NO: 60503 - DNA, 15417 bp, Oryza sativa
tgtctggttttcgggttggggggggggggggtgggtgggtgggtaatttggtcgagtgcaatagttcagggggtaattcatatttttttcctctctagtttcacaatgccggcaattattttcgtcatctgtaatgaagtaagatggtagcatctgtatgagtactagctaagatataccttatccgattaaaatctcttactccctctatcaaaaaaatgtttgacgccgttgacttttttaaaaatgtttgaccgttcatcttattaaaaaaattaagtaattattaatttttttcctattatttgatttattgttaaatatacttttatgtatacatatagttttacacatttcacaaaagtttttaaagaagacaaacggtcaaacatgtttaaaaaagtcaatggtgtcgaacatttaaggaaggagatagtatattttagtacagatggagtatatatatgattattaattagccttcctgggcagtaccaatctttccaattggaagatagctactggacgcgaggagaaaatcggacgtagaagcgagcagcgaccggcagttggacgagtcgttggctccagcaacgaccgggatatctgatgcgactagtgcccctggacttcgtcgatcaatggcaaattattgcgataaaattgttttctgccgatcgagtataagccaatcaattcctccatatatgttttatacatagcgcttggggagtggctggtattaatctggcatctatacttataaagtccacgaaagcgtgagcacaaagagatggctgcctctgaatataaattgatcggtagttaacaggcaccggcctacgtacaccaggaagggcaagccggctggcgcaaagatgagctcgagctttctggcagtttgtgccacttcttttgtgctggtgtgctcggcagctacgccacgagtattggcttcagtctatggagttggtggagggctcttgattgtcccttctaatgactccctcgctcactgcccctctagctgcggggaagtcgatggcatctcctaccccttcgggattgggggaggctgctttcgggacggcttcgagcttacctgcaacaccgccaccaaaactcccaagctccttgttgccaatagtacaacccagataacagcaatggaatatgacatggctttggctcctatgtacttcaattttacgacaaggcaaggtatggacacctacaacatttcatgggtgtcgccagctaagggtattaaaatttcagatgagaacactttctatgttgtctgttgtaattttgatgccaccttgttcgagtttggtacgggagatttcgttggttcttgtatgagtagatgtgacattgagaaggcaccaatagcaataggacagccttgtaatgggaacggatgttgctccatcaagttatcaagggacatgcggggatttcagtcaacacttgttcaagctgaagctgcagcacaaatatcagatccgctgcatcatgggatcatggctttcatgtcatatacggattattacgtacgtaatgcgagtgatcttttcttgagttggacgaatgtgagcaacgttgagggagccgagcttcagtttgccatcacggaccaaccaagctgtggaagtgcactggtaaacaaatcaagttatgcttgtaccaccggcagcaattgccaaaatatatcatcgggaggttacacctgtgagtgcaccaatcgttatctacaaggcaatccttacattttgggaggatgcaacatgcaaggtacttcctaccacctttaatttcctgcaaaataagacacatatatcgatatatatctaactttcatcccttgtcactctctttgtgggacagattacaaccccaagcataaagaacactgtccgacatcatgcggaaccatgatcattcccttcccttttggtctggaagaaggttgttttgcaaacaaaaggtttcggcttaattgtactgtacatcagatcatatcacagttttggaaacaagtgaagcacaatttattgtgactaatgtgtctgttgaagatgggactctgactataagtaatttgttgaataatacggaatatgggagagagatactaataactcaaggtgaccaatatggtgatacagtgatttatggtcctgttgaagatcgatttgacttctctttagaatacaacattgttataaagtgggccgtagccaatttaacttgtgataccgatataaaaaagaatgctacatatgcataacgcagtatccatagcgattgcctaaacgtcacccacgcaaacatattcatgggatatcgttgcaagtgtcttcctggttttcaaggaaatccatatatccgagatggatgtaaaggtttgttcctgttcattcccctcctatttgcaattgtttaagaattttagagaagttttatgtggatagtttaaccatggcatttcccctttagccttgttcggttaatcccatctacaaggggatcaagcgggattggaattaatcccctccaatccctctctaaccgaacaaggctgtactagtgcctagcctatgtctatacgttgtaccaataaaaacaaaaaaaactgaagagttaattgcagatattgatgaatgctcactgccaaactactgcaatgggacatgccaaaattttcctggaggttttacatgcactagttgcccccacagaaaagagtttaatccaattacaagacagtgtgttgcatcagctaagcaacacaatcttattataggtaagtcatagctgacagattagtcaatcttattgccttaagataatgcaaagtggcttcacggcagaaaattaatgaatggctgtaggtattacaactggtattacttgtggcattggttccataattattgcattaggtgcaattattctagccaataagtggaagaaaagcatccaaaagagaattagaagagcatacttcaagaaaaatcagggcctactcttggaacagctaatctcagatgaaagcgccacaaattaaacaaggatattttccttggaggaactagaagaggcaaccaacaactttgatgctactcgtgttcttggtcgtggaggacatggcacagtttataaagggattctatctgaccagagtgtggtggccattaaaaaatcaaaaattgtggaacaaactgagatagatcagtttatcaatgaggttgctattttatctcaaattatccatcgcaatgtggtgaagctttttggttgctgtctcgaatctgaggtgcccttactggtatatgagttcataccaaatggtacattgcatgatcgtcttcatactgatgttagtgttaaatcctcattgtcatgggatgatcgaattaggattgcttcagaagcagcaggggcacttgcttatctgcattcggctgctgcaatacctattttccatcgagatgtgaaatcttccaatatactcttggatggcaactttactacaaaggtctctgactttggtgcttcaagatctgtttcactcgatgagactcatgtggtgactattgtccaaggtacatttggttatttagacccagagtattatcacactggacaactaactgaaaagagtgatgtatatagttttggagtgattctggtggaacttttgacaagaaagaaaccgattttcatcaacgatgtaggcacaaaacaaagtttgtctcattatttcgttgacagactccgtgagggatctcttatcgaaataatagattatcaggttcttgaagaggctcacagggaagacattgatgatattgcctcacttacagaggcatgcttgaaactcagaggaggagatagacctactatgaaagaagtagagatgaggctgcaattcctgagaactaagaggctaagaaaattccaatttctcccagtcccaggaagtggtggagagattcagcaccttttaagcccaaatgctggtaaatcccaagcacagaacaactataccagtgcaggtgatttatcatatgaagggatctccagttgctacagtttggagcaagaattatcatcctcagtcagtttgccacgctagctatatatgtaacatggagtgttgagttatcacatattttctacgaagtgttatgttacgtagttcactccagagaatggtttttgcatgcttcacttcctgtatacttgcagcatgtatgcatagcccatgtgagttgatagaatgacagttgtattctactataattatttgtgatcaatatccttgtaaggaatgacatggtattgtaatattgtatttaagctacagtggcaaagtgaacaagttcagtaataattttattactccattgccaatgtcttgctcagtaagggtcaccaataggtatctgactgataactcagtttgtagatgctggatctttttttccacatagcagtgacatcgttaatacggagtattggctgtgtttagttccttccaaagttggaagtttgggttgaaattggtacgatgtgactgaaaagttgtgtgtatgataggttgatgtgatggaaaaagttggaagtctggatctaaacacagccattatagagctagtcggaagtcaaaacttggaactcagagaacgttccgaatgcctttacacaaagtataaatggcacggttcaaattttttatttcatcacttgtccaaaaaccctgcattcataatgggaactgtaaaattgtttggatttggtgggataaggtcacaggaatagggatatatagaggaaatctaatttatggtttgattgaggatcaggggaaaaaagtgaagggttagaatcagtccacactccacaccccatcaccatttctatcccagcaacgaaagggcatgtagcctagtggttacagtgacctgagtagtaccccaaggtcctgagttcaaatctcctatggagcgaatttccccttctctaaaaaaaaaaatctctatcccagcaaaccggaccacaagtagtagtaagtacctatgctgcaaacagaaatgctattgtctatggctccaaattctgtagctttgcaaaagacagtttagtttaccagtggtgataatttgagtatggagttaaccataccagtacaattagactaaaaaaaagaactccaacctagattatgcacacaaccacaaacacaccaagcaaaacagtggagattgccgtttgacaagggagcgcaccagattcggttcgaacagacgagacaaccgggagcggcggcctgccggcctccgcgcttgggggaggcaccagccttctgatcgcgccggggaagaggaggagccctactgccggggcggaccaggcctccccttcgcccccacacctcgacacctctctgacactgggcctctgtcggcaaacaccctgcaactccaccgcggtctctgtttggctttgcacttgtgccgctgtgtcgtgattgtgtccgtcattttcatgtcgctctttgctcatgttgcgccaccgccgtctcataaattagagcaccaatgttggcttgctcctgcatagaagaaacacactgctaattaacttgtagggcagagcttctaactgtacgtagagagcaaagagtatacaaaagtgtatgcggcgttatcgtactacagtaatcctacttaggcaacggtgccggccttcttttgttcatctatatgaattagaagactgtggcaattgtatcacgctagtgtatggtgattaggatttgcactttttttttttgaaaggagggcaaaagctttgcctcatatatttatagagatgaagaaaaaacagatcaaaaatatgtacagggattaggatttgcacattgcaactctttccatctggtactggatttgtggaaagaatgggcgggcgagtttattggtccctgcaatggctttagattttgcaaggataatatatagtagtaccacattcttagaagttgcaatatactccatccgttttatattataagttgtttgattttttttctagtcaaatttatttaagtttgattaagtttatggaaaaatagtgtagtattttcaatacaaaagaaacatattatcaaaatatactcgatgctaaatttaatgaaattaatttgtcattttagatgttgcttttaatgacaatagcccaattttcactcaaaaaatgttgaaatcatgagtccccaatgttttcatagggaactgcagtctgcgggattatatttacgaatctgctcgtaatagcttacaagacgagcatagtgaccctatacggtgacaaatccagcaaatatcctctaattaattaagctaacaaccccaatttaatcactcttagggcatctcctcagcgtgcctccggtcgcaaaatataattttactaatgaccactcctacttcagagtgtgtttcgaaccagagcttgttatatacgcacacaaaagcagccattgcatcgagcaataataatattgcagtttgacgagggagcgtaccgatttcgaacaggaaattaatcggcgctgagctacagcggcgtgtcggcctggccttctgccggtgcctccgccatgaggaggtgctggaagctgaggtggacggcgccgcccccttccccccgactccctcccgaggctgtggcttagttgcttgcgatgaactgtggcccgcgcaccggcggtgaggtctgaggggagggcgacgagcggcgctgccgcgatgaggccgaggggatggatgttgctgccctggacgatgttggacttgaggtccagagttgagggctcccgttgcacgtggttgggcttcttgaggcccaaaaactaacaggccgggaagaagatcgagaattcacgccatacttgcttatgcacgtaggcaaaagtgggggccgctgatccgcgaccagtcgcgcgaggccccgcgcgcgcgatcagctgccccccctctagtgtgatctgttatcctatatatactactatacgtactatatgtatacgtactatatgtatatacatatgtatatatatagtttatacgcatatatattatacatacgtgtgtatatatacataattttttatatgtatgcacttttaatgtataaaaagatatacacatgtatataaagtttgtgtgtatacgtataaaaaacctaaaaaataagtgtatacaaacatatatatgtgtatacaaactttatatacatgtatacagagttggtatacgtatgtataaaaaccaaaaaatacacatacaaactttgtatatacgtatataaaagtttgcatacgtatatacaaagtttgtatacatgcatataaagtttgtatttatacgtacacagagtttagcatacatatactattaaaaaacggacaaacacaaaaatatacgggaagaaaaaaaaggaaaaaaataaaaccggaaaagatacggaaaaaaaaacaaaaaaaagggaaaccgtacgcccatacgcgccgaccgccgcctcctctgtcgtgtcgcgcgcgggagggctattagcccatttcaggaaagcccacgacacgaagaagcccaaaaaacagagacccgtgggtttatagaaacagtgttaggctagaagtagtaggggtgaactcgccgcgcgcgctcacacgcgcgactagtcgcttattagcgatttcgggcaaaaatggcttaaaattgggaaccagaaattacgaggccattcagattgtagataaaataaatcgtactacatagataagtgtagatcatatagataagtgtagatcgcagaactgattgcaatataaattcagagttgatccagatttattacaccacttccataatttgtgggttgtccttcgttcagatcggaattgacttgtatgaataatttatattcccagtcatctaccagaaacgtttcgcacgtgcaccggtcgttccaatcatcatctcgctagcttgtcggggaggaaaatgtcacgtacttgtcagctgtacgtagtcaccgccgaagaacatgttggtagaaatgatttcgacttgcgaggtcatcttaccgtgaacacccgggcatgcatatacctggtctaacacggccggccgtagtcattccctcgaagtcttagttcaaaagttaatgcagagcttttaaatgcttagaaataaatttgacagctctaaaagagtttgagacatacacgaataaacaaactcacacctaaattagactcaggttgtgtttagttcagcgcgaagtttggattttggtttaaattgaaaatgatgtgactgaaaagttgtgtgtgtatgacaggttgatgtgatggaaaatgactgaagtttggatccaaactttggatctaaacacagcctcatttcatctctcaaccacatatatatttcttccatctgtggttatcacctttaatttctacacgtacgtatcttcactccacagtccaccccattacttgtcattttttgtttttgcataacaagattatcgaataattatttcaataagaatatggtgggcgaattggccagtttgtagaaacatcagagtactgctaactgcagtgtagatcgaccgacttgacatgttacttcctttcaaggattcattagaaaagaacctacaaaaatctactattgaatcttctacagtctctagtttggcaacgccgcaggccattattttcgtcatctagtagcatgtgtattgctttgttactgtgtgttgtgattaatagcatccggacagtaccattctttccagctggtagatagtcagatagccatggacgtgtggaaataatcagatgtgtataggatcagtgagcagcgaccggcagttgggcgagtcgttggctccagcaacgacagggatatctgatgggactagtgcccctggaattcgttcatatacgaggacaatatacaggcttggcagattgcaacaaaactgtttgctgctgatcgaaatactgatcaatcaatgtctccatatgttatatagcgcttggggaatcgctcttaatcttgcgtttacttaagtctctgcaggcgcacgatcagtataaattaagagacgacagacgttgcctctgaatacaaaatcgatctcacgcgtagttagcatacatatctgcacccacaaagctaggcaagctagccgatcggcgcaaagatgagctcgagcttattagtggcagcttgcgccgtctcttttgtgctgctgtgctcggctgctacgtccccagcatcggctgcagtctacggagttggcggagggctcttgtctatcccttctaatgattccctggctcattgcccctctcgttgcggagatgttggcatcgactaccccttcgggatagcgccgggctgtttccgggaaggcttcgagctcatctgccgcaacaccgccaaaactcctaagctctttctgggtgatggtactactgagatcacagacttgggttataggtatgttttggcccagatatacttcaacattacggtgagaccaggtacggatacctacaacatatcctgggtggccccaacagagggtattactattgatcattacaacacattttacgttatcggttgtaatttcgatgctaccttgttcgagtatggcacggaggacctcataggttcttgcatgagtagatgtgatggtgaaaaggcaccaataggagggccttgtaatgggatgggatgctgtttcatcgagttaccaagggtcttgcggggctttcagtcaaccataattcttcggtcggatggcattcctgtagcacaaacagatccagtgcaccctggaatcatggctttcatgtcatcggactattatatatcaaacacaagtgaccttttcttaggttggacaaacacaagtaatgttgaaggcacagtactttcttttgctaccatagatcaaccaagctgtgaacgcgcgcgcatgaacaacacaagttatgcgtgtagccctggcagcaattgccggaatgtgtcatctggaggttatcattgttactgctctggttatgaacaggggaatccttaccttctagatggatgcacgggtacgtacttcctgcctgccccctttttacccccaaaacgaagcaaaatataatgcactgtcactaacctccttcttattcttattatatattgtaatttctatggtggaacagattacaaccccaaatataaagaacactgttcaacatcctgtggagacatgaagattcctttcccttttggagtcgaagaaggttgttttgctaacgaaaggtttagacttaattgtacagaaggtaacctaactgtttgcgaattaggagaagcacaatatcatgtgactgctgtgtctttggatgatgggactctaactgtcggaaacatgatgaatgacacaaactacgagaaagaggcgataattgttcagaccacagatactggccgtgattattcattctcaggccctgtggaagatagatttgatctctctatggaatacgccattgttataagatgggcagttaccaacttaacttgtgaagtagctgtgcagaagaacactacatacgcatgccgcagtagccacagctactgcctgaacgtcacccacaggaaagagttcatgggatatcgttgcaagtgttctcccggttttgaaggaaacccatacatcgaggatggctgcacaggttatttcctcttcacacctcctccagtgtgcaccagcaatgctcatgcctgcaaatgtttagaaattgaattatatcaatttaacttgggagaatcgacaaactaatcatagttttttgcagacatcaatgaatgcttactgccaaactattgcaatggcacgtgtcaaaatttacttggaaattatacatgcacaagctgcccgcatagaaaagagtttgatccaatcaaaaagaagtgtgttacatcagcaaagcaacgcaatcttcttttaggtaagaccgtaagaagtaatagccaacatgcaaaatgattttattatgacaaaatgaattgatgcaggtattgcaattggaattggttgtggtcttggctccatagttatcgtgttgggggcaatgatacttgccaataagtggaggaaaggcatccaaaagagaatacggagagcatatttcaagaaaaatcaaggcctactcttggagcaactaatctcaaatgaaagcgccacaaacaaaacgaagatattttccttggaagaactagaggaggcaaccaacaactttgatggaactcgtgttcttggacgtggaggacatggcacagtttacaaaggcattctatctgaccagcgtgtggtggccattaaaaaatcaaaaatcgttgagcaaactgagatagatcaatttatcaacgaggttgttatcttatctcaaattatccaccgcaatgtggtaaagatttttggttgttgtcttgaatctgaggtgccactgctggtttatgaattcatatcgaatggcacactgcatgaccaccttcataccgatcttagtgttagatgctcgctgtcatgggatgatcgcattaggattgctgtagaagcagcaggggcactttcctatctgcattcagctgctgcaataccaatttttcatagagacgtgaaatcttccaatattctcttagatggcagctttactacaaaggtctctgattttggtgcttcaagatctgtttcacttgatgaaactcatgtggtgactattgtccaaggcacattcggttatctagacccagagtattatcatactggacaactaactgaaaaaagtgatgtatatagttttggagtgatacttgtggaacttctaataagaaagaaaccaattttcattaatgaggcaggtgcaaaacaaagcttgtctcattacttcgttgaaggacttcaagagggctctctaatggaaataatagatcctcaggttgttgaagaggcaaacaaggaagagatcgatggaattgcctcgcttacaatggcatgcttgaaagttaaaggagtagatagacctactatgaaagaagtagagatgaggctgcagttcctgaaaactaagaggctaagaaaattccaactgctcccaggaaatgatggagaaatcgagcaccttttaagcccaaatactagtaactcttatgcacagaatatttatacaaatgctggtgatttaacatctgaaggaatcccaggttctggttgctacagtctggagcaagaattatcatcttcaattagtttgccacgctaattaggtataccacggtgaagtgatatctgatatgctttgtagttccgttctgaacagggtatgctgtattgttttatttcctgtgtgtaattttaggttacagtacgtatggatagcccacgcctgttgtatattactatcattatttgtgaggaatatatggttgtaagggattaattaaggccaggtggcaaagacaaaaatttgtataatcatgaacagatccattcagtaataatttcataactccatttccagttgcttacgcagtacttcctccgtttcatattataagactttctagcattgttcacatttatttttttttaccggaatcacattcatatactccctcattctctaaatatttaacactattaacttttttaaacatatttgaccgttcgtcttattaaaaacttttgtgaaatgtgtaaaactatatgcataaaagtatatttaacaataaatcaaatgataggaaaagaattaataattacttaaactttttgaataagacgaacggtcaaacatttttaaaaaagtcaacggcgtcaaacattttgggatggaggaagtatatgttaatctttacctattataaaagtttaagatgtttttgccagatgtttcgtacgtcatctgacttcgattcctactcggcttgcgcactctcgcccgctcgtgcgcatcagaatcaggtccgtgttagtgtccgacttctcccctaatacctgcgcgtgttcacatcctccatcacgagtcgttcgcacgcaccagccggaaaaaagatcgaagcatcgatatgtcagcaaatcgatcggactctaatccagacctcgtgcgtatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagacctcgtgcgcatcagaatcgggtccgtgttagtgtccgacttctcccctaatacctgcgcgtgttcacatcctccctcacgagtcgttcgcacgcaccagccggaaaaaagatcgaagcatcgatatgtcagcaaatcgatcggactctaatccagactgatacaaatcacataggttgactcacggccacacaaataataaaatcagcatgggagatatatctatatctataactaatataaatattcatatttttccggtcgtcacatccttaacccacgtttttcgtccgtcaccgtcgccttcagctttgttcacaaaaactagggttctatttggagagataagctcgaaccgagctcgattccgcgttaatttctccgggataaggtccgattcttggggaaaacggaagaggaggataagggaaatatttcccctcaaccaattttggaaaaaatagaaaggggcgcccggatttggagtggaaagcggcgccgggtcgggttctgtctccggccagaggttgaagacaacactgtagcgacagggatgagatgtggactttggggaaaaaaagcctagcccgagaaaaaaagaaggaaggacgtgaaacaaacttttagcggtgcagctactaggccgaacaggaagaagtaggatgctaaagtggacttcacggattaggcccaagaaagagaggggatttttaattacttctccagataaattaaccaataaaatgatctttaaattgttaaaattatttcaaatgctcaaataatatcaagaaaactcttgaacatacttggataacaacattaaaaccagatcatttaatgattaatttattatttaaataatactgaaacgttctttgtattattaaaattagtagttgagctttgaaaaatccgagaaaaattccagagagcagaattaaccacgcatagaattaaatccatccatgctttatatttaggaaattttattatacatttacaacttattaatttatttatatataacattaattcaccaacaaatacatagcattaagtgtagccaagagcgaaaaaatgaggttggattcatcatgtcatctttccattcactacttaaaaaatatttttctggatgaccacccgaatagattgcagacaggccataagtgtttgtgcctacaaaaatttatcccattttcccatacggcttcttaagaaacttgtatgcaagaatcattttttccaaacggaccatttaaaatatatggacgtgaaaatgtggtgtttaactcaccggcatgcaaaaatacccccccgtagattctcactttttttattctccagtcctctctctttcccatcacccccattcatctcctccctcccagcggtaggcaagggcgacgacgatggcttcctcctcttctcccccactctttctctcccctctcccccctcccgacgcggtggagggctcgggcagtgggagagggcggaggagggatgcgacagcggcgacagatctggcggtggtgaggcgtccggcggcggatccgacggtggggaggtgcggcggccatcacccgcgcggatccgactgcggcggatccggtggtggggatgcgcggcaacagcggatccgatggtgaagaggcacgggggcaacggattcaactctccctcccgcgcgtcgacagtgatgggagcgggcggacccggccacccctagccccctacgccccacgacaaggacgaggatgaggatgaggacagcaacgacgacggttacaacgacgatgatgacgagaaggacggcgggcatccgtgatatggacaatattacatgacctaaaaaaataaataacttattgtagccataaatataggagtcaataaaaaacaattttatttcaaggtggtatcaatatctttcttataatcataaatcgagcggatccggtagtggggatgcgcggcagcaacggatccggtaatgaag

SEQ ID NO: 60504 - DNA, 936 bp, Oryza sativa
ccaaaataatgaaattgaagcagttttgagcattaaaagattcttagaaataagcaaagctccaggaagtagggaccgcaggcaaccaaccaaattacaatttcaagaacctgaagcaacctgcaacttgtctgtaattgaaaggattccagccaccaagaaatcaagaatccacagcctgctcctccaattattggtgcccaaagagggcaaatgtaggagccgggagcactctcagttctgcagagaaatgcacaataatcagcttaacacgccaaattggacatggatttgtgaatggaactctaatccactggaactagaccaaaagtttatcgaatcctaaaatcctaaaagcaaaactaagcacatttaatatcttcgcgcacataaccgaacagcaaatatttctactttcccaagaaacctgaacgagcctgaccaagagggggaaaagaaaactcaccttggataactcaagatggagatcccggagcggcttgagctcagttcagtctctctgtctcccagccattctccagtcaagcctcgcccctcccccctgatatactgctacttcccgagcgacctcacctcccactcgcaccacgtacttccgcaccgcgtgattcgaggagatcgaagtgggaagaagggaaagcaaacgcgagtcgtggaacggtggagccgacgaactgaaaagtgggggagtggggaggaggtgtggggggcaaaccaacaaaatttaaaggaaatgaaaatttactactccagcgaggaacaaaatggaaaaaggctactgcagtatcacgagagagtgagagaaacagtgataataacttgaggtctttttcaacgtgggagttttctctctctcttttttcttccataggaattggtttttgtttgatacgggacacatttttatcacgtgct

SEQ ID NO: 60505 - DNA, 10571 bp, Oryza sativa
tctattaaaaggtagtattatgattattagtaaaggagaaaaggatattacaacgtttattatagagactattccaaattattaatccctctatcccatagaagaattagcctttagtactaatcttagtatcacgaatatagacatatctctgtacagattaattgtattataatatattacattaatcctataacatttttttgggattaatcctatatttatttatttttaggacgggagaacattaagtcattaatcttttttttacacccattattaagaatgcgtactaggactattactactgcgaggtgaactgataactgcatgcttcctactactaccggccaaggacgctgggcctacatgcctggctctccagggccaagggagccccacatgtcaccatcctttcacggcagcggaagcaaacccattaaacgctgatgctttgtggctccaaatcgctttctcgctgtgagtagtttgcctatctacatgtacttgtgcagttatgcgagtgtactaagtactaacaaatctgttgtctgagcgtacatgtgtttatacgagcgtccgtatctacaccgtgtttcaaaaaaaaaaagttatctccgtgtaataccaatggatgtgttgatgtggcattttttcctgcgttctactgatgatgtgtcacgttacaaaaggcagtgtgtactagtactagatagccctgaaactaaacaccattacatagtgcttggaactgattgagctgaatggcatgcagtgccagatgccatatgccatgcatgcagattactactgcataatcctcctgtccaccggtctcagcctctcaggtcttcaccacgcacagctgaaagcctcagtgttgcagcagcaaccagggcttccggtttgcagctttcaaatctttcggtaaaaccaccggaggatttctgcacgcatcctttctgagttctgaccatctgatagtttgatcctagctcatggctctatggaaagcatcacgcaatctgtcaaggaacagagaaatgatcgagggaggaggaggatcacaaggtagaaatgatgatgattaactctgctgctgaagatcctaatactagtattactaactactatcagctggacccccattatatcagaccaaaactgttaaccatcgggattacccctgcagaagcaataatcaatcaatggccccatgcagcagcagcagggccactcactctcgctctcttgtgcctgacaggttcttgacatgaagaacatggcgtgtgtttctggctgctgctccctggccatgccatgatctatagccattggaatcggggaaagttgcagcagctgagagacccaagagcttctggtcttcgtgaggcgtccgtccgtccatcgcgctcatcagtggcatgagtggaacggaatgatgcctggttgcttcggccagatcaaagcatgtgagaatctgaaggtgactcgtctctctgctttgctttaccagccaccgccatgagagagagagagagggagagagaagagctctagacttgcatgcttggtgggttttgccttccaaagctcatcagtcatcatggccgacttgcatggcagacaggcctggcagtctctcgaacagcacattcatattcttttatcatttttgctttgcctgtttttagccgggatattttacctttgctctttttgttttttccctgtaatttggggcatgtagttaaacaattatactccttgaccaattaactaacttgacgccagcttagagctctcctgatacttccctttttaatctgtttcacatgtttgttcattgtctgatttgtatctgaaagtgtcattgtacagtgtttgttcagtgaccgaggagatcaagagcgtacctgttacaatttgtccactgcggacacttagtccctgaatctttacgagagggaaaaaaatgactatttgacaccatcagatataatgttgggagatttggtattgctaattattcacttgattttacccacacctctcatattctaccattttcttccctttttgcctgaaattcaatctgaaaagcctctgatatgcactcttcttttttcactttgtttctttgctttaccaagaccagtattctttagcacaaaccggcagagtgagcagcaagctctctcctcacgctatgcttttatcatccccatgtcctccccaaacatcaaatattcaatatctacatcgattcagtatttgtgtatgtccttctccaagcatcagtttttaatttgtgcattgtaatgttagggcttgtttggcatgcatggaggaaagaaatggacttttgaaaaaggtgcaagacactactccaatctgtgtaagcaggcctgagttctagacaagcaaaaggtgatgccggccaatggattgtacaatactactaataagccggaaggaggctaacaggtaggctcctttgtgttacccattagtcgtcaaaaagtgttctttgtgctgcccttttgtagccagcaagacaagggtacaatgacatgacaaaactgcaacatctttacaagccactaatgcttttcaaggataaataaggcggtctaaaagtagatttgctgcagttttcatattgcagtgcagagaacatgtgtaaccttattaacttgataaaatgtagcatgaattggcagatgtatcttgttcttcttacatgtatggagaaagatatgaacacagtagaaagtctaaaaataacctgctcaacccttctggatgtgagaagctcaattgaaagcaacttgcaattttaacaccatttacaaccttatttccctgtgtatacaggtttccttttctcagcaaatgcagctagaccttcaagacgatcttgagtgtgcagaacttgctcgtagcattcttcttcgacagccaatccggcggacagatctacctccatgccttgattgatggccttcttagccattcttatcgctaacggaccctgaaagaacaaatggtgcttagatcgtctacaagaacggacagaacagtgatcttgttgaatttgattcagaaagttcattatcatttgtagaagctgctctatcagagatcatgaacatctcaaacagatcaaatataacatgttactcattcagaagcctcttactttctgatttatctcctgggcaagttcaagagcccttttataagcctccccagcgggaacacagtagtttactactcctgcaatgaaaacatacatgtcgtagtggttcttctaagaagtcatataagcttttactaagaaatcacacctgtagaaataaaatgtaacaagactcctctcaaaaaagaaggcgccaggccaaccttacccatggttacagcttctactgcatcgaatctacgaccagtgaatattaattcctttgctctggactttccaacaatcctaggaagacgctgcgttcccccagctctatagattgttacaaagtgatgttaacagcagaagcacaccattttgcttgagacatttcaacaaaaatcaaactagttccactatgatatgctattcaagtacaatagaacagcataacaaacttttcgataggatgcaatttcccactttgatatgatacacggggttgctgcactagagcaagagaactgtgaaaaaaaagggaacaggtttggcatatactggtgggtaaatgactagattttttttgacgcaaggtaaatgactagatttacaagccaaacaatactcccatgttatttaataaagtgccagctacatttataaaaattacttacaaaagtaaagcgccatcttgaacacatacccaggaataatagcaaggccagtttctggcaagctaaatgttgcattttcccctgaaaacacaagcattgaaatgtttgagttttggaaggaaggaacaaaactctttgataagatggatggaatatgatcaattgatcactgcaggttgaaagagtaccacatatacggagatcacaagaaagagccaattctaacccaccgccaaaagcagctccctcaacaatggcaattgtaggaattgacaatgcctagttgtgcaagatgcattttgtaagtattctcaacatactctaaaaataaaacttgcatcaaggctttagaaaaaaaatagctagaatgcgaaagatgagcgtgcataactacttataatttgaaccgcgagtaccatatattgcttcactaaaatctactaagatacaatggatgttagcaaaatatatttgaatcatgcacccagaagcaaacctcaaaggacaggaatgtagatcttagggaattgacaaattcgcgaacttcgcaagggctcattaacctcctttcctgtcaacaatttatgtacaacggttatgattttgtttatgatcagcaaaggacaaagggacataagtacttacaaagcattcaccatttttttcctatactatagctacaatgcttttagttccataactgacacaaaagttatctacgccgtggtggatagcacttatttcaaatgctcaataattcaaacaaacttcttcaatcaataccatctgcacaaggacactttgattagttggtgtgtacacttgtacttactgaccatagctagccagtaaccagcatttcaaccatccatctagtaagtcttaacgtatatgaggaattgaggacatatatacatatccctcttaataagtcggaccctgctactgctattaacccttccaaacttgttgataaaaagattgaaacaacggtgccaatccatttgtttctctccatccgatattttttgagggactagcttctcaatgctgtcacaactcatttaagccttgattgatgtttgaagctcctgatcatgttgagtaatgagtacgtcaatcatcagttttccagatcgattcaactactcccttaaaattagaacactcaattaaaacatcacattaactcaaaattgaaacataccaaccttgccaaaaaaaaaaaaaacagtgaaccaatccttatctactttcagactcttctaacaactgcttagctagagtatgccacaaacatataatccttaatccttatcctactgtgagcagaaaacctatcgagatttagcagaggaactgatagagcgttcaccttgagatcagcgccagcgcagaaaaccttcgggacggagctcgccagcagcacgactttcgccgtcgcgtcagccttcaccttctcgatcgcgctccgcaacccctggagcatctccctcccgatggcgttcctggcctccggccgctccagcctcatctccacgatccctgagtccaatcatcgcagctgtaataaaccacaaaccccaaaagaggaaggcaaaaaaaaaaaaaatgacaggagaagcgagcaagggacggaccggagtcgggcgccgagagcttctggaggcggacgggctcctgctgggcgaggatttggagggcgcgggagaagagtgccaggtgggcgttgttcgccggcgcgcggcggccggcgaggtggccggagacggcgaggattccccggaggatgcgcatgctggagcagcagcggttgggtcaggatgggaggaccggaggagtcgtgtgggactgtgagtgtggaaacgagccgagcgtaaaaggctcgctagaagggcggctcagctcggttggagaaacgaggtaaaacagcagctcggctcggctcattgacgggctcgagccagcttgaggctgagccggtgactaagatgtggcaggctggcagcgaatttttttcattttttaatttttttcttttaatatttaaagaaataatctatcgacgcaaaaaaattacaaaaataaaccctgccgccctccaagttgacgtggcagatgtcggctcgacggcgccatctgctgccatctgcgaaaattgcatttagccccttgccgcccaaggctaaatgcaattttcgcagccctaaagagcatttggctggtactttttgcatctaggtaccagccaaaaagtattaggcccgggttggcttttttttttgcatgggagccccttgccgccataacatagggcggcaagggttttcgtgcaaaaaaaaaaacctccctctcccgtctctcccgtctgccgtcaccacccgtccctcccccatttgccacgtcagcttgccgccttagtagagggcggcagggtctatttttgtaattttttgcgccgatggattatttctgtaaatattaaaagaaaaaatttaaaaatgaaaaaaattcggctggcagcgccctgccggcaagggtgaggcccaggaagcctcgggtgggcctacaggccagcccaggaaggttggtccgctgagcccaacaagccacgagaattacaagagttgggcttcttgtctcgaacctacctaggcaagtgcaggagaattcatcgacacaaacttctttatttactctcgactaaagtcaccgggaacgggcaagcgaagatgatcaccacgacaccaaatggcagtatactgtatacacagataaactactttcctgagtatacaggtttcctcctctcggcgaatgcggctaggccctcaaggcgatcctccgtgtgcagcagctgctcgtagcactccccttcgacggccaacgcggacggcatgtctgctgcctgcatcccttgatcaatggccttcttggccattcttatccccagaggcccctggaagaaaataacaggattcagaaaaaagctacagattggaaaaagacctcgtattgtcacagcacactgtatgtgtttggtcaagatcttcatatggccaaaattgtggcttctgttttatttgaacagtcctgtgttcaaagccgacgatatggttcttactttctgggctatctcgcgggcaagttcaagggctttttcatgagcctcccctgctggaacgcagtagtttgcgagtcctgcgtttcaaacatccaattaaacctcatttgaagaaatgcaagtgaagataatagaaggaaagcgtaagggaactcttacccatcattacagcttcagttgcattacatctacggccggtgaatatcatctccttcgctctggaccttccaacaatcctaggaagacgctgtgtgcccccagctctacgtagtacagtaaaagatgaagattatctgctcaagctgaatattttcattgaagaaacacattttggactgtaatttatttatttatttatttttgtcaacgtaaagaatcgtttatatgttgactaaaagaggtattggaaataatgatgagtgggtcatcctgaatctggagctagcaatagcactcacaagtgcacaatgatcgactctctacaattttagtgctaacctaaaagaacattagtacattacccactgattttttttattatatttctcctagtggatcagattatcttttcattgccaagcataagcaaatactaccattaagacagaaattcttgtcagtaatatttaatatgaacattagctccactaattaattttctttttgagcaaaatgaaatcttttctgggtgttggactttgatgtaaacagattgcattaagatgggaaattctaaagtatgaagacctgccttattctggtaggtaagtgcatattccatttagtttcggatcatcttgacaatttcacgagaaacctatgtacaaaagtatggagtactagatgcatacccaggaatgatagcaagtcctgtctctggcagtccaagagttgcattttctcctggaggggtgaacacattatttcaaaaatttgaaagaaaggaacaatgattatgtccataagatgggaaatattgaattgctcatatactaagacaaaaggaagcaccacatatacgcaggtcgcatgaaagtgccagttctagcccaccacccaaagcagctccttcaatgacagcaattgttggaatagatagtgcctgaaaaaacaagatgtggtttttatatacacataaagaaaaatgcgccatgtataggatctgaaattaatgggcatagtttctcataaaaacactggtccactcgagggtggatgccaacaaaaaaaaaggtaaattctgaataaatacagacctcaaaggatgagaatgtagatctcaaggaatttgcatattctctaactccagaagagctcattagtttccgttcctgtcatgaactgttgctctgttatcttagccatgtggattgtaaatttgtaagcaacaaaaaacaacatgtaggaacagtataacatgtttttgttaacatcatctcatgattttaatatagtccatgagatggttttggttctttaactagtctagaggtcaatatttggtttaatggcaactacaagtacgagaagtcaaataaattggttgagaaatcaatatcatctggactgtgcaagatgacttatattaacttctagtaccaagttttaaagcttaaaatgatctgtctggttaagcagctattcctctctagaacacagccccaactagtaattgaccccaatttttaatcctttgtttaaagcatgacatcctccttttctcttatagtatgttctttgagatagtgactcctccatatgctgtcccaggatcgcaatcatgatatttcattttctccatgaatcattttcttcgtgacacgccatcacagtatttctttctatgaatttcgttttcagcactacaccaagctcatggatccatatttcttactcctgcagtttttccacagctactgagctactccaatgtctttgatcgttcagaattcgcagttgcatctcaactgttctcacagccattctactcaaatgcgaaacgctctaatcgatctgtattaaaatatgaagtatgaaaacacatgcttgcatttccaagtagtagaatagacagagaccttgagatcggcgcctgcgcagaaaactccaggcacggagctcgtgaccaggacgaccttcacggtgtcgtcagcctcaaccttctcgaccacaccccgcagcagcctcatggcttcccagttgatggcgttcttgacctccggacgctccagcctcagctctacgatttctgtttccacccacaaatttaggaaccgcaacaagggagaatttttagagcaactctttcagaaaaaaaaaaggattcttcagaaaatttaggcaaaggctaaaagccatgctgatccccgggttaacagaatcatcagaagattagtagtagacaagacatgagaggacaatctttaacagtccttaatagaccctgtcttttgcacatcgacattgttgctatcactgggtagcatcacacaccccatcagagataattgaagggacctctgcagtactactaaagacatattgtgaattgagtggctactggctactgctggaagggatcaagaagtggatggctttgcagcaaagtacagtgtctcccaagcccctgacctacctacttgtaccgctccactgttccagggcctcgccgacgccacgccgagtcgccgattccgcccggcgggaaccgaggagatacaaagcgagcgggggatcggcacccacgccgcgtcaggagatggcggcgctgacctgagagcacgagagggagctgccgcgcgggaggaggccgtgcctggcggcggccggagaggagaggggtcccgtgccgaccgccggcgacccgacccatcgagtgctccgatggtaacatattttgcggaacagcccctccttccgatcgatattaatggcagcgatccaaatttctgcagaataccccctataggttttgcaaaataccccctctccctgtttcgatgttttgtgagttgtgaccggaattacggcgatagattttggaggagaagagggcgaatttacagcaaccctaaaaaaaaaaagggtgaagattcacgaaccgcagtcgggtgccgagagcttgtggagactgacgggatccggcggcgccaagatctggatggcgcgcgcgaagagcccatggtgggtgcgggtcgccggagcgcagcggccggaggcggcgaggaggcgccgcattgtggaagtggacggatgggaagaagtgaagaacacggcgatgcgcgctgctcatgcggatgcgggtgagtttgttggctgcagctggagatgcatccaacggtacacgtaagacacgacacatcacacatgaacagtcaccaagtgcttaagcttggaactgcacgagcattcaacatttttctcctgttgatgtttctgaaagacgttgatagtggaagacgaggctacttgccgggcaaagctttgaccgtttctagttttactaccttgtcttggtaaaaaacaaagaagggaagcagtcaataattttcagtgacaagagattgtacttctctttgagtaaaaaacaaag

SEQ ID NO: 60506 - DNA, 20957 bp, Oryza sativa
gttgatcccaatttataaatgttttaccgtttgcaaataaacatgcatgtcttgctaattacatgggaatagggtttacctatctgctcgcttgtgccatgtttacttgatatctatcctttgtcaaccttgggtgataaattgactagctcgtgttacttatgtgacctagctagaactatatgcttagccatgcttaattaccactagctcagtcgatgggataattgcagtattagacattctagtatcttgttgagccgcgtgctcgagacatctggccatgttttgtggttgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtccgtgggttgtgtcttgtgggtacagttgtgcacctctggccagagtaaaactattcgaatagccgtgcccgctgatatgggcgatcgaccagattcaccgtgattagtctcacacttaataaatcgacccaatgcactgtagtacaggtgggttggttgggcctgttcaacatggtgtagcgttgatcattggagattttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgcgttatttacgtttggaactgtttattacttgtcgttttgtgtaccctggctggtcctggacagggatttaatgcacaaaatagtctggaaatttgggctaaatttctgggcgtgacagcacgacaagtatatctattaattaggaatagttttttagtttccttttgtctttagaaaaatatgtgtttagtgtccgataaggactttatgttttccttttatctttacgaaagtttctttcttgtcctacaaagactaatatctccccatgggtataaatatgtacacccggagtcattgtaaactatctcttgatcaatacaactactctcggcgcatcgccaccctctttaccgaggtttttacttatcaaccagcggaatttggcacttgaagcggggctgcatcggctttcgatctccggcgaaggggtaagtcctacgtttcgccggccccagtgaatctatcggctacattggtgttgttcaaggctgcatcgcttcgatctcttggatcgctctgatttggttgatatatttgcctacctgatatctcaattctatctctagttgcatttgtttagagacacatcggtttagttgggactgtcttggttaggttcgatcttctgtcttagccgatatatctctacaatcacaatgttgttataaatagatttgttatatccatcacattagacagatctatcggctcatcgagtattaaattatcatatacaatctcgtgctgcatcggttagattcgacctactagattattgttgataatataagtcttgttaagccgataggttcatgctaatgttttatcggggtgcaagctgataagttatctggacgttgcatcggcttgtaaggattgcatatacatatagttggatttagccgatcgcaacaaaagttttactgtttaatctaatcttgtggattttatgacatcagacctccagccgatgtatactttaacctttggatcaatacttgtttgactatatcatattgttagccgattggtttctactggattatattgctatattattgctatcagccgattgcctttatatcattatctacatcggacatatagccgattgctcaaaaccctatcgctatcggctggtatcggcatcggctggaattgctccatcggcttgtcagccgatcggctcattgatctgctatttgtatatcttgtcagttgcagtatcaaactgactggcacgcccgcatctcaacaacctttagacctgcactggagctaagcagatctctcaggccagtgtgtgtttttcacgtcaacagatattactatatgtttttattttctatacttggtgacaccctattttgtacaacttcaaattccaaatccatgtcagctctagagtttgtaaattagtttataataattttatattttatattttatctaaaatagaaacaaaagttcacatctaaatgttatcgatgtaaccataggtatagagacctatatattctgggttagaaatacacaactttaataaaaaaatcttagttctataagagcgaccccaaataatacctaaaaaactttttaaattgaactaaacattataaaacactaaaacaggtaagtttttctattacacagtatacgaacacacaccactatacacatagcatcatactaacgcacccgtgaattcatcctctaccacacgttcaaaagagacatcaaccatctctgcgcacctcccaaaatcaggctctcagatattactcgctcacagatggcttccgcttgcggccttccctttcggggcttgacgacgctgtgtcaagtcggcaacgcgcagatgcaggtggcaaggtcagcgaagcgaggcactgcgcacactggcacgacgcgcccaatgattggctcgcgagctgagagggccgcgaaaacgacgcgcgctaagcttagcttcggtgggcttctgcctgtacggcgagcgaagagcgatcgatggagatggatggatagtgcacggtccacgcggaagccaccaattttaaccgatccaacgtacacaacacaacaaaatcacacgaagctcacagcagcagcagcggcgtgccgtactgccgttcccgtgtcgtagtgtgtgtggcgtggaaagcgagcgatccgcgaccgcgcaaacgttggcgaagaaaggaacaggttttacgtacgttcgaccggttagtgccaaaactggatggagcttttctacttctgtttctcgcgtcaagatcgatcggtcgatcgatattggactaccggctttttattcgccggccctgccttgccgatcgaccgatcttttgcaatactggggaaatggggtgaggtaatcaccagtttagtacagacaagtcgaattgtattctttaagatctccctttttttttgcttttgtttctttttgcaaaagtttttttggttatataattggatacttgtgccaacttatggacaaatgaatcatcgatgcatcaatatgcatcgatgtatgtatggtttgattgaactgaagctacacgacggcggtagcggctagggtttcaagttattttgctttttgggatttttattttttttgccaaaactattttcgcgtaaagtcgctttaggtgaccacatacgaaaatcctgttttcgcatgtagttgcactacctgcatggaaaaataacagatatttacagacacctaggtgtagacaggccgaaggcctgcatgtaaaaatatgttttgaccgtctggaaaaatccttatttagtagtgttttgctctaattccttaatcttgtgtgccttttggctgttattggctttctcatcggcttttcgtatgcacgttaacttcttgagggtgggaatgcctcccatataggcacaagtacacaaccgctgcaccaccacctggtccttggatctagtgacctcaatctcatcatagcccgcatgtggcattgccctccatgcactcactctcggaagcgattgccacgtacactttcacctacacttcctagccgttagattcacgtattgcaacggtgatctcatcactattagatctaatgtcccccggtctaattgatcaccaccagatttggtaacctcgccattctcgtagaagagcttatcccacggtggtggagatgacatcatatccaacctctgcctttagtctctgatggagagggggcaggcaacgacggggcatggagaagggggaggtagggctcaaagagggaaagcaaggaaggagtgagggggagtaagggagagagggagatgagttatcagctaagatgagtggaagattgagctgcctgattcaacctatcgctagttcatccagttcactatggtttttatataggaaaacgtatgaattacccctttgaactatcacggcagtatgaattaccctcctagaccacaaaaccagacatttttaaccttgaactatctataccggatgaataaccccctttgatcaaatccgtcgtcgaccgccactgcgcgcctcaaccaccgaccgcccaggcgagctctgccttagctgcccatcacccgggcaagcttcgcctccgccgtcaactgactggtcccactactgcaggacagggcatgatccgcctccgcctgcttgagcgcgtacgcgggagagagagagagagagagaggggtatgacaggtgggcccaagggaggtatttttttatttttatttactgactagattgccacgtaggcgcaacgtgtgcaaactcaagtaaaaaccgttcaaaacagtgttaaggggggtaattcgtccggtattaaaagttcagggtgagtaatgtctggtttttgggttcaggggggtaatttgatatcgatcacgatagttcagggggtaattcgtacttttttcttttatatataatgaactggaaataatatttttttatcgattttagatgagcctgtagtgattaactgatttaaattgccttcctataccagtgaatcagtgattcaaagttagaaccggaggtgttaagtactcctacttgaggtatctaaattttacactaaaatttttggtaccttgaggtactttataaaggatggtaaaattaccttaatataaattatgagatccacatacaaaggttttatttcagatgcagaaattccgtgtgattaaatatctgcattacatttgtcagtcgtcacttatcatagtaaacgtgcagacagctctcttttaataattgacatgtttgtacgaatgtgtaacgattgagtcattggcacgacactttatgtagtgtcatgtccgacgagatctgacttgcgagaaagcacacacatacatgcatgtacgaattagcatccagtgctttaatgcttttgcaggttgaaattgtaatagtctttgcttcttaattcctccggtctaaagtataagtttggtcatcattttcatactctcacgcatatggcgatgctcaacttaacacaccacaggggttaaaccaaatcacttggtgacgtcttctttgccgtatttttatctaacaagtagattttggatagtgaaagagagccttttagatcacttaaaagctgttacacttaggttatgaaattgttttctttattccgacgtttgaaagtactccttgtgctattaggtaagaggtttctttttgtccatgtgctagcaagtatatttcttattatcttatatatagcctttgcaacctaggttttaattaagacgatccatggatatatagcacaagtatttccaacccaaaaaatatatagggtttgttcagattggtgccaaaataaaccttaccaaaatttggcaaattggcaacattttcaaaaaaaaattggtatgattggcttaataatattgtcaaaattctatacacattgccaatatttggtaacaaactaaacgtggtcatatgcctatcaattttaccaaataatagtatgattgaaaatgtcatcaatctgaacagcccataagctccctttcattatgcaatggtgtgtgtgaaagatatagcagtagtacgggcacatacgacctgcactagctgcagcctcaattgcaattcagtgctggttaccactaagcaagcacaacacacacatgacagaccagtgaaacaaaggaggaaaaaaagaaggcactattgtgtttggttggccccttcaatgtgggagcttgaccctacctgaatggatctatcaaatcaaaacccttgtgcaaaagagacacatgtaaatgtgcaatgtgtgtcttcccttttcacctccattggttctcagctgagaggcagtacatcatatagagatctttggcagtgcacagtccggacactttagggggacatcatatatacaaagaatgtttggccaccacaaacttcagctttatcttacaaaattcatgcatggttcatttatacaatttttctcattaaaattaatttcactcgttgcaaattctttgattttttgagtagtacctagttttgcaacaaaagaagttattggagaggtattacagtcaagtttgttattctttttctagttgtatatataggttgaatttgaatttttcatgtttgtaggacatatctcatattgatcatcatgcttttttttttttgaaaaaactatgatgatcatttgaatgacacacaaaaaatcccttggagaatgaaaagagtttcccatgccattgctctgaaaatatttcaggccgtagctaataaaaaaaagagtgagaacaataaaaaaagagtgagaacaatctgtgatgatatacatgtatagcactaaaataatatcagcggcaagcatcaatccaagcagaggacataacaagtaaaagagatttgatagcttgcaaacgaagaaaggcactaaaaacctttgcttttccacatcaaggtgaaagcgagatgcatctttatccaactggatactggagaactagtagagactaataactagtggcagcagcagaaagcaccaaacaagcaccccaaccaaacaaggcagaatccacccaccccaaaaacgaatttaaaggaggaaaaaaaataaaggaagctaacgcaacgtagaatctaattagcattgttcctctcactctcaggcacaaatcagattcttccaggagtcaaaggctctctctcaaagctttggctttcggttcacatggtgacatggttcagattcctcgtgtgagccagggaggagtcgacacggcggctgagagcactgagcagaatcgcaactcgctctgccggagattccaagtgccacaccaaagatactatttctctcctagtagtagtgcattctcctgcatggctgcaactatggacggctacccggctctatctttgcctttggtttttctctcgctttctcactgcttgcactagcatattaatttggtgattgatctgaatcagctgcatgcgttggccgtgacgaattcagaaaattgagggtcatacacataccaatggtctaaattgagcaatattgtatttaatgtagcctaaaacaacaacgagaaatggacattctacccggtgtcttgtgcgctaggtagtgtaccaccatgtataaccatgtgtgatgccattgtatatgaagctataaacgatgaaatatagaagtggattaattggagcacgaacagtggagtatattagagggttaggaaattgcacttatttatccgatttttttttcaaactttgtttagcataaatccattatggcgtttgtcgaagctgtgggcgtagaaagttgtccaaaataccattgttgtgttgatgatacgttgaactaggctcttattacgcatattgccatcgattgtcttgtcacaagagtcacaactcacaacacgatgatattttcacaactgttgatctaagcgctagatagaaagggatcgaattctgcagccgtggaggcaattaccacaagttggttgcgtccactgcgcgaaggtccattcagggcacaaaacctcgctttctccggcgtaattattccgtgtaaagcagcagcgcatctcgtggcagacacgcgtagtcgccaagcaatcatcgcgcgaggagaggagaggagaggaaggattgctcacagctcagagatcatatgattggtgatgaaacgaaaccaagctgaggtaaggccttagtgctgaagtgcccgagtgaaaagctggctggaggaacgaactggatatcagaaggtttgtgtttgttcgttggctggctcgatcactcggagctcctgctgcagattgggtcagtagtgaaagtgtgtactatgcatgagatgagtgcgtctttacaggaccctgttctgggaacttgtgacgactaacggcaagaatacctttgtggccatgatgaggatatgaatgcaagggcttcaaggatttgtccatattccataggagctggtacaaaataattgcggtaggtgacatgctatttgcaagatactccctattaacaaagctccgcgttaagacagaatcagcacatgtgtattttgcatcaagtagacgcacaagcatattacaggctgttaaggtgataaggtcccaactaaaacatgttattcagcactcgagatgcaagaacaccttatgtacaaaagcacaacgggatcaacgtgccccacttaagctccgagcctccgaccaatgcaaccatcaagtcattagctgatcagaagacatctttccttcctccattgtcagtgatgcactaggttatattgagtgctagtcattaatcttttcgtaaacttgtttttacttcatgtcaaccacctttccataagcctgttttacctcttcaagattttcagttaatcctcataagaaagggattgaagagaattgaggggaattaattccacactagatgtataataaatccccttcaaaaacaaggctttaggcagttagaagaaaacccttcaaaacaatcgtcctatcaaaaaccttaggacaagtagcattcatcgtctccttccataactatggtagaaaccaccagcaatgtggtgccgctgccgacctcctctgatcgaaccatcccaaatgccccgtccacctgatctgatactgctgccggtgttgcttcctccttgaccccaatttcccatctgtgacgatccaccattcatttcttcttcctccctttcattgtattccaggatcctgcgcttaatactctgcttctcctcaagctcagcagcctcttgctgctttgtgctttgcacaagtgagcagtcaccaggaacgaacatctgttttgtttgctgcttgtgccctttcttcattagcaccttaacacgcaccttgctgccacccccagcactaccaccctcttcatccacagtttcttctccactctcggactcgacagcccttgggtccttagaaccctcaaggacattcattggtaccatcatgttcaaagtggccctgggccgtacctctgatttacgtgactccaagctctcctgaagaagggctttcagctcccgatcaaagtcttctagctccttaggatcaacttgcacgactttatgtctaacctcaacaccttcatcttcatcagaaccagcaggaatgccatcatcctcatcatcaccttcattctcagatgcgtcatttgatttatcctcgaacataagatcttcctcgtcttcatgaccatcaatgctgccactatctgaataactttcactgtcagctccttcatgatccttgccattttcctcggctccatttgctgagctcctgccgttagcagaaaaggcagtatcatgtggctgcaccttctgagattcgctgtctgagagcttttcattttcaggcttctcaactgaggctgcacgctcactttcttcgagctcaagtaatgcagcatccagttcttctactgatgaatacctagccatgttgggtcttagctcagcaaacaaatcctgcaagaacacatggcaaaatatattttcggcatcatcaatgtaatgaacgccaacaaaaaaaatcaagtaatcataagccatatatctacagctccagtagagagtaatatattccaaaattcaaatgcatgaaactaatcctgtcgatttccttttgactcgttgtacaaacataataacaatggtaggattaagcacaaaacataacaatattgactggttacgaagttacaatgttctaagatatttcattgtttcacttgtaaagtacgtagtttttgcacagtgaccctacagaagtcaaggctcaagacaagatactccttgttctattttactgtttaatgtttcttgttagcaagaaaagtattgttgacttagcttctcctatttagcaaaacaaacaggtcgataggagtaaaacccaattttcttttctattctggtccccctagtttctcaagaaaagaaaggattacaggtccatttgcttaccaaatttcataatgctatttttttgtaaagttcatttggttacaaaccaaatacccatatttggcaatacccgaatatcaacatgcctcagaaatatgatgaagtaatcaatagaaagcttatgcagtcatttgacccatcttgttgggttttttcccctcataagttcataaccagaatccgaaaccactagataactattcttggctacaaacaacagcagtttgactgcacacatatgacactcgtgttttttttacttagtaacccagcatctctaatggagaagtttcacaaagtatatatgcatgttgggttgtcatcaggctgttcacatgataaagagtactaaaatgtacttatgaacattggcaaggtgtataatgagaaaaactaacctgaacgtcaaattctatgtcaagtggtaagggccctttactaataatatatctttgaaaatgcagcaagaacttgtcaagctttctttttgaagagcctctgttgaaatagtggccacaagtctgcagaagtgtaatgattaacctgatcctgaagcaatcttctggtggatccaacacatcttgctgggataaaaaaaaaagaagattactcaactgaatacaatgacagaaagatttgttagatctttcttaaaatcagcttgcaataagtattaaaaaggacatgagtaagaagatcaatgttaatgccacaaaatccaggcttttcactctaagaaatatgctgatgttctgtataatttggagtgtgtaatatgcacacaaatacagcaaacaagttacataacactaaagccaggcacagcatgattaacttttgatgaagttgctcttgtgttgtactgagcaaagagaaaggatcagagcacgaaacaatgttctagtatagcaatttaattgtttcaaaacagcaatcttagagccatgtggttttcttttttgaaaattacagagtctgagcctgcatctgaacatatcaacagaaataaggaatagtgccataaagttaaatgaagatataaaaaagtttccaatctttgctaaaggatatactcgtttacctcaggagttccatgaccaaatacgatgataaggtacagagtctcgaatacaactgatgaatcaatatgcttgtagctgtatagctctccaaggaatctcatgtgggcgagacgcctttgttgcattccatagtcattcagctccagccctacccttgtctcctctaaaacctgaattgaaatagagaataaagtaaaccacttggacatgatccacaaaaaaactgaaaactgccactttgttacaatttatttctactagctgacttgcaaaaaagagagcttgtggatagaattttggtggcgtagctatttctcaaacattccaaacacaaagattttgttcagaaacaaaggtaaattattacaatcagacatgcccctttggatcaaaaacaacatgagctaataccttgaacaaaggaactaacctcatctaccactgaaacagcaaagtcatcatgatggcgactaagaccagcagttagaagggcaatcagatgaacatggctgtattttcccttgtgaacctttagaaaacactttataaggtattgttggcactccacccaaggtagcttgcgtaattggcgaagaacatgttcaacacttgatttatcaagatcggagaaaagcaatttccgtatgtactgcagaggaagaaaaagacgatgaaataatcactactacactatactctgtagataaattcagtgaaaataatcaaagaaacgatcaaagaagacagaaattttacttgatgcagaggtggccgaacttttgaaactcgagcagatctttcaggtggtttacaaaggtaataggcattttctacaagtgtactgtggcggggatccaaattcttcacatttttcaatcgcatcagtatctccaacatgttagccatacgaatagtagtttcaggtgaacgatacaaaaaacgtccacaagtctcgagtagattgcaggccacatcaatgttatgatgactgaaatcatctaggcaggactgcaaaatatgtaagatatgagtacacaaagcaagtggaaatgcagcagagctataaagttccaaatcaatgcacaagatatgaataccttcaagcagctaaaaacaagagctgcaggtgcaattttgaatttgcacaactccccaataaacctaatgttttttatttttgtttcaatgttgatctgatcctgaaaaaataacaaaacagcgaggaatagttagtcacggtaactatcaaaggggagaaaagaaaatcttgcgtcccttaaacttaacatttcctagtctgtttggattatatgtggggaagatgcagaacatctggtccatgattgtctttgcttacattgatgttaatagcctaatatagatcggagagctaatgatatatagtccctccattattaaatatatattgttttagaattcatgcagacaaaccttgaaatcttaagtcactcgcatatgctataataatataaagatttcatatgtgaactatgtcattagtaaatgtcatgattttttaaacatagttattgttttacaatgagtatacgattagagaaggcgatgatcaaacatgtacattagagactgtaacaatgtcctaaacaataagtaaaagaaaacagagggcataccagatatcacaaaagaaaaaaacaagaattttctttcgaaaaataataaaagaagaatctttttgagaaggaacatgaaatgagcacaaataatgcaaagggaagaaaatagttaatgtcagcataccttcttatttattaagaagttgaactcctcttcaagcatagaaagaagcatacttggaacatctttcatacatgttgaaagtgtagccaccaaccgagaatagtaaggcaaaagttccagtgaagtccttggaacattgaataacgtccgcacgagtttctttcgacttgctttagaatttaggtagcaaaactcaacctggaaccaaaagtaagttatgaatgataattggtgttaaacatgaagtggatcgataatacaatttgagttaataccgtcaattggtcaataagatcacggctaacacatcctggcagcctctgaaggaggttgtctaaacttgcaccatccacagctcttattttctccttctctctttcagtttttctgtcaaaatccttctctttagatttttccttgtctacaccttttcccttatctttatctttttcttcactatccttcactccatcatctgcctttccttccagatgatattcagtgatggaagaagtttgaggattgtcatgtacgtcagtatcttgttctgcgacgggttccttcaaaagaacatgcaacaatggtttagggcaggacatgacacaatgacatacaaaagggaaatgatacaaaaaaaagtaagaaaatgcacatttaaaaaagcaatgaacacattccatcttctctcttttcctctcccaatccacaaacatacaacaaggacacagaaacaatcttgtgtataagatatgaaaatgtattggaacactttatcaatcaaaattgtaaacaaggaaatggaaagcattcattggatcatgctctgtcaaacatctccatataacatcacatatttgattaacatcaattgggaattaaaacactgcacaaatatttagcttgaatcaatctacatacactatttgaatttaaacagaatcgtcagccatatctaagagactgaaaaggtctgaactttgatacacagaagaaatgagcaaaatggagatactctggatgcctcgtgccactaaaaaagagtacccaaggaaacataagtgacaaccaaattgtcatgcagtgatatattgatatctaaaaaaccagtttacacagaaaaaaagtactaagtttggagacattgtgttcttacagattgttcacgacccttctcattcaactttggttcagcctctcccaataacacagcgggcacaaatgctctgctcgaaattaaggcatataggttaatgtagttccacaacaactaactagtgagagaagataacagtgaagatatgaagggaaacctgagatcaggtaaagattcataaaaagcttttgtatcctcatcatcccaaataggttccagtgcagacggttcttttgcagtagacggggctacatcacttcctgtagtaactctagttgtgtttccatcatctggcatcacggggggctgcatgtcaagagcttcagctaacctgcaaaagaaaggttaaagattggcaaaaaccacacacaaaatacatgcaactagatgataatgttaacatcatcaaaagataagtgccaacagttagtcaacacatggcaaaatagttatatttatctaccaaaatttaatggcattgaacagtaacactacaaagatcacgtgttggaaattaacattgatgtatcactgaatgtggacactggtcccaacttgccatcctcacattggatgcaaaatttacaatttaaccatttgcaatgtcattgagcagatctttttccccagaatgtgcggctgtgaattaactaaatatctgtggtcttttgcaatcacaaacatgaaaacatattataggataaaataggtagaaagatgtcttctatatcactttgtaaatcttttgcttagtaggaaggaaacaatgttttgaagttcgatcaaaacagtaaaattcgatttacatgatcaaaaggaaatcctctaagttacatattgtttttatactgaaatttgagaagggccaggaatgtctggtacatgttgtatcccagctgcacttaggcatggtatactcctcattcatgtgtatgtatattcatatgataaactatgttacagtgtgtgtggtacagaagaacaccatgattgcattgtaataaagataacaaattagaggaaattaaaatggtaaattccagggcagcacatgtcctgcaatactatgcaactataagctccctaacagaagaccagatgcgagaactggataaatggtagcttatgctgttacggaaccatatacaaataaattaaagataacactctcaaatgtatactcacgaggatacaccacgttgtaaatgatcaaaagacttccggagtttttcatacgaagcagtgttctcgtcgcttagttcacctttggcagttaaaacttttgcattctctgcctccatcagacgaagagactggggatagtgcatagttgggacgtattcataaaagatatcagaggaaagtaaaaaaaatgatgacaaaagaaggcaaaactagtatatataagagagcagttaccgcatgttctgattggagtagttcagctacagcatcataataagtgttcaaggctttcttgaagaactttttctgatcagccgtaacatttagatccttaaataactgtaccaattcagaatttgtgcggtcagatactcagcgcaatagtatggatactataatgcatggacaagagtttgttcgaatcattcaaacatatgagtcttctgaacaatgtgctagctggtatatgtattccagaatgctgtattggtagaatccttaggataacacagcttagcataaggtggggaagtagccaggtaggatcattttatacatacagatccttcccatgcttaagcccttgggcacaacgagtcaattatagcctaggcacttcctgaattgaagttccccaccattttctttttataataacaaaattaaaccttatgggtctatctatccttagtggtgaactagccaaattcgatattttatacatttctaaaagctgaaaaatgtatgtgcacatattcagaaacaaaaccagttgaatgatttccgttcaacaagtaaagagtagatctctcttcctaatgaagtctcatgatttaataagtatgcttaaatttctcttacctcatcataagcttcttgaccatgagactgtaaccctatgaaaaatctcccttgacgagcaaaggcagaaagaagagacaaatttgcctgagttgtttcccggtccttcaagtgttctaatgatgtaagatcttttataatgtttacaaatatactagcatcttcaacaatcccaacaaaatacagttcaattagaagtttcagtgtgcttctcttcttcatagctcttgagtttttgtctgcgtccaaatcttctccagatttcccaggaaagaatacctttagtagcccttgtgtaagacaaggagagaaatccttgtatctttgatgaagtaaggagcaaacctaaattacattgacacaatagttattatattacacaattccagatagaagtgacacttttggaagttcaagtctttatcaaagaaaactcaaaacaagcaaattgcagtaaagcatgatgcaataagtccaaataataactgaaatacatgtaacagcacatgtaaagagcatcactaggcaatggaaaatgcttcattatgcaacctagaaactaaatagtcaattgcattgaacaaaagaccttgctcaagtacaggtcggatggttccttatataggcacttttgcaaacacactaagaccacacaagttattcgaactcaattacctgaacagcagcttgtatatcagcagaacgaagtttggcctcacaaatataagaaactgcctcgctgacaaatttgctcaagttcacacttttcaactcatccatcaatccatccttctgttcatcatttattgttttgagtttctttataactgttgtatttcgcttaatactggagtcaagagtcctcaagtaatttgcatctgaaattagagaatcaccatatcataatagtgctagaaaaatgtggttatgacttatcaccattagaaattatctaatcaagaactcaaacatttttctgactgaatataactcaaaatttcattaacctcaacggcataaatattaaccatccattccaacgcaagagaaccaaggattacgagagtggtaaatttgagtaaaaaagacaaacaatgaattaaaatgaagtcattgagtagcttttgaggttattttcgtagctaagactccaaaatcactacaaaaattcctcatccacaacaatctcactttagcaaaaaattataaatattcaaattagtcactaatattcaccatgaccactatgaagtcattatactgaatgcaacttagtaccaggcctttcagagtttaggttgctccggcggagggcagtcttttgatcaacaagttttttgtattcttcaagacgagcctcctgcatacagccaaaatttaggatcagtgagcagaatttctgaagtcacgtcactagaaagtgcagacgaccaattgtacagggtagtttacaaattatcaatcttcaactagatctgccacagttctagaaacagcaaacgagtccatttcacaggcaatcaagagtacactttttacgcaaatacctcaagttaaagaaactagaactgaattggttgtaagggagttttcttgtgtgttgagtactaatataaccagaacagttttgtttgtaaagctaagtcaaatatgtgttgcagattcataatttctgctggtaacttcagttgttaagttgcgagattcagattcacagtaaacaagtataatgtggttcaatgcgtcagaaccatgctgtgttatgcccccatgtaatcaaagtatctctggctatcatggtgaaaaatgggaagcaaaaaacccaaccattataataatgacaaattatggacatcaacctgctcccttattgaattgcagccaacatccattgattttgtcaatgaaaaagtatcgtgctaaaatgagattaagcaaaattgcctgtttcagattgttactaaaggcacaccagaattacctcatcatcttgcttgttttggcgggtctcgtcatcttgcttggcttccttgctgttctcattctgagtgttctccattttattttacaaaaagtagaaaccagatatacacagtggaaagctgcaaaactagaaaagagaagaggaatgtttcacgttttagaaactagtagttcactgcaagtctgcaactgcaaattatttgcaaaatacagctaaatgcaacatccctgacaaacagcacaataagatatgcacgacatatgtgcatctcacgttaatgacaaagccataaaggccattatttagagattcacgctgatcactagagatctgtagtgctcaaagtacccaaacatacagaacttactgcagggcaactaatccctaccaccacacacacctaccccccgcgggccgcagagactgaattaaagtggatagtttctcccaattgcaaataaaaccgacaggaatcgaatcgctaggtttgaacgcatcaaaaccaaaaacccctagggatcgaactaagcgtgtgaaactactccctagttggcagcggcaccgcaggggtgtcccgaagcgggcggagaccgagaggacggtagggcgggcgcgccacaattcgcgccgccgccgccgccgccgccgccgtctcggcccggaagcccgagagagccccggcgcacggcgcacgggaggggaacgtgggggaagcaggggcacgtacctgcaggagagggcgcggcggtcgccggagacgagcgcgtggctggggagacgccgcgctttctcggtcggaggccggcacgaagggggaggttgcgggcgaggaggagaggggtgtggactcccggtgggagggcgcaggggaagaaaggggagcacgggaggggagaagcaggaggatctctctccttaaatgggcctaacccgtgaaaattggcccggcaatgacttcgcacgtgcgcggcccaatattagggacggacgcgggggagtgggagataaatgggccgaaagacggcctgactaagggggacaattacaatgcggaatacccatcggcctagcctaattagatggtgtttgaaactgatgaagaacgaaaaagctattattggcacataattaattaaattttgattattacaaacttaataaatttatataattgatattttaaagaaatttctatatataaaattttcgtatagaacacattgtttagtaatttcgccttgcagtaaaatgtgagaatgggccagattcaccggatccactgcatataaagtcctacgaactgaagaaaatggtacttcttcgaatatctaccaatctgctttgggagaaaatcaggtacagtacttccttccaaaacaatgtgataaaaagatccagcggagcatacttttgcaatgcattgctatgcaggagtacaaatttcaagataataagtaataaattcggatgcattcttgaaaaggaagtgtggtgctgcggtgcagtataaaggaataagattactttgactccctcaactgaccaccgaatctaaatcgtatccctcaaccgcaataccagaaatctcgaccccccgaacttgcaaaaccggtgtaatttaactccctcgccggttttgggaggtggtttcgctgacgtggcgccacgtggcgtctatgtggcgatattaaccgagtcttcggtccacgtggcgttaacgtggcaattacgtggcattagaattacaaaatatgcgtgggacccattagtcattggcacaaaaagaaatgtgggcccactgatatgtggggcccacatgtcagtcctcttcctcctccctatctcccttctctctctttctctccccttcttcccattcggccgacaggcaggagggcggcgagagcgagcgggcggcatcggggcgcatcagaaccgaactgggggcagcggtcggcggctaggacgacggcggctcggcggcggcgacggcgaggggaacggcggcggcgactcgcggcagtgggagggcgaggggaacggcggcggcgactcgcggcagtgggagggcgagcggaacgg

SEQ ID NO: 60507 - DNA, 3888 bp, Oryza sativa
aaagttgttggcccgggtggccgtttaaaaagctattggccgggtccaacttgttgcaatcctaaagattgacacattgcacatactccgaccggacgagacgcactgtctcatccgtgtcgcctgagaagcactcacttagttattttcagaaaagaattcaaataaaatcaattgcaaaaacaacagccttcccttgaagcctgcattaaacacttatttcccctggcttgctgagtacccccgtactcacccttgctctatataaatatccccccccagttgctgaagaagatgaagcggatcctgctgatgaggagttcttccaggagcaagccagctacgatgagttttagggtttcggcctagttcccaagtcgcgcctgtgatgtttggcccaagtcctggcttccgtttcccttttgtaatgcagttgtgagctcgggatctgtccgcagcccaacatgactgtacctctactctataataaagagacctctgttgctgtggtattctgtctccctgtgataccagcactgtttcctgggactggtatcgattaacaggctaaattggagcgtcacgggctagttccggtcgggactagttcggggcgtgacaagagatggtatcagaggacaggcttggccctagggcgaaacccgacgcttaggacgaccctaaggatactaagttcaaaactacttgcgaaaagctaaggtttcttttgctttctttattttcaatagtttgtttctaaaacggttactgatctttctccctctttcaaaattgtagatggcagtgaacgccagcttcagttcccacggttttggtgagggtcaccacgtcgcttagcttcgtgacctctcccgtttccttggcttctcgtgtcccgagtacacggggtactccgtggaccgtgttccccctcactgtgagctctctgtgtacctttacccccgtggaggtatacacggagctggccttcgcccacaccacttcaccgtggccaggcccactctccagatcgcgtaccaggacctctcctggactgcgcttcgtcacctggcccacgactacagccaccgtctcggaggctccgccttccggcagcttccacgccttccctctggccactcagacgccaggtacccttgtccgtacagcgagtctcagccagtgctgactcgcatggttgagctttcggaggctcaggccactcagcacgacctactccttgaggcttaccgctcccttgcccgccgatacgccgccttggaggcccgtctggccgaggagggtgtcacctcagttgacactatctcttgggactcaggacgcctctgccacgccagccacctgtcctcccacagctcccgcggctctgcctgcactcccagtggcccgcgctcccccagctcgcgtgcgccgtactcaccagtgtactccccctacccacacccagttagcccttcctacaccccggacacaccccagttgcttcctcccgccgtggcccacgctttatccgcaccgcgcggaagcgtgttgttggttcttccaccgtgttccgtttccgccacccagctcccccaccgccagcggcccgtgctgctgccggccctcgacaggttccgccggtcccttcgcgccagccgatcgacgtttcttcgactgaggagccgactacaggaggcagccaggccgacgaggagtagaggaggcagtcttcagcagccgtccgtgtgataggcccttttgttccgccgccaactcttttggagtcgtggcgaggtagtgcgtgcgtgtgtttgtggtgggtgttgtttggtagtctggttctcctaggtggtgtgcgcacagtcaagctcggcgtagctctgtgacttgtccacacccgttatatcaggtgtttttatgatttgaaaaatccagtttatgcctagtgtgtgctatctgagttgctatttgctttgctccttgccctcctaagtgcttatctgactcttaccccgcccttttctgggagtttagatggctagccgcccccgccgtgcagctcgtgcaccagcccgctttggttttgaagatggtagagttgaagcagaagcaaatcatgaatcagctaatgagcagtctcaccacagcaaccgttcgcaccgtactgtttcccgcaacgcagaggttgagcaaccccgccgcagcaaccgctcgcatcgcacagttttccgtaatgcagagatggaacaatctcaccgctctcaccgcactgccagtcacaattctggagaagaacacctccctcccccacctcatgtggaaaacaacatgcaacacataatggcagttcagacacaaatcttgcaaggactaaccacagccatagccagttttcagcataatgcgcatggaaatggccaccctcacgtgagcagcaatagatccaagctgacagattttctgaggtcacatccgccagagttctctcagaccgtcgagcccgtcgaggctgacgattggctgaaagatgttgataggaaactcaacttagtgcagtgtactccggttgagaagacgctctacgcctctcaccagctaagaggacacgctgcagattggtgggagaattactgcaatgcacaccctgaacccactaacattgcttgggatgagttcgctacggctttccgtgcagctcatgtgcctgaaagcactattgacatgaagaaagaagaattcaacagacttaagcaaggcaacatcagtgtcaatgagtacctaagtatgttcaacaagttggctcggtacgcccctgaggaagtggacacagacaagaagaagatcaggaaattcttgaaagggatcgcagttggaatgagactccagttgcttgctcatgacttccccacctttcaacatatgatcaacaaggcacttctacttgaggatgccagaaaagaggctaccgaagaatacaagaaacgcaagtctaaccatcagggaaattcttcccgaggcgcacctcgccctcgctacggtcaacccatgcaataccaccagtcggtcactcaggctaaccgccagccaggctacgcccctcgtcctcagatgaaccgtccggcacctcagccacagcagcgtgcccctagtagcaataccgcgccaaacagtgttacctccttcaagtcaccacagggaccgtcagcagttcagtgtttccggtgcaaccagatgggtcactatgctagacagtgccctcagaatcctaccaacaccaactcagggcatgctaatggcagcaccgccagaactcctactccagcggcagctcagtctcgtcctagctctcaggcaagtggacaaggttctcgtgcttccaaccactttggtcgaggaagtgtgaatcacattcaagctgaaaccgctcaggatgctccagacgttgtgatgggtatgttctctgtcaactccgtacccgcaatagttctatttgattcaggagcttcccattctttcatatcacaagcttttgtgaaaagaaatggttggaaaacccaaaatttgcgtgtaccaatgatagtacattcccctggaaggaatataagggcaactcaaatatgcccggaagttaaccttagaattgaggaagttgacttcctagccaaaccgatagtcctagactcgcaaagcttggatatcatcctagggatggattggttggctaagcacaaaggacagatagattgtgccgaaaagtccatcaccttgcaaggacctggaggaaagcaagtccgctttacccctaacacccctaccgcaagtcggtctatcctaacctgtttacaagtcacctccctggagtcggtacccatagtctgtgaatat

SEQ ID NO: 60508 - DNA, 1131 bp, Oryza sativa
cacagcgtttttcctgtttggctgttgatgttgtctgtcatttctggtagtgactctagaaccagatttagatgtagataatcctgtctcttaggataaaaggcacacctgaaagtacaaagggacttgtgcgtgtctcccgagatgcatgagggaattgcttaaccgttactagtagcatcttggaccgtctgaaatgtgcagtgaccatattgttttcattatccaagcacatgtcagcagctaaccactgaattctgttcaaactttttcgaactcgatacaatatgtcactcgtttgcagcatttggaggatcgctgcgcggaatttatttccatcagctattctcgaccgcggagctaggacagtgcgacaatgcacacatcgatttggactccattgaagaggacacgacctgcagctgtcaatcttgtttttgctgacggtgtgagtcggaacggatggacttgagatttgtttttatctgctgctgctactgctggtggatctagatcaacagtagatctgagttttgacagtttagtattggtccgaactctgattctgtgtaggagtagttatgatgcagaagcatacggtctacggtactgtagaagattgtttttgtcgcctcggtggctctccgtaacaggtcaaggcccgttatcagcacagattatgtatttcacgcttctaaaaagacattttcttttccccgcaaaaaaaaagacattttcttttaaaaaactttcttattacgttatttagataacctgttttaaactatatcagttaagacttataatataaaatactactgtttaattcaaatccatgataaagaaaatcatccgttagttttcatcaatcagcccctgaaaaatacgctgcctaatcttgatgttgtcagtggctcagttcaatgtaggacagtaggagtcgaatacctactacaactcgtagtaagtactacagtgcagtacttctaatcctagtggtatactatatgactagaaaatgccgtgccgcgtaattgaccagcttttatgaaataaatgaatgaaatgctctgataagtacacctaatatgttttacttcctccatttcacaacgtacttcctccgtttca

SEQ ID NO: 60509 - DNA, 2386 bp, Oryza sativa
gctacttgaagagttcagttttgcactcaacttaggccggagaaagtgtcaaaacaaacgtgtaacatattctaaggtcaaagtgaaagctggaaagagaaaccgggaagagataggacttgtgatcatcaaatcaattcatgtcacaacctcaaagacgttttcgagcaagggaaatggagcctgcaaccatttattcggcaacaagataaagcactttcaagtctcgtgtcaaacttaagtctttcacgacgtgaaagagtggctaccaactcatgtccaaaagcattttcggatggacgcgatgtaactcgccgaaattagcagacaaagagattcaagctcatgcaccttgcaaccactcaagaattaagataagatcacgtagcagagaacatcaacagagcaagcactcaccactcaccagacaccaagaacagctgcaataacctgtccaactctaaggctcaacaactccaggaatggctatcagaaggccagaactaacaagaagcagctagcttttgtactagtgtgtgtgatgcctgccgttcttttctattggcctgctgcttcctagtgcccctagagctgagctctcctttttatccttgcacttttcagcctatctgttcttggcaagcacgcagttggatggctcaacctgtgaatgatgcaagtgtgtactagtaggcatgtagcacgggttcctttgcgttcgtgtgtacgtgaccgtgtgtatgggactggatcgatgattgggaggggggccaggtgcaccgagcatcgatcaaatggatctagcggaattgagatcacctgcagttgtttatgactgcaactttcgcagtcatacaaccattgttggatcaaatatcaagggctcaaatcacacaaaagtactgttcatcagatactgtagcagatgaatcctgtagcgcgtactgtagcaagtgataacaaacagtactggtactaaatcatggcgttgaaatcttcgatccgatggtattgaagacctaagactgctaattttgcagtccatgttcaaactgcgtgggatcccaatccgatctagcgacgcctacggggttatggcttatccaggcaagtggggggattggtgatgtgatggatgcggggtttgttagtattggtttattatatcatcgtgtagttgttgtcggatggtggtggtgtcatggtgacacatgctgcaatgcttcttgttctttcttactacactgcccttctgggaccactgtcggcgttgggagaatgcgttttctcttgatttgattttctgatcgctgtccactttgcatgtgctgattgctgaaactatgattttgatccatgctgatgaagaacacgtacctccggagctacggtgttacttactcttatatagcaacctaatactagattgaacagattttaatcgtacgaatttaatcaagtactaagttgttatataatttttgaaacaaagggagggagtaatttaatttcgttcataaagagagcatgggttcccatccttcacaactgctgcaacttgtaggaacgttcgcaacttcgcatgaaggtatagtgcacgcctacgtgttgccgctgcaggacgatgtatgctcctttcccttgcttgcccatgacgagaactcaacagaggccagaaaacagctagtgcaccggaaacacagatgcatggttgcgagtagtgcaccggacgcacgcacgcgccatgacatggagtatattactgtagcacactacgggatagtggactttgtggcagctagcctcgccctggcgcgcgacgcgaccacgcgagagaggcagagataaggagtggacttttgcgcgcgtgcggcgcgtccgccactgcgtctcgtggtcgccgatcacgcgcgcgccggtgtaagatcgagagatcagatggacggtgtggtacggtactccgtatccagtggtggtcctggtctacagcgctggcgcgctctttcctcgctcgtgcacgcaacgcacgcgcgagcaccaccgcggctagctgcgcacatcgacgaggaatcagtgcgttcggtaggcggtagcccctgtagacggtagtgtggctccgcaccgcagcgacgactcgcggcgccgaggtgcgctttggcgcagacggccgaccggcccatgcgggcaccgaatggcgctatcgaatatcgatcttggagacttggacatgcaggctaagactgtgccggcagtgtcctgtgtcccggtctttcttttctgcgattttggacatctacagttctacactttcatggacacggtctgttgatttgcaactgcagggttccgaggtacaccgaccgtgttttccaactcgacctgttcg

SEQ ID NO: 60510 - DNA, 2841 bp, Oryza sativa
cttcatgtccagtagttggccactatttgtccaaggacccaggatagaccaaaagtggctgcctaactgttgggcttttatggccaggcgtatttaatcggttgaatcggtttgtcatgaatatcctagcggaccatgggaaatctccaggtttaataatgattttgaatgttgatgctcagctcatcagtttgtgagttgtgacattgatcccgagtttgatggttaacctgctgaaagcgtgttcttgcttaggctcaatctggaggcacttgacacacggccatggaccgaccttcgcctaaccatgcgcacatctcgcgtaaggcaagtgcgcactgagctcgtctttgtttagtcatggaaaccgcatgccttaatttgttaggagctggggtaatttttttccctgactagcgcgggatggcggtgcgttgcaatgcgaatggaaaagagaaccccatcacacatttaaagcctcaaaagttttagaaaaaattaaggtcacatttatcatcattttgtacctcacttcaatattttttttaagggatataaagtctaccaaacctgtcgatagcaccactatataggtacatgaatgtacatctaaggctgtaacactggtggagaaaccatctttacttccggttgggaaccccgtttagtcccgatttttcaaccgggagtaatgattcgggactaaagatacatctttaatcctggttagtaccaccaaccgggactaaagagaggggatctttagtccaaccgggactaaagagacaatagcgacagtaccagatggtccctttttctatttctttttttctttttattttctcccgaatcaagtaggcaaatccccaaatcaaagtaacatcccaaattcacatcaccaaatccacatcacaaatcataaagttacttatacacacaaatcaaatacatcacaatatcctaagaaattgctcaaatacatcacagatccaaacaatgaatcagaatttttaacttctcagtcaaatacatctaagtgaatcatcacattttttttttaaaaaaaagaatgccgccgctagccacgaccgccgggcgcggcccagccgcccgccgccgcgcgcggcgccgtcgccaggccgccgggcgcggccccgccggccttcgccccgcctgtagaatcgagatgtcgactagaggggggtgaataggcgatttaaaactaaatgacacctaatcaaaactaacttaagttgctaggcttggtgagggtcaactctaactaagcaactaagttatgttttgcaaacctagggtgatagtggctcaattatatctttagggaagtaagtcacactcctatgtcaatgtttagcaatcctagggtgatatgatctcaagtatgtctctaaaaatgtaaattgcacaaatgtaaatgcgacaatcaaatgagacaaggagacaagagatttttcaccaaggttcggaaattcgccggtttcctactccccgttgaggcgagcccaactccaccgctcaaccacgaagccaccgcacgcccccttcgtcaaggggtgggcaaggcgggagccggcccacggagaggactacccaagcctcgatcactagggtagttcttccttcactccgaaggtggtgaactccaaaccactcgcaaaccggcgccgggcctcctccataatcttctcggagaggtcaccgggcaactcctccacaagccgtctaggaggcggcaacctccaagagtaacaagcaatgacccggcgtgaagatgatcaatcaagtgccacactagctctacaaatggaagcaatgcacttgactcttggctaatcaaccctctaacacactagatggatgaacacaaagctcaagtgggtgtgagagaggtgcaatgggtgtatgcaattgaattgggtgccaagagagcccccttgctgctagaaggggagtatttatactcccaccaaccaaaactagccgttgggggcgaaatctttatgctctgccggtctgaccggaggtatgtggccggtcagaccgtgctactctgcaacggctagaaaactagccattgtagccctgtctgagggccccatcggcctgaccggtcagaccggcctcggctcggtcagaccgccatcggctcggtctgaccgaatacagctccgtcggctctgtatcggccatcccgagcagcaccatacccggcctccagggggccggtctgaccgcgcatgtgccgccggtcagaccggccatggccagtcagaccgccgttgtgaggccggtcagaccggccagggcacgccggtcagaccgccactatgtggccggtctgaccgcccctggtcaggccgagcccagtgaaagcaaaggtgattatgtgtgtgtgatgaaaatgtgagcacaagtgaaaatgcaatgacctaatgtggcaatttaatcatctctttgctaggtcattacccccctttatagtacggcgaaactaacaaataaacttgcaaatttgatcgtccttcacctcgatcaattttaaaattaaaacactagttttaccgttttcttttcttcgcttcgcgccatcaaattttaatccatcgatagtcatccatgcgcacacatgacgtggacctaacttaaaatatatctcaatagcaatggttagtccataattatcgcttgtcattaattaccaaaattaacaacgggggcctagatgcttcaatctccccctttttggtaattgatgacaaacaccacaaatatatataatcaaacatagaacacatggatatatactgcaaaggaaatcaa

SEQ ID NO: 60511 - DNA, 10637 bp, Oryza sativa
ttaattaatgccagcgcatatatgcatgcatgtcctggtcctggacacgtacgcccggaacgtacacgatcgagcagtgcatgcgcgccggcgacgtactggctttcgttctgcacgcgtccggaacgagattgctgagggacgatcgatcgcccctagcgatcagtccgtctcccctccctttcctccacctgattttcttttttatcaagtttacacatctaaagtttaaaaacccaaagtttataagtcaaaggtttatatattcgattcaaatttaaatttgaattaaaatgtttttttacatagtatttctatacatctaaagtttataaacccaaagtttataagtcaaaagtttatatacccgtttcaaatttgaattggaatttgaattcaaatattagtttatagacccaaactttataagtcaaaagtttacaaacccgtttcaaatttaaatttaaatttaaatattttttatatacagtatttgtatttctatacataaattttttcaactttgtctttttattttttttaatttttatggtgtactgtggtaggaagagaagaaggggaggaggaagggggagaggagggagcgtacaggggaggggcgggcggtgatcgctaggagcggtcacccgcctattagcctcccccgtgcggaatgcgatagatcagtgcgttcggccggcatggcggcgacgacggcggcagcatctcctcaacacacgaacgcatgtagagctgggacttgaactagcaccatagttattaagaccggaccggtaattgaaccagcgaggacgtcggttcactggttcattggttcaaccgccaaaaaccggttcgattgttttgaaccggtcaaattgaaccggccacaaaccatgtcacagtacatgcatttgatcttttttcccctccctgagtaatatgcgtgcaataggcccaagcaatgtcagtctttcttcttgtctttggttctgatgctgattcttgagcagtagatgtaggtgtactcccatcaacaggagttggagtatctgaagaatccattgctgtcaaaaatacaaataattactaatattgatttatctaaaaaaaatcaaagcttcagtaaaacaagtatatatgcattatatttcttcagtacaactagcaaagtaacaaatttgtgtcttctaaaaaatcaagatctgaaataaaatcgtcacaatagatcttaactagttcactaccaacggaactggcaatagcatagtagcaatttcagtagcaagttaggaacgtaccatctgccatggatgaagcttgcgtcgatggagagttggagactggatttggagcttggaagagctgagcgctactcgatggagattggagactgcagaacaggagaagtggagatggtgccgccgctcgccggagctggactgccgtgcgcccgtgctgcggtgctggtacagcagttcgtcgccgccgccgccaccgaaggtgaagggacgagaagtcgagaagaatacgccaatgtgaatctaatcctattccccacgggctgtaaccctaaaaattgcgtgtttacaatcttaccctttgcctttgttgtgtcacactgagaaagatgaggggtaactggtccaaatgcaaaaaccgcctggttcagttaaaaccgtccggttcgccggttccgtaaaaaaccggccggttcgagcgttttttagcggttcgattgcacagacggtctttgaagtgaaccgagccgctgcactctctggttccggttattagcggtcgaaccgccggtccgatccggtcctaataactatggctagcacgacgcggcacagcgtgcttcgtgccaaatagagccgtgccgccccgacatggccagcacggggggcgctgatacgtgatcagccgcgtgctcccgcgcgcttgcggtcagtcagccccctctagtctctagtctatatgtatctatacatcatatgcatatactatatatatatatacatacgtatatacatataattttttatgaatatgtttttaacacataaaaaatatatacacatatatgaagtttatatacgacgtatataaagtttatataggatatatacaaactttgtatacgatatatacaaattttatatacatacgtattaaaaaaaatacatcacgtatacaaagtttgtatatgcttatacaaactttacatacgcgtatacaaactttgcatacgtacgaatacaaattttgtattcatgcatcttaaaaaaggggaaaaaaaccgaacagaagagaaaccagaaaaaaaaaagaaaaaaccaaaccgaacagaaacgagaaaaatgaagaaaaaaagggaaaaaaaaagaaaaagctaaccgaacagaaacgaaaaaaggggggacaggaaaactcgctactccctcctctcgcgcggcgcgtctcgtgccaggccgcctcttcagcgacgcggcccaagcacggcccagtggtctgatgggcctattcgtgccgggccggcacaagcacggcccaaaagaagggagcaggccgtggtggcgtgcggcttcgtcgtcccgtcgcggcagtgacggccgcgcccaccctgctcgtcgcggcgatgcggcccaccgcgcggcggcgtcaatcagcgaacagttttgccaacggctggtgctggccttgctgctaccagctagctaccgatgaggcaatgaataagacgagcaagatgacaatttctctctcccttcatggcatcatcatctccatcccattgttgcaggcgtaacgacggcggcggctgcggcgccgcgaccttccagtgcctgccgtccgcagtggctagctagcaggcgtccgtcatccctgcaagttagttaattgcagcggcatcaacatgcttggtgatcatcactactgtaacttgccctgactttaacatgggggtgcaagtatgattgctaggggatgtctctaaggattatgatctggaagtttgtcttgttcaaagtgattattttaaatattgttctcgctctttagtcagtataacatcagtcatatggctcttcattgcaacagattacagactgtacaatgatctttactagtcagtgtacgattaattgtctaacttatgttatttggaatttaatcttaagtctaacgatcgtctgcttggtgctagctagctgatgagcatgtagacgacgaatgtgatgcaaagtgaaacaagaccttgattatacaggactccatcgtaatggcattgtgatccagggctttccacggatctcttcaatggtatagtatgggcggcacggcccaggcccggccgttcctgggccgagggtagtcgggccggatgccggcccggcagccatgcttggggtcgtactcgagcgaggatcttgtccctggcggcgtcgcaggcttcccgccacgccttgtgctccgcctccttccgctccttctcccgcggaataagtccactttccctccctcaacttatggccgtgtatgaatagcatccctcaaccgcaaaaccgggtataacccatcccccaaccccgaaaaccgttgcaaatcaactccccgaacggttttagaggcggttttgtcctatgtggcaattgacttgcttatgtggcagttgacttgctgagtcatcaagcgggacccacatgtcagcagtctccacctcatctcatcttctccctcaccagtcaccatgattcccttcaagaaacgggaaaggaaaaaatcaagaagcggaggcgaggcgacagaatcgagcagcaagatcaacggcaagacaagtagcatatgatggttgccgaattcagagaagacgctggcgatcacgcgaaacaagaaaggggaacgaacagaacaaatcagagaccatgaaatcgtcgaagaacatgagcaagcagcaaacaagctagcggagttcttctagcgtgcacgcgacacggagcgggtgtccgccatgcgcagctgctggcaatgccaccgtcgtccccgtgccggagcctctccgtcctcatgctgcagcacaacccggcgctcggcgacatccccagtggcttccttctcggacggccggcaagcttctcccgcgcgcggacggccggcgagctatttccccgtgcgcggacggccggcgagctactcccccgcgcgaggacggttggcaagatcctccccgcgcgcggacggccggcgagctcctccctcgcgcgcggccggctgacgagatcctcccagcgcgagcactgccggcgagatcctccacacgcgcggacggccggcgacttggaggggttgcctcgtcctccacgaccccctcttagacgatgccccggcgccctcccgcctcctctgcgtgctcgagctgggccactccccgcgcgcggcgtggccaaccgacgagctcgtcccccttgcgccgtcgtcgccgccctgctgatagaaggtgagaggaggaagatatgaaagagaaagaggggaagagatgagatgaggtggagactgctgacatgtgggtcccgtttgatgactcagcaaatcaactgccacgtaatcaagtcaattgccacgtaggacaaaaccgcctccaaaaccgtccggggagttgatttgcaacggtgtttagagttgggggatgagttatacccggttttgcggttgagggatgatattcatacacggccatgagttgagggaggtaaagtggacttattccttctcccgctgcctctccagcgctcgctcgccgtccgctctcgccgccgcctcgtcgtagaagaagggatctaggccgctccactcgtcgccgccgccgacgccgccgtcgtcctccgccatggtgacggctaaaattaaaaccagctaggttaattaattacctgattagttaatttcttcgtaattaaacaatgttttatatggttacatatgaccttatacgtttataggttggtgaaaatgatttttttagctgggctgacttgggccagaaattactttttattcgggttgaaattgaattgtttatcaagcaaacgagatgcaggttctgatttgattttcagcgtgatactggtttatggtttgtgtgaattctatagttttttacttattattgtttaatgaaaaaagtccgaattacacccttgaactattaggtgagtacgaattacccctcagacctaaaaaccagatatttttcactctcaactattaataccggacgaattacgtccttgacttaaaccgtagtggttttggtcctatatgccagtccgatcagcaattcattttttaaattgatagacctcacctgtcaatctcatcctctatctctccttctctttccctaatcatctctcttctctccttctctcaatcagagcagccggtggacggggagccgtggacggtagcgacagacggggatggtggcggaggcaacggcggagagggagcggagtaggtggtaggcggggacggggacaggagggggaagcagcaatggggtaatggagcacaagcgacggtcgatggcggaggtagttgggagtggcgagcgtcggacgcgccgctgcacagcgacggggcgacggaactcgagcggcggaggcggaggacctattgggctcccgttccccgccgccatggacgcctcccagcgagctcccccgccaccacgagcgcctcctgtctcccctgccaccgtgatgcatcctcgcgaactcccattcggtcgtcgccgtggacgcctcccagcgagctcccccgccgctgtgtacacctccctgagagagagcaggggagagacgttaggggaggggatatgttgagggagagatgacaagtgggtccatgtttttttttctgtattttttagttgactggattgtcacgttgacgtcatgtgtgcaatctcatatcaaaatcgcgcttagggaaagggcgaaagatatctggttttcgggtcgaggaggtaattgtacccactcgatagttcaggggtgtaattcggacttttacctggtttaatcctctgtttggaggactggtcgatctatcttatcctattgaaaaagatgtgagttgctcgatccatttttttcagtattaattactgcattgatactgtaattttgggaagaaaatggtatgctgttcttgacctactgtcgcttaattttcctatttttcttagcgttgagcactactacaaaacatcaaataggcgtcgggactataagtgccggaagtgttaaaaccggcacttataggtctttttccacttcggcgggttgaaatcgtaaaaaaccggcacctttatcaattataggtgccggttttaaagaaaaactgacacctataggtgtccgttttttaaacaaaccggtgtcgattttgttaaaacccaaccctataataaattataggtgtcggtttttgtaaaactagcacttataccaagccgagccgagccgatcgagtggtcttatccatatgaccgcacccttatctgtcacgcccagaaatttagcccaaatttccagactattttgtttattaaatccctatccaggaccagccagggcacacaaaacgacaagtaatatacagttccaaacgtaaatacttacagaagaggcacttagtcctcacaccgaaagagaacggcagcagcggaaaaaggcgatcctagcggggcttcagcttcagcttcactccacaggcaaaactcaactggggtctgagccttggtcttctaacttcgtcttcagctcagaagcactacacttctgaaaagggggaataatagcaagactgagtacaaccaccgtactgagcaagccacaccaacgatgcagacgtgcaaggggatacaaggaggggtttgtggctatttgcataaaggcagttgtaaaacattttattgagcaaaacagtaaaacaattgagtaattaaagtaatattgaatctccactgatcaacaggcccaaccaacccacctggactacagtgcattgagtcgatttattaaggtgggactaatcacggtgaatctggtcgaccgcctataattgcgggcacggctattcgaatagttttactctgatcagaggtgtacaactgtacccacaagacacagccccacgacacgttaccgtgcgccgacatgtcaccacgacataccggaaagaggccgtgacaggacccttcgcataaccccctctaaccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgagccggtccttaattgccatgggtgcgactagcaaaaccatgcacccacagcccaccattcagtcgcattttagttggataattacgaccatgaagcatggccagatgtctcgagcacgcagctcattctgatactaaaaaggtctaatactgtaattatcccatcaactgagctagtggtaattaagcatggctaagcatatagttctagctaggttacataagcaacatgagctagtcgattcattacccaaggttgacaaagaacagatatcaagtaaacatggcacaagcgagcagataggtaatacccggatcccatgtaattagcaaaacatgcatatttatttgtaacgagtaaaacatttataaattggtatcaacatgctcaaggggaatgtgtgacttgccttgcttcttcacttggagcttctgaactcttatccttgcgaacgcgatcttccgaaacgacaggaactacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatgaattttagaagttttgagccatttaaatgaatttctagaattattaacgaattatgacgcaattatcatttatttttccaaaggaaaagagggttgctgacgtcatcaaaggggaggggcggcgccggcaagtgggccccaccggtcagcggcacaagggcgccggtccaccgtggaccgggaccaccgaggcggtccaccgccggtccacgggaaccgacggtccggatcggcccaagccgatcgggcggccacggggtggcgcggctgggcacgggcacggcttaggccggcccgacctagcgatggcgcgcggcaacgcgaccaccggcggcgacggcgcggggagtggcggcgcacgcgagggaggcgcggcaaaggggaccgatcggcccgggcgagcagggcagcggcagccggccggtcgagcacacggcgcggcggcgacgcaccggcgacgcacgcacagaagcggcagcgcacggcgctaggagggagaggaggaggaaaccggggtgctcaccacggggcgacgccggagagaggcggccgacggagggaggcgagatggcggcagcgcgagagaggtggtgcgcgaggcggcgatgttccggaggcggagaggggagatggagtatgggtcggggtagagctcggcacagcgatgccgacgacacaaacggcacggcgcggcgacccctagggcggcagtagcgggcggctggaggcggtgaatggcggtggtttcggcttgcacggtgggaatggtgctgcgggggtggaaggggaggacggagtggatgccggggtgcggtgtgacgcggcgaagccgttggaggcaaaagcacggccgggcgagcggcgctcgccggcggggagcggatggaggcggctaaaggcgaaggtggctcggggtggcggtggaagcggcgttgcggcggtggattggggaagaggagcggtggacggggtgcgcacggcgactgcggtaacggggaggcgacggcgcagtgcggggtggacgggagcggcggcgcggcgcggctggagttcgccggagagcggcagcgcgtgggctcggcgcggggagagcgagagagggcgcagcggcttggggaaaatgggggaaacggatgagggaaggcgggatcgagcccgggagaggcggcaaccggcgacggagtggggcggcatcgtggcgggtgtggcggctcggcgtggcgtcgattccctcggggagagagggggagtggggcgggatgtggtcgcgaggtggaaggggtctcgagtccacgccggttgggacgaggggaggtgcgggatcggcggagggagtgggtggcgtggccgacggttggagctggccggaggttggggatgacaggtggggtccacgggtcccacctgtcggagagagagagggagggagaggccggctggggaggcggaacagacttgagggagggagagagctgagcgggccgagggaggaggccggcccgagagggagagaaagggggcgcgcgggccgcgggagagaaggaagacttgggccgaaaatggcccaaagagaggaagggggattttctttgttttctttttattttaattgattcaatgatctttgtgctattaaaattatttctcgagctccgaaaattcgcgggaaatttcagagagtattttagggcacaaagaatattacaaaatattctcggccaatgatttttaaaggaaaattttaaattccctcattatttcacttgataaaattgctttagcttttatttaatttctagaaaatgcattattaaatgatttttaatcccgaacgagaatcggggcattacattatcctctcgatctctctcgctctccgtctctctctctcgctcgctcgctccctatcgtctctctctcgtccgacggagtggcggtagcggcggcggccccgcggagggggccgcggcctcccctccaccagatccgaccggataggaggcggcacacctcggcaacagtagcggcagcggcagcccgacggaagcggtagcggctgctgtgcccctccatcctcctcgcagcctcctcgccgcaccacgctggatccggctgcctagatgtcaggggctgctggatccggcctcctagaggcggcgtcggcggcaatttgatggtgagtcttcaatttctgtgatttgtgtggggatgctgtggttgatgaatcgatggtgatgttgatgaattaatgctgatgttgaatttatgtgatggtgagaagtgagatgttgatattgatattgatattgatgaattgatgttgatgaatttttgtgatgatgaatcatgatttcttgtatatgggatggggagctgctcgatccagagccgatgcatcgagctggttttttttggctcctgtgcgtctcaaaggtgccggttatggaatcggcacctttgaccctggctaatcagtgccgccttccgggtgccggttg

SEQ ID NO: 60512 - DNA, 16800 bp, Oryza sativa
gatttggtctttttttgaggatatggtattttagtgtttattatggtgttttttaattgctttttgctttttattatatctatcggattttaatccaaagattaaaaatctgtgtgatacgataataaaaatctttcgaaagatgtataggtactccctaatttttttcccgttcggttagccctcagtgggtaaaaatccatgcaatccctacccgattttgctatccatctctcgcgatttttttatggcatttgacacttttttggcctccatgcaaccacttgcaatgcagcggcaattttgcaggtcgaacgttgcatgcagtgcagctcgccggccggctggcacatcgaccagtgttaccaagctaccccgcgcgcgcgcgatgatggagaagcacggtgtcaaggtggcctctgattggcgagctggccgccattagtacggccaacgctgttcggtgagcgacaccgcccctctcgtcatcgtcgtcgtgaaatatagagttacagtcctatataactaaaattacatttgtaaatttagttgatatgacatgtaaatgcactgtaattttgataaaaataatatttaagtaaatatatatttgtattttctttaaaatataaaattacagtcctatataactaaaattacatttgtaaattcagttgatatgacatgtaagtggacagtaattttgataaaaataatgtgtaagtaaatatatatttttattttctttaaaatataaaattacagtcctatataactaaaattacatttgtaaatttagttgatatgacatgtaagtgcgctgtaattttgataaaaataatgtgtaattaaatatgtatttgttatattctttgggaccacctatacatttgtcgacaaattttctcctaaaaatttgacatatataattatagtacaatcgtagtgtaattacactataacttgcatgtaactacagtgtaacttgtatgtaagttttacgtaattttgaatcgatagatctattacaagatttgttcttgtgaggaagaaaaaaatcacagcatacacatatatgaaaggatttgttcccaaggcctcaattttaccgaaataacatgttacggagagatttttgaaagttacatataagttatattatagttacagtgtaattgcatgtaagttacttacgattgtactgtaattacatctgtcaaatttttggaagaaaatttatcaacaaatatatagcaaaattgtattcttttgtagtccgttggatgtaaatctaagggtagaaaaaatctaggtgattttttttattggaaatcaccggacaaatggatagacacagtccctttcaggttctcttccatcaccaagacaccaacggaaatcaagaactcttccattgtctgtcttctcgcataaaaggttccacgtggtcgatgcctcagcgttgttctcctagggttcattagctcgctgctgcgccatgaagtacaggaaggggggcaacgcccccgccaccgagcccgacgacgacgccacgacgaaaggaggtcacgacgtgccgccgagcatcaaggtggacatcggtgagtaccatggaggaggtatcgggaacggggacggtggctcggcctcgctcttcgagccgcggccggaggagacaccggtgagccggaggaacgatcgcggcggcggcggcggcgggcgcgagccgccggagaagcggctcacgctgttcgctctccgcctcgccgtgctcgagaaggcggcgagcgggctcgggaagctagacttcgtgtgggcgacggtggtgctcctcggcggcttcgcgagcgcgctcagcaccaccgacttctggtgcgtcaccgtcatcctcgttggctccggggcgcgcgtcttcggccgcagccacgagctggagtggcagcaccgctctacgctcacctcctccaccgccggtggcgcgctgcgctccacctcccgccgcttgctccgcagcctcgggcactctcccgccgccaacccgaccgacgacggcggcgcccgtggcagtgcgaccgagacgcagttccagcaccagatcgtcgctcgcacgaagcagcgcgtttggcacgtgcccgacgtgtcgctactcccctacaccggcaggttgttcgtctccaagaacatcgggaggctcttcagctggctgcaggtgctctccgccttggcctgcgtcgcgctctcggtgatgcgcctatggcggcacgacttcggcggcgaccagcccaacaagcggccggcgctactgctgttctacacgttggcgttgatcgaggcgctgatcttcctgctcgagcaggcgtactgggtatggatgttctcccggcagaatctgatcaagacggtgagcgacgactgcaagctcggagagtactacggccccgactcgctcaagcgcttcttcttcgacgcctactcccgctgcatcacggggagcatcttcgacggcaccaagatggacctcgtcaccttcgccgaggagctcatcctgtcagagttcctcggcaatcagctcatcggcgtgcgcatcctgcagcagttcaccaccgagggctcatcggccaacgccggggaatccaatctcaacacgctgcgcaacgttggcacgaacgctcgctccatcgagcggctcgtggagatgatcaactggaagagccccggggaggaggaggtgcgccggtgcgcggccgaggtgttgtccaagctcgccgacaagagccggaacgcgctccgcgtgtccggcatccctggcgccatcgagtccgtcatgtccctgctctacaccgacgagagcgcgccggactccgcggcgccacacgacgtctcgccggcggcgcggagctacgatcaccagcagttcaaactgctcggcctgctcatcctcaagaggatcgccagggaccacgacaactgcggcaagattgggaacacccgcggcctcctctccaagatcatcgagctcacggacgcgtcgccggagctgctccacaacacgcgggcgccggagtcgccggttcgcatcgtgaggcgcgcgctcaaggtcgtcaagattctggtgtccgcgacgagcagcaccggcaagatgctccggcaggaagtcgccgataacgtgttcacggtgagcaacctgcgcggcgtcctgcagcacgggcagcagcacacggctctgcagaagctggccacggaaatactgtcgcacctggccatggacgccaagggcaagcaggtgatcgtgggcaccggtggggtggtcaagctgctgctgtcgatattcgtcaacggcgagaaggagctcggcgcggaggccggcgaggcgctggcgatgctggcgctggagagccaggcgagctgcgcggcgatcctcaaacaggatgacgtgctcgaccacctcatgtcggcgctggagggcgacggcgggccgcgtcgcctgaacgcggcgagggtgctgcgcaacctgtgcgcgtacgccggcgagaagcatcggcggcgcctctccacggtgaccaaagcgatgcctacggtatacatgtgtctaatatatttacacaagaacctttcttgagtcgtgagtcgtgacgtaattttgatttgattgttaattactatacactacatgttttgtatgatgacttgttgctgaaggtactgaaggccaccatgacggggagcgagaggaccctcgaggtgttcgtcggcctgacggtgcagatctgcaagttcatcgacggcgttcggttcgccggcgagctgtgcggcgccggcatcgacgagagaagctacgtggagcggctggcgagcatcctgcgggagcaccggtacccggacatcacggtgccccggatgcggcggttcgtggtgcagcaggccatctggctcatgacctcgtcctccgccgccgccgcctccgccgccgctggcgcagactacgtatcgcttctccgggaggccgggatggagcggctgctggagtccatcgccgacaccacgtcggagctggagtgctaccacgcgttctccggcagcgtgggcatcagcaagcaccgggagagcttctccgccgccgtggacgccgcactcgagctgctcggcggcgatggagctcgagctgaggcctgagctgcatgcaacggtcggaactctaaaatggcaaaggatttgtggtgccacgctggcacgctcctcccgcacgttctgtgcgtcttgatgattgcacaacacaaaagtcctattctttttttttcttaaaaacaaaaagaaatacactacacttatacgagtagaaatttttactatagctaaaaaatttgccactattacacaaggatgtatatatgcactatctgttcatgagattcactgaaataacatagtacatatttatagttttgtcgttgctttgctttgggggcatatttaggtcctatttgtttcagtttaagattattataatctagattattaaatcagattactctaaactggattataataagctggcataaaataagctacgagttgtttgtttctctggattattagaggcatctaagagtagtgggtcattagccactcaataatctgaaaaaaagctcctctagagaagattattggattatagtaatctggcttatagattataataatctagcataataatctacttgtttattttaacttgctcctaataatctagattataataattataagctgaatcaaacagggtcttagttttggaatttctaacacaaaaatctacaggacataagtcatagcatgataccccatggtaggtacgtaacccaggggttcatcagttgttgtgcgcaactccgtttgtaccggagcagcatgatttttgagttgtgtagagtatcattttgatcgagcaatcgatgcgttactagtgctacttaggaatgaaaagtgcattttctttcacatttacatcccctctgctatggatgtattcgagtattcaaatccagtcgcccaaatctcacacgaatttgacgaaaccctataaacatttcagtatttttttatgatcgccgtatgggccatgaggcccaacaacgggtgatgctgtaccagacggcccagcaactgcaatcatcacaagtcttcgacggctgcatccggcggcgacgacgcggcggcggcggctaaatcggagacccgcctcatcgcggcgcgagctgcagagtcgcaccaatggaagccgccggtggcgcaggcggagcaagcggcggcggcggagagtcgcagccgccgaagacgctggtggactgggcgctggagatcctcggcacggccgaccccgacgagaaggcccgcctgggggacctcgccgccacggagtggctgcgcggcgccatcccgctcccctacgacccgtcccgccccgcgcggccccctcccgaccgccccgcccggagcgccgccgtgcggctgctcccgccgtcgcgggcgcccaagctggggaagggcggcagcgcgcagagccggctggcgctgctgcactccctggcgcacaccgagagctgggccgtcgacctctcctgggacatcgtcgcccgcttcggcgcgccgctgcgcatgccgcgggagttcttcgacgacttcgcccgcgtcgcccaggacgagggccgccacttcgcggtgctctccgcgcggctgcgcgagctgggctcgcactacggcgcgctccccgcgcacgacgggctctgggactcggcgacgcgcacctcgcactccctcctcgcgcgcctcgccgtcgagcactgcgtccacgaggtgagcatactattaatgcacactattaattggattagcatatcattgccaaatcgactcactgatgattcgactgaggtgagggatgattgtagaattagagtagcatctcattgcaaatacggctttattactatcatgaatgcagtgctgggttacctatactactttagtgttgtaagagccaaaaacttgaaagctgagtgccttccatgaaattcaattgataaacagatcagtattttcatcatatttggttggtctcataattgtgtctcacaagaagttgtagatttgtgtttgggttaaataagcaaattgatatttttgttaaaaaaaagactgtatttgatacactgaaatgaataggcagactatagaaatttccatcatatgtttctcttaccttttgtatcagtaaactactaccattttactagctgtaagactgtaggtagtctatattttcttgcctctgatctagtataagtgtaaccgtataaagtacaaccgaatggcatcttcttatgatcgtaagttagataatgagctgtcactgccataaccgtagcccctggtatcatttgattggtcatgacttttgattcttgtgacagtcaatactttgaggcaactaaaatgaatttggacagatctagcatactgctttgcaccatttactgttgttttggctgtttgtgtaagatgttgatactcatagaaaatgaacgatacatttatccataagctagatgtaaacaaaatgctgactcacttgtgatatgcatgatgattttaatagacgcacaaagtgtatataagacgtcggtaattcaaaatggtatttgaaaccttgggctatgtatggggtcaaatgaccttccaaatcagtattttggaatgttaattttgtgtggaaggccttacacactaaatatatttgttcaatttgctgctctgctagtgttttttttccttgatgcgattggcgactactctctataattcgacccttaggagttatccagttttacagacctttaattttgaaatgcgatgtagtaataataatataatttatgtaacctatgtcaatatccctgacatgataacttcactgaacatttgtacaagtacatgactgatgaaggtccatttggaatacaggctaggggattagatgttctacctaccaccatatcaagattccgcgcaggtggggatgaacaaacagccaaattactagaagatgttatttatcctgaggagataacacactgcgcggctggtgttagatggttcagatacttgtgcctccggtcccgcaatggtgatccaactgcaagttcaattccgcaggctataacccaatgctctgaactcccacgagatggtaccggtgacatccacaaggtcgaagaggtggaaggtgatggaccgaaagccgagttagcacaagcctccaatggcgatgacaagacagtccaacaggtggaggatgaactggcaaaatgcaaactagtcgacattggagatgatgttgaagcagcggtcattcggactttccacagtgttgttagagagtatttccggggacccctgaagcctcccttcaatacggaggcgaggaaagccgctggcttcgagcctgcctggtatgaacccttggcagtgaaggaggtagagggacaagcagttgagtgagatgtttgatttctgccatgtactgtagcaggctagaacctacatggtgggcattacacttctgttgaacctcttcttccctgttcccttcttttagcagggaaaactgtactgaacttgtgatcatgttttgtttgccatacggaaaccgactggtctgtccgtggaccagccaaaccaaattaaagacagaaactttacatttcatcgcattagcttcgttgtaaatttcttcccccaacgcaatggaggattccttttcgtttagttgcagtaaagcacaatagaagtggtttccgcaattctgttgataggattatctagggctgtattgggaccaattgggcccgcaagaaacgagaagggaacataactgagacaccacatgtcagcgtcctctcttctcttctcttatttttctcttttctctcctctttcctttcgtctcctcccttcacttcttcagtaggctgggaggcctgcgggtggggcggcggcgggcaaagcaggcaggggacaacgcggtggtgggtggcaggcgaaaggcgaagcagacagggggcggggcgcatcacctgcggccgcgcgacaaccgaggcccgctccagcacggccgctccctctccacggaggccatccttgccgtgcaatccctcaagcgcatcacctcttttgaccgctccccagccgccgccgtgccctcgacttccctcggcgcctcctcaagagcgacctcctcgccgccatggctgagctccagcgtcaaggctgttggtccctcgccctctccccactccacgtcgcccgcatcgagccttggtactaccccaacccagctctctacgccacgttcgtgtcctcctcgccagtcactgaggatggcaccgccgccgccatggacgtgctcgtggaggcgttcctagaggaggagcgaggcggcgggttcgtggagggggaggaggacgtgtacaagctgatgcggcttgtgcgcacgctggtggcgaaggagagggcgcgcgcggcgtggagggtgtactagctggcgcgtgtggggactacagacagacttagatgtaaagctgagggacttcagatgaacttattccgaccgggaatgcctgggcccaatcggaccatatactccggcactgggcccaattgggcctgcaagaaacagcccgtcgtcacctgtggtggcttgcttttcttgccattggaagggtggaggaggaggggataagcgaggttgaaggagacgcacatccatcccggcggagaggatgctgctgctgcgcgccgccagggcgtcgccggcgatggccgccgtcgtcaggtgcaaacccaccaggctgaccccaatcgcgggcctctcctcctcgtcgggtgggggcaggaggaagaaggccgggcggcggggcgaggccaagcccccacccccacccccgccgcagctgcggggcggcgagacgaagaagaagaagaagccagacgcgaggacggcggcggaggcggcgcaagggttgcagaggcatgaggtcgagaggaggaagaagccgccgccgccgccgccgccgccgaagcaggagaaggcgaagcgcgtggtgcggtggaagtgcgcggccgggtgcggcgcgtgctgcaagctggacaagggccccgacttcccctcccccgaggagatcttcgccgagcaccccgaggacctcaaggtactcccaacgatgcaaaattctgcctaatctactactaccattctgcaacgtactacctccgtcccgtcccaaattataagcatttttcggcttcgataacgtctttactaacaatatctataaaaataaaacgttttaaataaaaagagttgtatattatgatagtttgtttagtgataaatctaggaacatcaattttacaggattgatcttttttatttttttctattaatagtcaaaattgaaaatgtttgacttgacactatccttatatttaaggacggagggagtatatactaaaacgatgtaaagaaaaatcgacgattacttgctgtttctataaattgcaatattgttatgacttatgaggtgatgcaagcttaatcaaccaacgctgatgaatgaatgaaatgatgcttcacgcctgcagctgtacaagagcatgatcggcgccgatggatggtgtatcaactacgacaagtccactcgcacctgcaacatctacgaaggtagtcacaaactcaacaggacgaatcctgtatgaccctggtgtgtaatgggccatttcacctgacactgttctggttgatgcgtcgcgaaacttgcgatcgtagagaggcctgtcttctgcagggtggaaccgaaggttttcgaggagtacttcggcgtgccaagccgacccagcacgtttgacagggaagcttgcaggtttgcttctcctgtcctgcctcgtgtatcgctgggttagttcgtcaaaggtggtgatttcgggtttgtttacttgttcgcagtgcttgtgtggataccatcaagatggtgtatggtgaggagtccgcggagctaactaactttaaacgtgtcataagggaagaaagtaaaaagcatgaagctagcctgaaccaagataaattgttggatacatagctcctggtaagaactctgtaagtctatagttctggcatggcccaaatcctgaattttgccgccctttacatctgtaaagttgactagtaacttgtaaatcatgtggttcctttagtgagtattgctaaccattcatcgtagagatatagaatctcatcgcatattgttttttcttagatatgcattccatatcttcaattgatttgaacattgtgatacgatgatagctcctttctatgatgtggtttaggcaagaaaaacaactgccaaacaccaaaatgtgtgaaaacagttcgtccaaaagattattatcgtagtgcctcactatgccaaacggggccttatatatggcagtgagccagtgaagataatcttgcaacttcataccatgttaagccttgtcatgacatgtttgctgatgtataggtttttgtttcaggtaaattcagaagacatcaatggcctataatgtaaaggtccatatatttatgtttcctgctgtttgatgtgcatcagtgcctcaaatggttaaacgtggaacacgcaccgagatgttgagggagttttacctgagatgttgctatcacggttcggaggaaatgaattgacacttgcaagttaagaaggcagtcggatatgctcaagtttataagcttgttgagtgagggttggtggtattattttttccccgttattgttaacaattgtttgctaaagcatagagcaatagttagcttggtttgaatgccttcatccaattctgatgatactgacctagctaatctcactcagatttgattctgaatgattaaatcccaacctaatcccattcacgatttggttttggtcttttgaggtgataaaatatgttccctgtatttttttccctttcctattacacttgcaatatgttccctgtatttgttttccttttttattccacttaagaaacatttctgctggagatataatcatataaatatcgctctcattctacccttacctttctaagtcatgcctagaggcgatggtcatattattatgctctctcgccattattgttctagtatgatcaaagattaaaggcttatttatcagcaagctctagtccatggctctgccccctcacattctagcagagctccaataaatcaataatctcaagcataacacagtaacacaccaagaaaagcagaaaaaggaattgaaatgccaacagaaaacagaagttagtatatatatagtaatatgaacacactgatacaaataatttgagaggataacgagcgttctacatacaaatcctcctcgagctgtcatgtgaacgattcttggatctcttcgagtgccttccctttagtttctggcactaaccttgccacgaacaacaccgtgaccaagctcgccgcagagaacagaaagaaggtacctgcgcacagaaagtaaaatatcctcagaacaatgagacaatcggccatagagatattacagcttggaacccaaccggaagcatatgttcatctttttcgaagctaaattcgactgttttatttacatatagtgcatctatcccatgagataccggtgaggtatgttttgctttctcttcctattgtcctaggtttgtaaggggtgaagatgccttacctgcagagttccaatccatgaggaaattgaatgagtaggaaattgcgaaggaaccaatccagctaaccagcgtcaccaagcttccagctattgcttttatttcaatggagaatatctgcggaaataaacaagggctcaggaacacaagttcctgacagacctccaagaatacgggagcataataggagtacaatattaacttgacggtgttcctttttcctacctcagacatgataacccaaggaacaggtcccattccaactgagtatgcagcgtaatatacctattgtaggaagcagtgtcagagcatgacatttcaaaaattcaaagatgcaatcatcagaaatattcgtctccaaatgtttgaaagaaacttatttgggaattggctgaaagttgtgaaatatttgaaagattttacattgaaagtacacaacactgtaaaagttaggtgtttatgaattctttaccgatatgccataaagagccaatgttggaaccagttgtgcatacactccttgtgcctgtaagaccatgaaacgcggatcaatcaaattggacggaaaagtaaatactctgctaagaatggtacaggtatacagggatagactccttgttccttaacctacatattatttaaattagtaaattaattaaggtttatcaaaactcttcagaattgttgatttgttcagtttcattttactgcaagttcatacttccacctggttatttaatgttgtctggagtgatgctgtcctgtcattgtttctccaaccaccaaatataagtcgtgcaacgaattgagtaatttgaaggtaagcaactctgaaaacagaagtgtatagttaattacttaccttgaagtagaacgataatccagtcagaaagcagcccagaaatgttccagacgcagagaccttaataacagaagaatctcacaatacataattgataattccagacccagagaatgataattgatctgtttcgttttattcaattggctcaggttttgtattgttcataccagtagaagggctcttcttccacttctatccatgagaagggcaccaaacaatgtgagtggaatctgaaacaattgcagttacagaaaatgttaggaatggaagcgggggtgggcaagcaggttttgttttgcccatttatcacaattctagttaatttttcttccaaattttgtactaccaagtaggaaatgaactactatgcagaggtttttatgtgggtagtgggattgcccacttgcatccctagaagatgttatgcccatttactttcattgacagaaaggacataaagccgacctgaaaaattccaatcaaggtggtcccaagctttccagaaaaccctggagttcaggaaaaaacaaattacagatagtccctctaatcagagaataacaaatatatccctccgttttttaatagatgatattattgacttttgaacatatgtttgatcattcgtcttattaaaaaattttatgcaaatgtacaagatataaatcatgcttaaagtactttgagtgataaaacaactcacaacaaaataaattataattacgtaaattttttaaataagacgaatggtcaaatgtgtgaaaaaaagttaacggcgtcatctattaaaaaacggaggtaactacttaggcatttgaatacctgcagaggaaaagatatagcttgtataaaatcccaaggcatttattcctcccagctgctgaaagaccatcaggccaacacccacctaagcatcatagtttgatgattattttatttctgaaaaacagcatttcgcatcatcaagttcagatcttttagggtaaaatgcaatgcctttcaacagcttgaaacttcttacaatgactgcaaacaaattctttctctgaaacaaatcttgaaccctggcctcaggtaagctacgaagtgattcgatatattcctgcataaaacaattgttataaacatcttcactacaaactactccctccgtcccctaatataagagattttgacattttgcttgcactgtttgaccatttgtcttattctaaagattttggaattattattaattttatttgtgacttactttattatccaaagaactttaagcacaacttttcgtgttttatatttgcacattttttttgaataagacgagtggtcaaacgttacaagaaaatagtgaatatcccttatattaaaggacggaggtagtactagaatgaatttagaatggaattaactctaatcccagcagcctcttcagatatgtcagcattctcccctctaagcttttgcagtgaagcattgaattctttgactctccctgtattggcctgccatgttattaaacaaaggacttcagttagagacatccactatgatagcttatgtcagggtttaactctttaacaaagatgctacatttcacattggactgttatatcatttgtcaatctgattaattcatgatctatttcaccgaagatgttatgttcccgtaggtgtcttccttttttttttcagtcatgcagtatataccttcggctatgggttgatttaacttattttcttacttaatgcaatgctacaaaattattttatgtattttctaaaatgaaataataagactaacaatatacgttgcattagtttgttccaaaaaaaacactaataatcatcaaaagttggattgataaaatcaatgtattttggcatccatattaaagaaaagggttatagttactatcttaccagccacctaggagattctggaataaacagaagcccaacaaggaggaaagcacaaggcactaatcctgggtaaacatgcagtattagtttcctttagcggatatcataagacagataatgcgtatatcttacctactagaaccaacgagcgccatgaaagaagtgccccaataatgtaagcagctgaacatcctgagcagatgaacaactgcatgcacagaagggccaatgctaatgtttaagaattattaaattaaataaacatcaataggctatccagttccagttctcctacctgatttgaagatgcaagaccccctcgaagatcctttggggctatttcagatatgaacacaggcacctgtgccattccatggtaatttaagtgcctgtaagattctaatgctatgttgacaagacacgaatgatacgttactacagaagatgtatgtgggaacataactgagaccgtaaattgtattactcagccaaaaggctatatatggattatgagattaaaccatacaaaatgagataacataaccacccttgatacttagatggtagtacactagtacccttgacacattacactagtacattaaactctatcttttcttttacagtatgaatagtcagatatgcattgagaaattagagatgctcaccacataggaaagaactccagtacaatagccgagcaagactcttccaagatagagcatcgtagcacccttcatctcattgaagacaacatttcaagctcatgaaaccacaaatgacagctaaagaagagaaatagttcgcagaggaacatacattggcaaaatatatggtaaaccaaccaacaatgccaataattgctgccaaccccatggtctgcagcagatgcaatggaagacatgtcacgagaacgaatgggaataacttaaactagtcatgaattcaatcacttcaccgttttgcgcccaagactgtctgcaaggcgaccgctagtcagagcgccaatcattgctccaattgtcaacacagacccaaatacgccgtactacaagattaacatgaatcgagacgattaaatttagaaaacaatggagaccattgagttgtaagatagtagcctcttgtacaacactaactgcagtaaacaaaaacttgaacttcaatgcgtattcaaatgctctcaattggtaatgcagaatgaaaaggtaaagaataagcataggcagatagcatgtatttttccctctgaccaaaataaatagcaattttgcaatgcggggactcatttgataaagatcgtgctacgaatcataacatattgggatgcttctttgaccaaatgaaatcaagcatgcacctggtaagctggagtactaagattacaacacaacaattaccccaattcctcaatgcacccacgtgaaaagattatatccatggctcaaggaaaaaagataatgcgtatgtgctaaccgacctctgaattggagagcccaaagtcgttcacgattccagcttgcgctggcgccgaataccccacctgaatttgtacattccatcaaagcacacacatgaacacaagcaatagccgcacgccttatgttttttcttgagatttagcgagctctcagtgcagcaacacaagaggcatcaagccatggggaggagtctgggagcgggatgcgtacgcaggtgccgaactcgaaggacccgcacacggccaccgcggtggcgaggaacaccatccacagggacccctcccccgcgccaccgtggggcgccgcccccgcctgcccctgggccgcggctgcgccaccccgagcagcggccggcggccgcagcgcgcagcaagcatcgcgccgccgtgccgcggcggaggcggaggcggcacagtgcacccggcgcgcggggcggcggtggttgcggtagagctcgaagggagaggaaggtgagtaggcggcggcggcggaacggcggaggacgagcggcggcgacggcggtgcggcggtggacagaggaaatgcggcagccatcatcgccggagcgatcgagccggttcacatatttttctgtgcctcatctgcttgcattttattgtgtttttttttcctttcatttgcgaaggggacacggtgtgcacacagggttcaccttaccgtttggggggggggggg

SEQ ID NO: 60513 - DNA, 6264 bp, Oryza sativa
tgctggtgggctagccactttcattcactgcgataatttccgtacactgctaccaaaggattctagggttaagtgtcttgcggatggtggatttttcctcgatgtgtatgtttccaaatcacctttgcacgtgctttgtgattttcaatatttttttcatgcatgcatgaagtacttgctagatattctgtgtcaatctgagtatttgcagctgtaggcacaaatagtaactagaagacttcaaacatccaaactatttgagtgtatgaacattgaaaatcttgtactgacgtatatataaaatgaaatcgtccaacgagatgatattgtgttattcttactccggtgtcttgttataaaatcattcctggactgggccaactcgaggtggtacatatgcattcattctgacctttcagattagatttttttggagtttgcacttcctctacggcatcacctaagtcactagttcatttcaaggcattaattgtcagcaagcaaacatgttgcacactccttcagcactagctgatcaggaataagaaagtatattcaatatgccattttttcagagagaaaaaaatatactgtaatagaaaattgtactgcattatcttcagcttctatctatctcattatgtttttttttctccattacagagaggacatttctgggcaaaggaccatgcgagcattctacaacgatgttgtccgtcttcaggtctttcccttccttcctcctataaagttatctgtttccaatactcaaatctctttctcgaatgtccttttttcaggatctgcgtggaaggtttccccattgtggtccaaacatggatctgggccaggttagtcatggtatgcatttatatcagtaatcttgctatccctgatcttatgctttactaaatcctggccattaactttgttccagtgcttcttcccaagtgaagttgtaaaggacatcatcaccccagtatttgttcttaatccagcgtatgatgcttggcaggtatccttatttccaccactagagttctccagtgttgtgtaaaactatcagtgtcaaatattcttaaaaattcccatttcaggtgcaacatgtgttgagtccagtagcatctgaccctcaacattcatggctagaatgcagactggatattagcaagtgtgattcgaaccaacttgaaattctccaaggttgagtcaccttgtgtcttattatataattaacttatccgcctttcaggattttgtagtcatgtttttctatatgaaacatactttgcaggttttaggaaaaagttacatgatactataagtgaacttaagcacaaaaaggactggggcttttttatcgactcatgctttatacactgtcagtcgttgaactccttgacttggcattctccatcttctcttagagtcaacaacaaggtaatgctttcatcctctaaaaagaaaacagaaagaaaaaaaatgtctacagttcaaggaacattatatattatgtcaaattgacaaattgtaggttagcctgtgttgagggctagcctttgcaaatttatggtgaccgtcagctgacttaacatctagtatttacagtgatgatgttcttgagattatttatgtgttttaaactattcgatgtacaagaaagaaaggtgtcctgttagtcacaagataagagtgactctataaatagtttgccgaggattcagcctataaaaaaacaggaagaagctcctcagcagtcagctgtgctactgctgtacatgagtacatcgtctaagccccataaatatattatttaatgtaacatcacaggacatccctttgtaggtcatctgttgtagattgcatgtctccactacggcattacctcatgttagtttaatttcctgcacatgatacttactgagctaaccatgaaggtgtcagtattcctccaatcttcttggtttacttcttcaatattttgctcgtggtctaacgttgaatctgctgaatagaccattgcagaggcggttggagattggttctttgacagaagagaggtgaaggaaattgattgtgaatatccctgcaacccgacttgccacaacttggtttttgccaagcctttcaaggcatgatgaagttctaaacacgtttctctttttgccatgatattgtaaaacaggaaattttatatcaatcatcggtcatcatgtaatcttcagactcgtcgggtgtttgacacccaaaatcatacatctgagatagttagactggccgaattttttttccacgcaatttatgtaggattataagtagtttattcaaaagtagaattgtatgtgctgtacttcacaacttgttttctataaaataaacaaaaagtgtatttcttgtactgttgtagtattgcctatacatacatgtctggtcaatctaccctatcataatttggaccctgtacctgccatcaatcagcttagatattttaattttccatacgattaacgtaatgatttctagctcttgaaagcaaacatgtcgttttcttctgaccttttgaccttgttctaataatatgcgtggcatattgattaattgaggagatgatgcaatttaactgacaattccatctcacgaaaaggccagccatgggctgtcatttgagatagatgggcatctaacctgtcattatccgttaagcagtgggattactgatcgtttccattacagggacgcgcacgaggcagcctgagaaaagagaaggaagctaatgaaaacgaaagcggccaagaccaagaaaacgagtcgacggtgatgccgcgttaggtcgctcatcaacagttgtctctctttccctccatttctggtccagccataaacaccattaataccgtttttttatcctctttccaaaggaaaatttgctcaatacttgactgaagttaacatgacattgttcatcactcgttttcagaaaagaaaacaaaaaaaaaagagaggggacattattcatcactgtagtggtagtgtgcctataggcacgtcactgctctccaggaacaaaacgacacaaccattgtctcctaattcagcgtctattgggacccaatgggagcacaagtaaaaacagccattggggctgagtgatgagccatcagagagtaattaatcgcactttgaaattattagttagtttctgtcacatgatgaggtgtggcaccaagatattttttgcttgagtgatcatatggactatagaatggccaaagcttcacaaatatctgtccgtgttatcgtcagttcgtcacaagaagcaaaagaactactaggtcgatcaccaagcctgacgtggaattgcagccatgacttggaaggtttccaaattccaagttgtgtgctgtgtcctggtcaaaacaaactacagtagcacttggcttgtgtctcatatagtcatctcctagtccttaaactctgcataacaacaaagcttttgccacaaaaattcttgttatctccatgaatttctttcaatctaaacccaatccacacggcagacttcagtgttaatcagagttggtcctcagtctcacctaaacctatgatgctaagtccatctttccaagtgaaatgtagtggtatgatttgtcgatagaaaaattatgctactcctggatctcacaatatcactgcaggtaggagcacaagagaaggtacagatcgcaaggacaaccatacagctacaggcaacaacagtcttcattttatcagcctgaagaaaagaaacaatctgatgctgatgccatcacgaacgaacgaaggaagccaattactagcagtaacaatccggctgtaacagccggacgacgatggacagtggcactgacagagacagtgacacgccaccacagttcaaagaaccggtacacactggagtacggtacatacaatgtcatcacataggcagagaccgcagctgctgaattcatggcgatccaatggaccaccctgctgatggctgcagcatcaccaggacatgaactcgcaccattataacacgagacaagggccaaaaatgggggcatgattcatcacacagaggaggaggggtcaggccggcgcagagctcacatgccatggcaggctaactttagaggtgacgaacatgaaccccgtttcacatctctgctgcatgcatcccttaaccacaccaacactcactgtgtgattgatgatgaattgctctcactcactcactcactctctctctggtctttcagagctcctatgcatatgctaagcttaacccggcaagccgaaaaatagggtgggcacacagacaatggggagtggagggttctacttatttagtccctatctatttaactttccatggatcaaagttgctccaaattagccattggattttcatctgggtttctgataccaacggatgttttgaggatgatgcggcgattgtccgtgcgttgttctgctttcatagatcgtgctcaggcttgtccaggttgctgctgtcactgtccgccatgcggctcgagccacggccaagctttgagaaggagcccatggccgaaggtagccctttgaagctgctgctgccctcactgaggttgtgagatcgacgcgaccgcttccgggtgagctgcagggatgacggcttgtcaggatcacaagcagaccttgtttgggccaccaccagccgtgagatgctgccccggcagaatgggcaggccggtgagggcggtgtcagggtcgtcggattgggtttgttgtgacagcacagtgccagcgtgcacggtgcacacatttgatgtccacagtcttgcacctcaatggtgcaagcctggtcgaagcagatgcagcaaagctccgtgtcgctcacctgtgcccaaatgatcaacacagccattcagtcatcatgcaaatgcacagaaagctaaattacacaatgtgtttatgggatcccaatctgacagataacactgaaattgttcagcactcaaatacctctgagcatgcatcgtcatcggcactgtcatcaccgggcgaaggggatggcagggagtactttgtgccattcaggattttcttctccctctccctgttggcttccatcagagctgcttccaggagagccttagcttctggttcaagctcactgatgaacttaagtggggatggccacaccatgggctctgctgatgtagggttcagcaaagctgcacatgctccatggttccgtttcagcgcaacagaatagggaattctcctggggaaacaaaaaccattaaaattaaaatcagtggcagagcatgggcaattcagcaaaaggacaggtcaagtttgagaagaacagcaagctcatgtgaattcagcaaatggtcagcgagttcacctgttactacttgctagactgaggtctactgtctaagaactgcagggattctactaagcacctaaattcaacacctgaacttcactaacaactatgcttgatagcacatcaatgttttcttctatatgcgccaagacaaaaactgaagggggaaagatctagttctcacccagccgaatccctttggagccgatcagctccccaggcaagcagcttcctgatgcaatccaagttcccgctacgagcagccaaatgaagcgacgtgcttccagggaagctgcatcaaacaacaccaccacacgaatcagcactggtagcaaggaaccaacagagctgaacagctgatcaccaaacattaatttgggatgccaccaagatcagcagcattacccatatgatcctgtcaaagccgacacaatggcgccgttctccagcaacacctgcacgcaccccggccgcccctgcctggccgcgagatgcagcggagtggcgccgtggtcgtccctgacgttgacgaaccgggcgaaacccctgccaagcttcgacagcagcaagtgagctcacagagacatccagagctattctatagctgtaccaaagccacacgacaggatgaggatgatctcaccatgagtcggccaccggcgtggtctgcgcggcggcgaggatggcctgcaggcagtcgacgtggccgtagtacgccgcgtggtggaggcaggtcctcgcgtgcaccgagtcgaacatcaagatctggtgcgaaatcgtaactgttactgattttttcaaacagaattactacagtattatcagtatactgattttgcagttcttttctctcacatttgcgt

SEQ ID NO: 60514 - DNA, 54653 bp, Oryza sativa
ccgtcctgttggatgagggagccagccactctggcgccccaaaaaggaccatttctaggataagttttttcaggggtctatttgcgaaataagtttttcaaaagaaccaaaatgtgaaaaatccagcctaagcctgcgaggctgcgaccgcctcctcgagcagcatgatgatattgctcggctcgctgccatcgcacggcttgttccccttaccgttttcggcgtggttatcggaccccacggtaaagtggttaccttgataaccgcaagatataccgtggttttaaaaaactttatgtattgtaaccgcgataaccgttaagtaaccgcactgttttgtaaaccgagggaacgatagccgtacagcgtggacgaacgcaagtatctgtacagaaacgcaaacagagatcgacgaagggaatgccaaacgcccagatctgggaggctacgacctggagcgcagatggtgtttgtctctgaaacagaggagaggacgagtcggctcaaagcaccagagagaaaaactaaccacaggatggtggcacgctcgtggtcgtgggcgcctgggcgacgaacgtgcaagctggagtatgagagagcgagccatgaaggatgggcaggccgcactcacgggcacacggcgagctgcaagcctgcaatgcctgcaaggctgcaaatcagagtccacggagctacagcgtgtcgttagagcaagtttaatagtatagcttactgctagctctaattcattatatccaatctaataggcaattcatacaatagttgcttactatattattaatatattgttccatctatcatacacacattgtgttttggagtccgcgctgtagctggttacaaatctgtagtccgttgctcttctctctcatattttatctcgttaaaatatgtttacagctggctaatagattgctattgtatctgctcttatgcatgatcgccattgttcccagataaacagaggcattacccccacggctcgggatctctactacacatttcagcatagcaaagcgccaaagcccattggccccaccggccaccgcgcataagccctcgcaacaacagccaacttgaagcagtggagctcaaaattcgttccgattctaggggggatcgagcagcgagcggactcccctcgcttaccgccgcgcttggccgccgccgagggacggtggatcgcggtgtcgggggactcggcgtgaggggaagcgggaggcgtggtccacctcgttaggccggtgcctactcccagcgacggcaccgccaggacgacgcgccgccgtgatctcggcggctccggacctccggttgtcttctcgaaccgatattggtacgcttccttctcaaacatcaatctccatgcctcgttgatgttttaatctgctactattattgagtattacctccgtttcaggttataagactttctagcattgttcatattaatataaatattaataaatctaggcacatatatatatatatgtttatattccctagcacagtgcctgtgcgttgccacgggtgaagtcaattttgattttacatatatatactctgtacatgcacgttagtagataaggaatcgaaagcgatgacatatcaaccgaaagtgactccactaaatcgaaccttctattgttgtgcaacgaattgacactcactacactcatacctaattgtttgttgttttaaatctactcgatttatgattataagaaagatattgataccaccttaaaataaaattgtttttttactgactcctatatttatggctacaataaattatttatttttttaggtcatgtaatattgtccatatcatgtatgcccgccgtcctcctcgtcatcgtcgtcgttgctgtcctcgtcctcgtccttgtcgtggggggtagtgggctaggggtggctgggtccaccagctcccttcaccatcgacgcgagggagggggagttgaatccgctgcccccatgcttcttcattaccggatccgttgctgccgcgcatccccactaccggatccgctcgatttatgattataagaaagatattgataccaccttgaaataaaattgttttttattgactcctatatttatggctacaataagttatttatttttttaggtcatgtaatattgtccatatcacggatgcccgccgtcctcctcgtcatcatcgtcgttgtaaccgtcgtcgttgctgtcctcatcctcatcctcgtccttgtcgtggggcgtagggggctaggggtggccgggtccgcccgctcccatcactgtcgacgcgcgggagggagagttgaatccgttgcccccgtgcctcttcaccatcggatccgctgttgccgcgcatccccaccaccggatccgccgcagtcggatccgcgcgggtgatggccgccgcacctccccaccgtcggatccgccgccggacgcctcaccaccgccagatctgtcgccgctgtcgcatccctcctccgccctctcccactgcccgagccctccaccgcgtcgggaggggggagaggggagagaaggagtgggggagaagaggaggaagccatcgtcgtcgcccttgcctaccgctgggagggaggagatgaatgggggtgatgggaaagagagaggactggagaataaaaaaagtgagaatctacgggggggtatttttgcatgccggtgagttaaacaccacattttcacgtccatatattttaaatggtccgtttggaaaaaatgattcttgcatacaagtttcttaagaagccgtatgggaaaatgggataaatttttgtaggcacaaacacttatggcctgtctgcaatctattcgggtggtcatccagaaaaatattttttaagtagtgaatggaaagatgacatgatgaatccaacctcattttttcgctcttggctacacttaatgctatgtatttgttggtgaattaatgttatatataaataaattaataagttgtaaatgtataataaaatttcctaaatataaagcatggatggatttaattctatgcgtggttaattctgctctctggaatttttctcggatttttcaaagctcaactactaattttaataatacaaagaacgtttcagtattatttaaataataaattaatcattaaatgatctggttttaatgttgttatccaagtatgttcaagagttttcttgatattatttgagcatttgaaataattttaacaatttaaagatcattttattggttaatttatctggagaagtaattaaaaatcccctctctttcttgggcctaatccgtgaagtccactttagcatcctacttcttcctgttcggcctagtagctgcaccgctaaaagtttgtttcacgtccttccttctttttttctcgggctaggctttttttccccaaagtccacatctcatccctgtcgctacagtgttgtcttcaacctctggccggagacagaacccgacccggcgccgctttccactccaaatccgggcgcccctttctattttttccaaaattggttgaggggaaatatttcccttatcctcctcttccgttttccccaagaatcggaccttatcccggagaaattaacgcggaatcgagctcggttcgagcttatctctccaaatagaaccctagtttttgtgaacaaagctgaaggcgacggtgacggacgaaaaacgtgggttaaggatgtgacgaccggaaaaatatgaatatttatattagttatagatatagatatatctcccatgctgattttattatttgtgtggccgtgagtcaacctatgtgatttgtatcagtctggattagagtccgatcgatttgctgacatatcgatgcttcgatcttttttccggctggtgcgtgcgaacgactcgtgagggaggatgtgaacacgcgcaggtattaggggagaagtcggacactaacacggacccgattctgatgcgcacgaggtctggattagagtccgatcgatttgctgacatatcgatgcttcgatcttttttccggctggtgcgtgcgaacgactcgtgagggaggatgtgaacacgcgcaggtattaggggagaagtcggacactaacacggacccgattctgatgcgcacgaggtctggattagagtccgatcgatttgctgacatatcgatgcttcgatcttttttccggctggtgcgtgcgaacgactcgtgagggaggatgtgaacacgcgcaggtattaggggagaagtcggacactaacacggacccgattctgatacgcacaaggtctggattagagtccgatcgatttgctgacatatcgatgcttcgatcttttttccggctggtgcgtgcgaacgactcgtgatggaggatgtgaacacgcgcaggtattaggggagaagtcggacactaacacggacctgattctgatgcgcacgagcgggcgagagtgcgcaagccgagtaggaatcgaagtcagatgacgtacgaaacatctggcaaaaacatcttaaacttttataataggtaaagattaacatatacttcctccatcccaaaatgtttgacgccgttgacttttttaaaaatgtttgaccgttcgtcttattcaaaaagtttaagtaattattaattcttttcctatcatttgatttattgttaaatatacttttatgcatatagttttacacatttcacaaaagtttttaataagacgaacggtcaaatatgtttaaaaaagttaatagtgttaaatatttagagaatgagggagtatatgaatgtgattccggtaaaaaaaaataaatgtgaacaatgctagaaagtcttataatatgaaacggaggaagtactgcgtaagcaactggaaatggagttatgaaattattactgaatggatctgttcatgattatacaaatttttgtctttgccacctggccttaattaatcccttacaaccatatattcctcacaaataatgatagtaatatacaacaggcgtgggctatccatacgtactgtaacctaaaattacacacaggaaataaaacaatacagcataccctgttcagaacggaactacaaagcatatcagatatcacttcaccgtggtatacctaattagcgtggcaaactaattgaagatgataattcttgctccagactgtagcaaccagaacctgggattccttcagatgttaaatcaccagcatttgtataaatattctgtgcataagagttactagtatttgggcttaaaaggtgctcgatttctccatcatttcctgggagcagttggaattttcttagcctcttagttttcaggaactgcagcctcatctctacttctttcatagtaggtctatctactcctttaactttcaagcatgccattgtaagcgaggcaattccatcgatctcttccttgtttgcctcttcaacaacctgaggatctattatttccattagagagccctcttgaagtccttcaacgaagtaatgagacaagctttgttttgcacctgcctcattaatgaaaattggtttctttcttattagaagttccacaagtatcactccaaaactatatacatcacttttttcagttagttgtccagtatgataatactctgggtctagataaccgaatgtgccttggacaatagtcaccacatgagtttcatcaagtgaaacagatcttgaagcaccaaaatcagagacctttgtagtaaagctgccatctaagagaatattggaagatttcacgtctctatgaaaaattggtattgcagcagctgaatgcagataggaaagtgcccctgctgcttctacagcaatcctaatgcgatcatcccatgacagcgagcatctaacactaagatcggtatgaaggtggtcatgcagtgtgccattcgatatgaattcataaaccagcagtggcacctcagattcaagacaacaaccaaaaatctttaccacattgcggtggataatttgagataagataacaacctcgttgataaattgatctatctcagtttgctcaacgatttttgattttttaatggccaccacacgctggtcagatagaatgcctttgtaaactgtgccatgtcctccacgtccaagaacacgagttccatcaaagttgttggttgcctcctctagttcttccaaggaaaatatcttcgttttgtttgtggcgctttcatttgagattagttgctccaagagtaggccttgatttttcttgaaatatgctctccgtattctcttttggatgcctttcctccacttattggcaagtatcattgcccccaacacgataactatggagccaagaccacaaccaattccaattgcaatacctgcatcaattcattttgtcataataaaatcattttgcatgttggctattacttcttacggtcttacctaaaagaagattgcgttgctttgctgatgtaacacacttctttttgattggatcaaactcttttctatgcgggcagcttgtgcatgtataatttccaagtaaattttgacacgtgccattgcaatagtttggcagtaagcattcattgatgtctgcaaaaaactatgattagtttgtcgattctcccaagttaaattgatataattcaatttctaaacatttgcaggcatgagcattgctggtgcacactggaggaggtgtgaagaggaaataacctgtgcagccatcctcgatgtatgggtttccttcaaaaccgggagaacacttgcaacgatatcccatgaactctttcctgtgggtgacgttcaggcagtagctgtggctactgcggcatgcgtatgtagtgttcttctgcacagctacttcacaagttaagttggtaactgcccatcttataacaatggcgtattccatagagagatcaaatctatcttccacagggcctgagaatgaataatcacggccagtatctgtggtctgaacaattatcgcctctttctcgtagtttgtgtcattcatcatgtttccgacagttagagtcccatcatccaaagacacagcagtcacatgatattgtgcttctcctaattcgcaaacagttaggttaccttctgtacaattaagtctaaacctttcgttagcaaaacaaccttcttcgactccaaaagggaaaggaatcttcatgtctccacaggatgttgaacagtgttctttatatttggggttgtaatctgttccaccatagaaattacaatatataataagaataagaaggaggttagtgacagtgcattatattttgcttcgttttgggggtaaaaagggggcaggcaggaagtacgtacccgtgcatccatctagaaggtaaggattcccctgttcataaccagagcagtaacaatgataacctccagatgacacattccggcaattgctgccagggctacacgcataacttgtgttgttcatgcgcgcgcgttcacagcttggttgatctatggtagcaaaagaaagtactgtgccttcaacattacttgtgtttgtccaacctaagaaaaggtcacttgtgtttgatatataatagtccgatgacatgaaagccatgattccagggtgcactggatctgtttgtgctacaggaatgccatccgaccgaagaattatggttgactgaaagccccgcaagacccttggtaactcgatgaaacagcatcccatcccattacaaggccctcctattggtgccttttcaccatcacatctactcatgcaagaacctatgaggtcctccgtgccatactcgaacaaggtagcatcgaaattacaaccgataacgtaaaatgtgttgtaatgatcaatagtaataccctctgttggggccacccaggatatgttgtaggtatccgtacctggtctcaccgtaatgttgaagtatatctgggccaaaacatacctataacccaagtctgtgatctcagtagtaccatcacccagaaagagcttaggagttttggcggtgttgcggcagatgagctcgaagccttcccggaaacagcccggcgctatcccgaaggggtagtcgatgccaacatctccgcaacgagaggggcaatgagccagggaatcattagaagggatagacaagagccctccgccaactccgtagactgcagccgatgctggggacgtagcagccgagcacagcagcacaaaagagacggcgcaagctgccactaataagctcgagctcatctttgcgccgatcggctagcttgcctagctttgtgggtgcagatatgtatgctaactacgcgtgagatcgattttgtattcagaggcaacgtctgtcgtctcttaatttatactgatcgtgcgcctgcagagacttaagtaaacgcaagattaagagcgattccccaagcgctatataacatatggagacattgattgatcagtatttcgatcagcagcaaacagttttgttgcaatctgccaagcctgtatattgtcctcgtatatgaacgaattccaggggcactagtcccatcagatatccctgtcgttgctggagccaacgactcgcccaactgccggtcgctgctcactgatcctatacacatctgattatttccacacgtccatggctatctgactatctaccagctggaaagaatggtactgtccggatgctattaatcacaacacacagtaacaaagcaatacacatgctactagatgacgaaaataatggcctgcggcgttgccaaactagagactgtagaagattcaatagtagatttttgtaggttcttttctaatgaatccttgaaaggaagtaacatgtcaagtcggtcgatctacactgcagttagcagtactctgatgtttctacaaactggccaattcgcccaccatattcttattgaaataattattcgataatcttgttatgcaaaaacaaaaaatgacaagtaatggggtggactgtggagtgaagatacgtacgtgtagaaattaaaggtgataaccacagatggaagaaatatatatgtggttgagagatgaaatgaggctgtgtttagatccaaagtttggatccaaacttcagtcattttccatcacatcaacctgtcatacacacacaacttttcagtcacatcattttcaatttaaaccaaaatccaaacttcgcgctgaactaaacacaacctgagtctaatttaggtgtgagtttgtttattcgtgtatgtctcaaactcttttagagctgtcaaatttatttctaagcatttaaaagctctgcattaacttttgaactaagacttcgagggaatgactacggccggccgtgttagaccaggtatatgcatgcccgggtgttcacggtaagatgacctcgcaagtcgaaatcatttctaccaacatgttcttcggcggtgactacgtacagctgacaagtacgtgacattttcctccccgacaagctagcgagatgatgattggaacgaccggtgcacgtgcgaaacgtttctggtagatgactgggaatataaattattcatacaagtcaattccgatctgaacgaaggacaacccacaaattatggaagtggtgtaataaatctggatcaactctgaatttatattgcaatcagttctgcgatctacacttatctatatgatctacacttatctatgtagtacgatttattttatctacaatctgaatggcctcgtaatttctggttcccaattttaagccatttttgcccgaaatcgctaataagcgactagtcgcgcgtgtgagcgcgcgcggcgagttcacccctactacttctagcctaacactgtttctataaacccacgggtctctgttttttgggcttcttcgtgtcgtgggctttcctgaaatgggctaatagccctcccgcgcgcgacacgacagaggaggcggcggtcggcgcgtatgggcgtacggtttcccttttttttgtttttttttccgtatcttttccggttttatttttttccttttttttcttcccgtatatttttgtgtttgtccgttttttaatagtatatgtatgctaaactctgtgtacgtataaatacaaactttatatgcatgtatacaaactttgtatatacgtatgcaaacttttatatacgtatatacaaagtttgtatgtgtattttttggtttttatacatacgtataccaactctgtatacatgtatataaagtttgtatacacatatatatgtttgtatacacttattttttaggttttttatacgtatacacacaaactttatatacatgtgtatatctttttatacattaaaagtgcatacatataaaaaattatgtatatatacacacgtatgtataatatatatgcgtataaactatatatatacatatgtatatacatatagtacgtatacatatagtacgtatagtagtatatataggataacagatcacactagagggggggcagctgatcgcgcgcgcggggcctcgcgcgactggtcgcggatcagcggcccccacttttgcctacgtgcataagcaagtatggcgtgaattctcgatcttcttcccggcctgttagtttttgggcctcaagaagcccaaccacgtgcaacgggagccctcaactctggacctcaagtccaacatcgtccagggcagcaacatccatcccctcggcctcatcgcggcagcgccgctcgtcgccctcccctcagacctcaccgccggtgcgcgggccacagttcatcgcaagcaactaagccacagcctcgggagggagtcggggggaagggggcggcgccgtccacctcagcttccagcacctcctcatggcggaggcaccggcagaaggccaggccgacacgccgctgtagctcagcgccgattaatttcctgttcgaaatcggtacgctccctcgtcaaactgcaatattattattgctcgatgcaatggctgcttttgtgtgcgtatataacaagctctggttcgaaacacactctgaagtaggagtggtcattagtaaaattatattttgcgaccggaggcacgctgaggagatgccctaagagtgattaaattggggttgctagcttaattaattagaggatatttgctggatttgtcaccgtatagggtcactatgctcgtcttgttaagctattacgagcagattcgtaaatatagtcccgcagactgcagttccccatgaaaacattgggaactcatgatttcaacattttctgagtgaaaattgggctcttgtcattaaaagaaacatctaaaataccaaattaatttcattaaatctagcattgagtatattttgataatatgtttcttttgtattgaaaatactacaatatttttctactataaacttaatcaaacttaaataagtttgactagaaaaaagtcaaacaacttataatataaaacggatggagtatattgcaactattaagaatgtggtactactatatattatccttgcaaaatctacgtccgttgcagaggccaattaactcgccgattctttccacaaatccagtatcagctggaaagaaagagtggcaaggtgcaaattgttaccaaccctgtcaagaccaggccgaagagctcaagatagcgacggcccaacactcgtataattgggccggactgggttgcgtaagagagtggctagcctgtgtatataaaggcctaaccttatgggaatcggtatcgaaaaacattgtactgaaacctctctataattcaaatcccatcatcctcctcctaatcctttgttctttctatcctgaactcttccattcttcctgtctccctctctcgctcttgctcaccaactgttcgacagaaatcccaggaagagttcgtaacaaatttggtatcagagcagtcgaatctggattatctagagaagccacggtatcattcgcgagcgcaactcaaggcgaacgagatggagcagcaacttggcgagctgatgactacgatgacttcaattcagaagcagaacgaggctatcatgatttcggtggaatccatcgaggaaatcaagccgatggttgtggagctagcgggatggaagccgacggtagagaaggtggtggcggaattgcgggacgaggtgggcgacatccgcgctcagctcgagaagatggtgaagcagcccgcgccgtccccaaatcaagtcaagtcggagtccgtcaagccggatcccgtcaagccggaggaaatggctccacgtcttccgacgccgcctggggcaaagcggctgccgaagaggacggtggaaaaccgaccttccacgtcggcgttcggcaaaggagcgcctaggcaattttgccaccacgaggcttcgaatcaccgggggaaggctgtgtggggaaacaactccccacgaactcccccggtcaagggtgcgtataactctacttcccctttccattcagttcctgagtcgagtgggggatgccgtgggtttagttttgggggtcaaatttctgcatctagagtagagtgcccagagtttgcaggggaaaatcctaaggcctggaaactgaagtgtgagacttattttgggctgtgtggaactccttctgatcactggattggtgtggcgatactccagttctcgggtactgcattgacttggttgcagtcgacccgagctcatgaagttagtgggagttgggaggaattcgctgcctgggtgtgtgggaaatttggtagagaggagttccaaagtttgattcgacagttcaataggttaaggcaaactagcactgtgtgggcatatgcagaaaagttcaacgagttgatgcatgggttacatgcgcatcatccctcgtggaattcggttttctttgttactcagttcatggatgggttgaaggcagaagtgagatctgctgttgttttacattgcccaaccgatttggatactgccgtggaattagcttgtttgcaagaggaagtactggaacagaatcgcaaggaggggcgtcgctttgagccgactgggggagcccgaggacccttgcacactggtgttggaccttttgtgccaaagggagatgataagctaactactgaagtttctgctactgataaagttgcagctctcagggctttccatcgagcgaaggggctttgtcacacttgcggggaaaagtggagtcgtgatcatcgttgtggccctactgtgcagctgcatgtgattgaagaagtgctacagcttttttctgatgaggttcctgaggaagtggagtcatctactagccccctgctgaatcagatgatggtgagttattggccatttctcgagaagctgtacttggtattgagtcttctcgtatggtgcgtttgtaaggattgatccaacgacatgaggtcttgatgttggttaattcaggaagctctcacagctttatcagtgagaagttagctaataaactgcagggtgtgcgcagctcgctgactcctctgaaggtgaaaatcgcggatggtggtatcttgcaatgttgtcaggagtttcctaattgtcattggtgggtacaaggggagtccttcagcactaatcttaaggtgttaccgttgggctgttatgaggtcattctgggcatggattggttagagaaacacagtccaatgcaaattgattggaagcttaagaccatacaatttgtgttggacagcaggcaggttctgttacagggtgtggtgccggatgttagctgttgcccggttatttcggctgatcaacttaagggtctcttccatcataatgcagtcctacacacagttgaactttgtgccagtgaagctgttgcaatcagtcttgttctgccaagagaagtggagggattgcttcaggaatttgccaaggtttttgatgaaccctctggcttgccaccaccaagagcttttgaccactctattcccttgctgcctggagcccaaccagtaaatttgagaccgtatcgttacagtccggcacaaaaggatgagattgaacgacaggttgctgacatgctcaaacaaggagtgatacaacgcagtgccagtcctttctcctctcccgtgttgcttgtgcagaagaaggatggtacttggcgattttgcattgattatagacatcttaatgctatcactgttaagaatcggtaccctctgcctattatagatgagttacttgatgagttggcacgagcttgttggtttacgagtttggatttgcgagccggttatcaccagattcgtatgaagccagaagacgaacataaaaccgctttcaagacacataatggccattacgagttccgggttatgtcttacggattgaccggcgcaccagcaacgtttcaaggtataatgaatacaatctttgagccattcttgcgtaaaggtgtgttagtcttcattgatgacattttgatctatactcggactttggaggaacatgtgcgcttgttaagggctgtatttgatattctctctgccaatcagttgcaagttaagagatctaagtgtgtgtttgctcggtcatctctcacttatttgggacatgtcatcagtgctgaaggggtgtcaaccgatgctaagaacattcaggcagtactgcagtggccggtgccttctaatgtcaaggaggtcagaggatttcttgggttagcggggtattaccgcaaatttgttcgccattttgggattctgagtcgccccctgactaattttctcaagaagaatgttattttccattggactgctgaaactcaagcttcttttgatgccctaaagactgccttgacttcagctccagttctcgcattgccggatttctcaaagacatttgaaattgagacagatgcttcagctgtgggtgttggtgctgtacttatgcaggagggacatcctttggcatttttaagcaaagcgcttggtcctcgcaatcgtggcttgtcgacttatgagaaggaatgcttggcgattctcctagcaattgatcattggcgctcgtatctgcagggtgctgagtttgtgattcgaactgatcaacgtagtctcattcatctcggagatcaaaaattagccacaccttggcagcaaaaagccttaaccaagttgatgggactgcagtatcgtttggtttacaagaaaggtagtgagaacagcgccgctgatgcgttgtcccgacgagtggccgatgattcaacagaagtattgtctctttcagtttgtattccagcttggcttgaggaagttcaaaaggggtatgatcaagatcctcattcttctcagctggtggctcaactgacactcaaatctgacgcattacctcatttttccttggaatctggtattttgcgctataaggggtgagtttggattggtgctaacccgcacgtgcagtctcaaatcttacaatctttacatgttggggcagtgggtggacattcaggggtacaggttacctactcccgtgtcaagcgtttgtttgcttggacagggctcaggaaagcagtaaagacatatgtggccaattgcactgtttgtcaacaagcgaaaacagaacgggttcgctaccctggccttttgcagtcgcttcctgttccggatcatgcatggcaaatggtatccttggattttattgaaggtctgccgacttcctcgggttttgattgcattatggtggtcgttgataagttctctaaatatgcccattttgtgcctttagctcatccattctcagcttttgatgtggcacaagcttatctctctaacatttataagctccatggactgcctcagtctttgatctcagatcatgaccggatctttacaagcactctatggaccactttgtttaaattggcagacactcagctgtgtatgagtacggcctatcatcctcagactgacgggcagactgtacgcgtcaatcagtgtttggaaacattcttgcggtgctttgtgcatgcttgccctaagaaatggtctcaatggttggctcttgcggaattttggtataacacctctctgcactcagctttgggaacttctccttttgaggtattgtatggccatcctcctcggcactttggtattgttgatatcgcagcctgtgcagtgccggatttgcaagaatggttgaaggaatgcactgttattacttcgttgttgcatcaacatctccaccgcgctcgccagcgcatgaaacatcaagcagacaagaagcgtttggagcggcagtttgctgtcggagactgggtgtttatgaaagtgcaacctcatgcgcaatcctcggtggcggtgcgagttaatcagaagttggcctttcgattttttggtccctttcaggtgactgctcgggtgggggcggtggcttatcggttggcgctgcctgcttcttctatgattcacccggtggtgcatgtgtcccaacttcggaaggcatcggaaccagcttcttctacggtagctaccctacctccagcggtggaagaagcagatcctgttccagtgcgagtgctagcacgcagactgatacgtcggggatcagcggctgttgatcaagtcaaggtttgctggtcgggctgtccaacatcggaggcaacctgggaagatctggagcggctcaaggagcgttaccctgctgctccggcttggggacaagccggatgtgaaggaggggaggatgttaccaaccctgtcaagaccaggccgaagagctcaagacagcgacagcccaacactcgtataattgggccagactgggttgcgtaagagagtggctagcatgtgtatataaaggcctagccttatgggaatcggtatcgaaaaacattgtactgaaacctctctataattcaaatcccatcctcctcctaatcctttgttctttatgtcctgaactcttctattcttcctgtctccctctctcgctcttgctcaccaattgttcgacagaaatcccaggaagagttcgtaacacaaatcctaatcacgatacactagcgttatacaattaccacaatctcctactaattcatacagatgaacaaaagaaggccgacgccgtttgccaaactagaattactttagtacgataaagccacatacgcttttgtatactcttgcttttgtatactctttgctcccgtaattttgacaaattgacccgtctataaaacttatttccaaaataagccgcgtcaaaaactaatttcaaaactaggccgacctcagcgttaaccccaatggtgctgagataaaacgtaccagcgccaccctaagagcaagtacaataataggctataagtcagctgcaaacatattttaaggaaataaatgatgagagagaagagcagcgggctacagatttgtagccagctgtagcacggacttcaatacacaatgtgtgtatgacaggtgggaccaggtattaatagtataatatataactattatacgaatgagctattagattggctatagatgaattgaagctagtagttggctatactattaaacttgctctaattggcactaatatcacgttcaacgtggcacggattagccacaaaagaggagctcagcgtcatgtgtgctggcgctgatatttacatggtttaaaagaatgtgtgctggaagtgtcataacgcagaagctagctcagtggtcaggcccctctactccagcccacaggttcacagttcgaaccgggaaagccggttttcaggttttttcttacttcctctttgaatcttgttctattgaaattttttttccaaacaatcacatattttgtttgtagatttatttttatgttactttttaaggggattatttattttattttatgttcaatctggaataaataaatttgaaaacattaattaaaatgttaaatacttagctcaattattataattttgtatttttaattttatgttgtatgatttaggttctcagttcttaccaagaaacgaaccctggaactctggcttgcagccacactgaccaaccgctgagctagatttaacttgtgtcagttattgcccacactaattttaaaccttctaagaggtcagcgctaactcatttggcgcttagcccgtggctaatatgttccacgtcggatatgaccttagcgccaacaatgctggcgcttggacgttttagcttagctcagcgccaaccctaatggcgctaaggtcacggcctagtattgaaattaatttttgacccgacttattttgaaactaagttttatagaagggtcaatttgtcaaaattacggctctttgctctctctacttacagtcagaagttctgccctacaagttgattagcactgtgtttcttatatgcaggagcaagccaacattggtcctctaatttatgagatggcggtggcgcaggcagcatgagcaaatagcgacacgaaaataacggacacaatcacgacaaagtggcacaactgcaaagccgaacagagggaaaatggaaaaagaaagagagaaagaatacaaagcccatgagcccaaatagcgtagagtgctgcggacggcggagtgcggagagcggagagcccttgcgcctccaccaccgcgcctcttgctcggccgtcaactggtggccgcggtgtcgaggtgcggggggcgaaagggaggcctggtccgcctcggcggtcgggctcctcctcttccccggcgcgatcagaaggccggtgcctcccccaagcgcggaggccagcaggccgccactctggttgtctcgtctgttcgaaccgaaattggtgcgctcccttgtcaaacggcaatctccattgttttgcttggtgtgttagtggttgtgtgcataatctaggtttgaattctttttttaagtctaattgtactggtatggttaactccatagtcaaattatcaccattggtaaactaaactgtcttttgcaaagctagagaatttggagccaaagacaatagcatttttgtttgcagcataggtacttactactacttgtggtccggtttgctattgggatagagatggtgatggggtgtggagtgtggactgattctaacccttcacttttttcccttattcctcaatcaaaccataaattagatttcctctatatatatcccaattcctatgaccttatcccaccaaatccaaacaattttacagttcccattatgaatgcagggtttttggacaagtgatgaaataaaaaatttcaaccgtgccatttatactttgtgtaaaggcattcggaacgttctctgagttccaagttctgacttccgacaagctctataatactccgtattaacgatgtcactgctatgtggaaaaaaagatccagcatactacaaactgagttattagtcagatacctattggtgacccttactgagcaagacattggcaatggagtaataaaattattactgaacttgttcactttgccaccgtagcttaaatacaatattacaataccatgtcattccttacaaggatattgatcacaaataattatagtagaatacaactgtcattctatcaactcacatgggctacacatacatgctgcaagtatacaggaagtgaaacatgcaaaaactcttctctggactgaactacgtaacataacacttcgtagaaaatatgtgataactcaacactccatgttacatatatagctagcgtggcaaactgactgaggatgataattcttgctccaaactgtagcaactggagatcccttcatatgataaatcacctgcactggtatagttgttctgtgcttgggatttaccagtatctgggcttaaaaggtgctgaatctctccaccaattcctgggacggggagaaattggaattttcttagcctcttagttctcaggaattgcagcctcatctctacttctttcatagtaggtctatctcctcctctgagttttaaacatgcctctgtaagtgaggcaatatcatcaatgtcttccctgtgagcctcttcaagaacgtgagaatctattatttcgataagagatccctcacggagtctgtcaacgaaataatgagacaaactttgttttgtgcctacatcattgatgaaaatcggtttctttcttgtcaaaagttccaccagaatcactccaaaactatatacatcactcttttcagttagttgtccagtgtgataatactctgggtctaaataaccaaatgtaccttggacaatagtcaccacatgagtctcatcgagtgaaacagatcttgaagcaccaaagtcagagacctttgtagtaaagttgccatccaagagtatattggaagatttcacatctcgatggaaaataggtattgcagcagccgaatgcagataagcaagtgcccctgctgcttctgaagcaatcctaattcgatcatcccatgacaatgaggatttaacactaacatcagtatgaagacgatcatgcaatgtaccatttggtatgaactcatataccagtaagggcacctcagattcgagacagcaaccaaaaagcttcaccacattgcgatggataatttgagataaaatagcaacctcattgataaactgatctatctcagtttgttccacaatttttgattttttaatggccaccacactctggtcagatagaatccctttataaactgtgccatgtcctccacgaccaagaacacgagtagcatcaaagttgttggttgcctcttctagttcctccaaggaaaatatccttgttttattagtggcgctttcatctgagattagttgttccaagagtaggccctgatttttcttgaagtatgctcttctaattctcttttggatgcttttcttccacttattggctagaataatcgcacctaatgcaataattatggaaccaatgccacaactaataccagttgtaatacctacagccattcattatttttgtgccgtgaagccactttgcattatcttaatgcaataagattgactaatctgtcagctatgacttacctataataagattgtgttgcttagctgatgcaacacactgtcttgtaattggattaaactcctttctgcgggggcaactagtgcatgtaaaatttccaggaagattttgacatgtcccgttgcaatagtttggcagtaagcattcatcaatatctgcaattaacgcttcagttttttttttgtttatattggtacaatataaatgcacaggcactactacctgcttaaaggggaaatgccgtggttaaactatccacataaaatttctataaaattattaaacatttgcaaattggtgggaatgaagaggaacaaaccttcacatccatcttggatatatggattccctcgaaaaccgggaaggcacttgcaacgatatcccatgaatatgttcccatgggtgacgtttaggcaattgctgtggatactgcggcatgcatatgtagcatctttttttactgcggcatcacacgttaaattggctactgcccactttatttctgcaccaccatacacctgggatattatgtcctctcccccatattctgtgtcgttcaacaagttgctaaccaccattgtcccctcttcaattgacacatcagtcacattataacgtgcgtcccgtgggttgaaaagtgtgatgttacctgttgtacaattaagttggaacctttcacttgcgaaacaaccttcttcaagaccaaaagggaagggaattgccatgtttccgcatgatctccgacagtgttctttccgcttggggttgtaatctgctccacagagagagaaaaatgaacgaaaaaccgatacggaagacttttgtttgcgccttagaaagagagaaggaatgaaaattcgatatgcaaataaagctctctatatgtgtgtgccttagtagtatttaagtggagaaaggtagagaggaatcacctcggatgatgcatccttccaaaaggtaaggactttgttctgcataataataataaagatcataattggcgcactcacaggtgtaacctccagatgacatatttaggcagttgctgccggtgctacaagcataactcgtatttttcattcgagcaatttcacaacttggttggtccatgattgcaaactgaactaatgcttcctggatattgcttgtgttcgtccaactcaagaaaagatcagtcgcattatctacataatagtcattgtatgacataaaagccataacaccatggcgcagctgcagctgatatgattgtgctgcagtagcatcaacttggactagtgttgaccgaaatccccgcagatcccttgataacttgatggagcaacatcctttcccgttacaaggcccttctgttggtaccttttcaccatcgcatctactcacgcagtaaccaacagcgtctctcgtaccatactcgaacaaggtgacatcaatattacaaccaataatgtagaaggtgttacgctgagaaatagtaactcccttcctgggagacacccaggatatgttgtaggtatcagtacctggcttcattgtaatgttgaagtgcatgggtgcccaaagatcatcgtcacctacatataagatctgggtggtgccatctttcatatagagcttaggagttttggtgctggtgttgcacttaagctcgaagccttcccggaagcagcccggcccaatcccaaagggataggcgatgtcgtcaacatccccgcagctagaggggcagtgagcgagggaatcattagaagggatagacaagagccctccgccatctccatagactgcagctaatgctcgaggcgtagtagcagccgagcacactagcactaaggaaatggcacaagctgccacaaagctcgacctcatctttgcgccagccgagacttgcctttgtggtgcaggccggtgcctgttaactacacggtcaatttatattcagacgcaccatctctttgtgctcgtccgtggacttcgtaagtaaacgcgagattgacatcaactcccacaagcggtcggttgattagtgctcgatcggcagcaaacaattttcttgcaatttaccaagtctgtgtatttgttgacgctgtatcgacgaagtccaggggcactactcccatcagatatcacgtcgttgctggggccaacgactcacccaactgtcggtctctgctcgactcacccaacgactcaccctattcatccgattttttccacgcgttcagtagctatctaccggctggaaagactggtactgcccgaatgctattttgatcataatacacaaacgtgatacagatgctattgctaccatcttgcttcatattagatgatgaaaataatggccggcgttgcgaaactgactgtactacaactacaagacacgcacatagacttgtggttgtgggaggttgttctgctatcgtacaggttagaattcttgaaagaacgtaacatgtcaagtcgttcaaaactgcagttagcactccgttgcttctacccaacttgccaattcgcccactatattcttacttaaactattcgaaattcttaatatgcaaaacaaggacaagtaatggggtggagtatatccacagataaagaaatatatatgtgattgggatgaaatgagtccaatttaggtgggaacatgttcaaagtctggttcttcgcgtgtatgtatcactcttttagagctgccaaattatttctaagcatacttgtgtatggttactatttcatccaccgatgtggggcgttgattgatccgagtccacgtgtgatcaatgtaacacactgaaatgtactgtaataatcccttcgtcccaaataagttaacctagtacgagatctctttacatggcaataggatatattatatctcgtactgggttaatttattttgaaattgagagtagaaagagattacatagctaagcaagtccacatagatcgaaagcgtgcacctcaaccagctagaatgacaggagaaaaatttttagctgaaaatcttccgaagcttttcattaactttcagtttggacttgaagggcatgactacggcatgccatgtatgaccaggtatatgtgctttgtgctcatgctaagataatatgtgccttgtgccttgtgcagttgtgttcatgctaagataatacttcctccatccaaaaatgttatataacctaggattagatggagacggaggtagtacagtacttgcaagcaattaaccagaacgttcttcggcgatgactacagctgacagcttctccgtatgtgacattattcatctcccggacaaccggggcacccaacgagtcaatttcgatgtgaaccgggtcgtgcgtgtagactggagcaaccctgactttagtcaattccacacctctcgctgtactggaatctactccctccattcgaccaaaaatagatacctctgtagggtatcatatgcctgtttagttctctcgtatacgaacacgtatttaaagtattaaacgtagactaataataaaacaaattacagattctgcctgtaaactgcgagacgaatctattaagcctaattaattcgttattagcaaatgtttaattaggctcaaaaattcatctcgcaatttacatacaaactgtgcaattggttttttttcttccacatttaatgctccatgcatgtgtccaaacattttatgttacggaaaagttagaagtttgaaggaaactaaacacagccgtagctatgttgatgggcttgtagtaaatctgattaccaacagcataaacagtcctgtaataacgaatcacaaagtgtacaactagtctgtaatataaatcgtttgagagtgacgatatgcacaaatcaactaacactagagagcctagcgcatctgtctatagcagaaatgtactcattgggttagcaaagtaacgcttgttacacttggatggttctttacagcgatcttgcttcaaaatactctgcaaaagggtaggtgccgaaggggcacgttcatcaaacacccgagcataaaggtgtttatcaaacatcagcttttccaacaaggtccggcaggtctgcagaaaggagaaaacaaaccatgagtggaataatgtaaaatatttattttttttaagaagggtatttttcccagcctctacatccaaccggatatatacagcctttttgaattcgctcaaataacccaatctgagaatttcggccctcaaataacccaatctgaaatttgctactatggatatttgaactcaagactgtctttttaaattaggtacttaacctatcaaataggaaacttagccatcaaataacccaatctgaaattcgctcatatggaaaattgaactcaggaccttgaggtgctactcaggtcactgcaaccactaggctacatgccttttcacaaatatttattatttaaaccactatcattttaatatcgaatatacaggtacaaaaggagaaagtagaggggtgacgcacctgcgggttcaacacatccatccgatggatgatatcctcctggcataattagagcagaacaatagatcagaacttttaaaatattgttgctgataatggtaactccgtaactggaatcaccactaagtaggggaatcaaacgatcttagatctgtacattcaaaataactgcctgatcaatttaagacaaaccaactttaccacgcaaccggagggattcaaataacttgaacagtaagagatgagaaagtaagtaaaaagaagaatataaatgatatagaggaagcaaacacgggagtcacattcagaaagaaaacaggacatgctaaaccataacatacacaaacggaaatttccacaacacttaaatttagacaatagttgaattttccattgttcacttgtaccgtatcgatgaatcttttaatattgtagtgctagctataactaagatttaagtattccattcagatatttagaaataaaactaaaattacaattgtcaaactaccaaaataacacgaatttgaaaagaaaaggaatattttaaaatatggaatttcatgtctcaaccttgattttgaattcttgaatttccaaaccaaaaataagggatccggggaatttaaaattcagatttatgcttgaaaagttaagacttccaaagtttcaaatactgaagttctcgcataaaattttctttttaaaatgagacatttaaagaaaacaaggattaattagtaaagaatgccatataacattaatgcaaaacttttggagatatagatggataaacaaatcacaatttcagtggcatacatgaaactttcctaattcaaaacaaagagctacaaaaaataaaacaaacacgcacctccactactcctggatattgcatggtatatccaataatacgacgacttagaccttcgtagacagtgttattcatgcttccatcaccatttatccatggcaatattgggtgatatatatgcctttcgcaagcatgacaacaatcactgcccctgttgtcttgtgctggagtaaacgaccttttctgacctacaggactttgatagcgtatctgaggagagcttgacttgctttggacattaagaaccgtcacagtgtgcccgtcaccaagcatttttacactcccttgcacatcactagacattgcatgcttctctctcagtagattttctgtatctccagtctcggccatctcaaaagcagaagctcgcaaacaactgcaatgacttgaatctgcaagtgtagttatatgatattttgacttatgtatagagtcaacaatctgcacaccatcatatgcattgacctgtgaagcaagaaaatagagtgacacctatatatgagtagggaaataaaaaaatgtggacaagaaagcagcagtaagtgtagcatcttatatgcaagtattccactcttaatcagtttgacataaatatttaactatcccaatgatgttttaaatgtttatataaaattctacaagtgcagaaaaatatgtcagtaataacaagatctgtttgttaacaacaaaaaaccactggtaaattttgacaagcaaaagaatgaacagtgcaagtattcataattaggcagatatgaaaaacaaaagtgaattaagataattatatcgataaaccagtaaccaaatagaacaaataagtaggctactaatctaccatatgcatgcttgctcacagatttaccttaatgaccagctgaaatctcttgagagtatgaacaatcagatcgacaaactggatgcctgcaggggataagaatataaaaatgaactatacttacaaaataattgatgcatagtctaacaattctaagtttaacataagttacacaaatctaaagaatacctagaggatccagtgcctgtgacatctctctcaaattaactccttgttcgccagctttatgaacaacacaaaatgcatttctgaacaggtcagaagacaatatgtctggttcatttttgttacaacataatgatggtgactgttcagcatatgtttttatagcatcccaaggccacccactgtaagagttctccaaatgagattctgacagtaaacgccgacatgaactggagttgtttagatacaatgatgacatattgtggctttctacctgtgaatcaacatccttgctccccatttcccaggctgaagtaaaaataaggcattctttatcatgtaactcttgtgtaagattacttgttttaattctctcttgattcaaagccacttgaagaccagggaaacctttctctcggcgatagcaaaagtcgctttctatcttgggcaaaggtttgtgtttcttagtcttactgcttttaagtttaaccatatcagccttgcgtttgtgactactctcatccaattcactgttatcatcaacaaacaaactagagctattaggctcatcagcctcaccaactccttcacttggcaatgagggtgaaatgaacgactctccagacaaaacaagagaaaagagctggacaatttccccacattgtagatctggatacaaacaaactccatcatccatggtattcttttgctgccctacccattgagaaaattcagaagcttttttccctgaaccaaatgggaagggtgaattcgaagcattaaaaaagaatttcccagaaagagtgtatggctttgttccatctccagttacctgtaaaataggaggaaagtagatgaacagttgaaaaatgctgccttaaattgcaagcacactttaaaaaaaaaacataaagcttaactatactgactaagtaccaaaaattgagcatataatatcattccctttgtcttagagaggtacaatatcattcctaatagggttcaatgtatatatgccactaaggccaaatgattcttcctaatatcagcacaaacagaatgacagtagagatgccaaataaccacttcaacctttgcagcatttaaatgtaagagattatcaccatagctccactgcaaactcagatgcttgtactacaggacaagtaaaagctgaaaaatttatactccctccgtttcacaatgtaagactttctagcattgtacacatacatatagatgttaatgaatctaaacacatgcatatgtctagattcattaacatctaaatgaatgtgggcaatgctagaaagtcttacattgtgaaacggaggaagtattacacaacaagcatagattatagatatgtgtagttgcgagctccgagaactgcacaaagaaatccgcgatgcaggaatgcagcctcatcgcatttatacttcttgggttcacagccaaagaaatggagcagtgcacataggatcttaaaattcacagaatgttgttaatacatctattattctattgtgttttccaacaaatacagattcaaaagcctgaactggggagagcatactgaagaaataatcaaaagaaatttgatacattgatgggaagatgaattagcaaacactaaccatgaaatttttctctctgagaaaggaaaaggcagtaaaaatttcagtctctgaataaagctggagggttgctgctaacgaagcttgcacttctggtcctgatgaggtgctgagaaaagccagcttcagaagctctaatgcatttgcaactgccaatgatctgcatacatctcttttagcaatatcatctttattatggttaatggccttttcatgagatctgaagggaatgtccatgtttttacttgcatggattgcatttgacagcctataggattttgcatgttcacggagtccactttcttgaattgcagtgcttgcacaggttgcacgtgcacctaaaacctgattattacaaggtaaaacatcagcgttaaataaaatatgtgtttattgagattaaatgtatcagtacgtactggctgtttctgcccatttggaacttccttggtggcatcattatcatcattgttcctttcattcttagacccaactctcttggtctgctccattttttctactcgaatgaattcaaggacttcatcaagtgcactctttatctctggatcctcgaaattatcccaaaagaattgctcagaatctggatccacacagttgtcatgactagaatttgagatttcggaaggtaatcctctcaatttccatctcttttccttttcaaggtacctagcgtatcgtatccctaaaaggtcacagactcggctcacagctggtcttatgtttgtttttttcctcaagtatgctatccttctacggcatgcagctggtggagctggaagatcagaaagagagttccaatctacgcgatgagatactgctccaagtgttgcacgggatctagtgtatatcatcagcaattttctgtagataaaaataaccaatcaggttcccagcatcatggaaaacattgtctccagtaaagtgcattgaaacaaaataattgatgtacaaccaagaaatacctgtcagaatcgtatgtccacacaaatcgtttctctctcatgcagcttcctcttaagatggtagatcgactgatccttggactgcttatcgtatcttcatccacctgtgggagagaatcagtatggaatgtggatggagagattctctcagatacctcctcatgtgggatagactgtgctggtctcggttcagtggattcaatggtttcaacattccgtttgataaatttcagggtaatctcatcagcagaccttttcctttttttagaggttgatcctgaattaacttttcgccgttttcttgcagcagggacggtgggctgtccatgaagctgtctattctgagaggacgatacacagagcacctacataaatcagtccatccagtcagtgttactggatagaaaccatgtacataacagaaacataaagggccccgaacataaaaacagagttgaaacgatagcaagagtaaacaaaatcagccataacaatgttgcaactaagatgatgaaaataaggctaacattgcaactagatatgagatactattattatgtttcttggctatattgtatttatcactttgtttcctgctatatagtgtttaagcattatttcccttaagagctgccagtggagcttgtgcattcttccaaactttgtaaatattcctcacaatataatccaaatagcgtatgagactctgttactgctccccagtccaaaaagaaaaacgagtccagttattactattttaactggtccccataggcccagatgctatcgcataaaattattgtcgatcaattcaactcagaatagtatgagtacacctcatctatttgagatttcacgaatttgctaccagttagtcgattacatgtcacctttcccacacatgttctcggtcacatgtccactttacaacatgagttggaattcacaatacagcctatttgccaccttgattcaccacattcaagaaaaagaaagtaggcattaggacaacctcacgaacacactttgcatggtatttgctgatacattaaacattcccatcttgtcttgaaattccgttgatctgtttctggttttgtgtttaccctttacccttattttaattttaatactttgcatgggatataattaatctgttatagggttatctttccacaatatagaactgaaccagaaaaagaataggggtgcattagttggtatataagttgaagaaatatcaaatacagaagtaaggtcaaatactaattcctataatgagtgtttttatttcagtcccctccattattttaaaaaaaaaggtcaaataataaaacagagtagctcttcgtatctctaaggagcttggagggaaatatcgagatcagacacatacctgctgtacagagagattcaactccctggcaattatacgacaatctctaaaaggaagttttccattctcactggcattcataatgcgctgttgtaactccagtctttgttcagtagtcattactctaagtgaactccatgaacgaggatgagaaacctacaaaatatagggtatcatatagttaatctgtacaacagtacaagagaaaatcacaactgagatcgaatggtctaacattagcaaaatagccaatgccagtcaatattatttacactgggtgtaatgggcttcaataataactaaatggatattgaaacacatttacaactagtagcatgattgcagttgacaatatacagttaaaaacaaaatagaaacaagaaaacggtcacatatcaacatcaggattcaacaacggtgagctctttgcacatggtgttgcagtgttcaatcatgaatagtaatttaacagtaatggtagatcagatgccctgaaaatacaaataatatggatacaggccagcattggccattcaaaatagaacttcaccttttaaaataataggcagagtcattttttactacaaccagaaaagagagaagatatatccataaagtgcagagttatgtaaataaaggaactaaggttagcataaaacatacaggagagagagagagagagagagagaactaagaaagtatacataaacacattttattggagaggtgaataatgggataaaaaacgaaaatgaccattaaaaatagaacagataaatcaacagtaataagtcattattattaggtaacaatgcaataatgaatgttgacaatgacaaacctctggtacagaacagccaggaaaggcacttgatggctcagccaagccagctgttaaataacagtactctaacgtttcccagtaagcatcaacaaactcctgccttgaaagaacaaaatcatgccgaatttttggccgatggttcacattaacatgggatgatggaagaattcttggtgtaggctcttcaatgtaaggcctcagctctattgaatgtgtaggcaaagcatctgatggcgcaccagaatcatctacaagttcctttgcaagttggacaagctagcaaacaaaacgaaagaactaatcatttcaattcttctcaagctgaattacaataaacattaaccggaattcataagacagatatgcagcaggccaatatagacctaaaaaatgttaaagagcatgcctaaggttcaagactctcacaacgttaattccaacatcacagacaaaacattaccttgagcttatctagaatatttaccaagcgtgagagtcggcctttggcatgagtatccatgagttggttgtattcctcggtaggaatttctgaaagcgtttttccaagcctacacttagtaatcatgtgatcaatcttctttgctgatcccacaacttgcagaaagagttcaagaggcattttttttgtagctcccaccatagaaaacaacacagacgattgactaaggttcttgtcatgatgcccttctttgtcattatcaaatgggtcacaccaatttggcaaaccactaacatatacccacagaaatttatggaacagcttagctcgaatcatctttgcaccaatgaatccattggcatgcatagcttctaatattaatggtttgttatctttaactctgcgcggaatcctcaatccaagtatagcagtcgtgtgttgattttgcttcaatttagctgctgcacctgaacgagtttctgtatcaaagttcctttgtctattcctaatttgatccacaagttccggtgacaagtctccaacagaagaatgcagtattacatcaatgagacgactgcgggtgtagtctgtaaccagagggacactaactttgatgcatttacagctgccctcttcctgaagcttatttaaagtgcgagtcaatgtcttcctatccattatttttccattttctttttcaagtccctctaaccatttatgtaactccacctttagtacaaatttctttttctgcaaagggaaaaaggaaaggtgttatataacaatatgcagtcctacatgcaaggatgcacttacaccatgcatgcacatgataatgaaataaggtattttggcacattattcatattaaaaacttttgagtgttgtatactcaattagtaacctttagcatgtgaagaatcctcctatgccgtcgatcatcagaagtcaatggagggcagcgacgcctcttcctctgacccaaagcaagtttctctaaaacagaaataaggggctcactttggttaagctcattgattttaatggtgctcatatatgtcaacattcaaactttgtaattcttttttcaacatttaattacaactatgtaggttcacttgcaatgcagcataaaagttgtatcacagattcagttcaaaagtactttcatatgatcgccttttgtggtgataagaaatcctaaaagaaatttatggtcaaagttcaacttggatatcgtgctaactcaaagaattccttaagaaaaagaaacacagggagcacagatgacaagtacaaataactcgcagaactcaaagttagttcgcaagaagcttggcacatacagttctcaaaaaatgcactgtactaactggatgaaatataaatcactaactcagccgtataaatctctcaaactgtcagaacttgcctttacttttgatctttggaatactcgataaaaaaaaaggtgcagggtatgaaatagattacatacctggttatgagcctatgagcttattaaacagagcatatgactgcacatttacttggacgaaaatgtgaagccatttggatatatgcgactaagggtgttcaaaagtaaggtcaataagtgaagttttaagcagcataaaataccacaagctcctacaacagcatggcactcccccaaagaggtactaagcacaattttttgaaagaataaatagaaactaccaggaacatagatcactgtaccttgttcaacaatttgagaaaccccaacgcaagcttcatggttactctggaggggatgtcctgctggtttattgtggcattcttcttccaacaaaagcttgttattatcaacaaataaatcaacccgtgagattggagattctgatcctttagatggaactaatgaccacaaatcagaacacttctcgtggtcatctgggagtgcctccaaattatgcagagcagcaccagctttgtagtgtgaaaagttttttgaagtccaaactcggtattgtgatgtcttgtcttgaacttcagcttcccaagtcaaattgtattttttaagcatggatgacactcgcttatgaagcctttttgaattgttgtgcccaagacgtttgccaagctacatggaagttacatgaaaacatgagttgctaacttcaagaaatacagaacactaacatgctgcactaataaggtatcatgctttgcaacaagatattgcattaggatgggctattggatgctttataggcccatatggctgggaatgggctgggggtggggtgactgggaaaaggctgggcgttgggacagagtaaaaagcacatgattttctggtttcctcaagaggggcacgcagcgcacaacatgggggaaggggaggacagatgactgtgcttttaagtagtaagagactagatgacactgacaatattagtccatatcacactgacaatagcatgtgcattgccatggaactcaaataagtaaacgacagcttctaacctaagctttaaaaatgcaaaagcaattatatttaaatccagataaacaagttgatcatagtagagagataatgacactttactgcactatataatcatcaatgctagtctcatcatgacaggacattttgcacatgaagctctttttttttcattagggatttcaaccagaagaataatgtatcagaaaagattttatatcataaagaagctccagtaagttagtcaaaaatatagatatgttataggccatgctgctagagacaaaatttatgtatttacgctactagaaatgaaccagttacaacccacaagaagccgtacatatatgccattaagacaactattcatattcctgtataccaaaagaatagtttgtaggtttgtagaatatgtcattgaaaagcacagatgtataatttaactcctgaaaaagttacaagaagtacctcaacaagggttattccttttggcccttgagcgttgatcatatcgtatatacagttctctaatggaagctccatgacttgatcagttgcctggcctttcttgccaagtttgtagtttgaggttgtactttttggctgaaattcatttggatcgaatttcttcaacagacgtaaacagcgaataaactgaacaaaaggaatacctttatcacttgttggctcacaaagtatatgaccaggtgaaagataacagcacaagaggggtacatatggacatggtaaattataaagtcttttctaatttccagttcctgacaggaagcactgacaagcccaaaactattactgaatagagcatacattattaattgaaaatgccaacagaacaggaggaaagattaatgtcaccttatcatcaactttggcatcaaattcttcaataagttgtgcgtctcttagcctatgcagtacctaagcaaacagtgtctcagtaataccctataaggaggaaaaccagaagagcagaaactagagagcatatgcagtaagtgattctgagcaaacttacatttctccatgctctgtgcccatatgtcatcctgtaattgagatctacttttatatccgaaacaacaagagtctatcgatgaaataatagcagagagttagaaaactatagagaaaaaataaaatccaggagaataccaaatggaaaagaaaagaaggaacagttgacctttccactagcttcttctagtttatcgcatatggctttcattgctggaagataatcatgaatagatatatcatttttgtcatttacaccaaaagccccatcttcttgcaaaacatctccattgctctcttcattgctgcccagtagttcaggctttatgatctcaattctctgttgtgaattcatattcaggtttttggcatatcgcgagagatacaatgagttagtattgatgatttgtttattctgggaagcatcttcggcatcagctccatgatctttaacctttataatagttgactgcctaacgattaacttctgcgactgaaggctctttacaataaagtggaagttgtttcctttcatacggaaagttttgcatagatcattttgcgttacaccagaagtcctatgagaaacaaaggaaaataacatcacagtgcaaatattcaaaatcaatcatcttctctgcctatatatacattacggaacaatgtatatatggctaacagaaagataatgctattctatttgaccatgcttcttatgtaatttgcaaatgcatgctaattgctaatgatcagaatatatgcaggttcctgcattaaactcacgaaataataaaggtaagaccaaaatacatctaaggaaatggtgtttataactatgccaaattgtgagtaaccccacccaattttggtttgccaagacaatcatgcatagtagctcagcatttgggaaaaaacctcccagttcatagaaccaccagctcatatgatgatttgctcaacggttacgccagaacgcacctgcttgctccgacccgttcaagcgcccccttctggacggcgctcaactccgatttcgcgaacctgcggtcatacatcccgaggaagttgtccctgagcgcggcgctagcgaccaaccgcaccccccgccgctcggcctcctccacgtccttctccaccgggtcgacgggcgccccgtccccctctcccacaacgaggctgatgatggggagcgcgatgaggcgggcccagaggacgcgcttggcatcgaggccgggagagaggccggccgcctcgagcgcgccgcggagcgccggccagaggtcggtgaccgggaggccgggcgagaggcgggcgcacacctcctccagcgccgccgagacgagcgcgtccatgcccccgcggctcgtgtagggtggtgcgccccggtgtttcgggaggtttagggttttggctacggtcgcatctgcctctgcgctcgaggagggctctgtggtcggaggaagaggaggattactcgccacgcgaagcggagctcgccgcgcttgccggcggtgtggccgcggtggggagtagtggatcgccggctttggtccggtgatgaggcttgccgatgatacagaaagagtacgggttagattgcacggcccaataggcccattaacgttagaaatgctcggctcaataggcccagtaatggccgctccctagtccacaaaacctagtgacgcggcgaaacccaaaaacccttctgcactcgccgccgcctccgcaacgaaaatggcagcgctcgcctccctcctcctactccgccgccgcggcgggagccacgccgccgacgctctccttcgcgcgctcactaccgccgctggagagcagccactcacggcgtcggcggccaagacccgcctccgccgggagcacgaccccgaccgcgtcgtctccctcttcgaggccatcgacgacgcctccctctcggcctcctccacccgccacgcgctctccctcgccgcacgcaggctctcccgctcccgccgcttcgccgacgccgaggccctcctctcctcccacatcccggcctcccccaccgagccgcagctcgccgctgtcctctgctcctacgccgccgcgtccctccccgagaaggctctcgccgccttccgctccgccgcgccgtccctcccgtccccgatctccccgctccccttcaacgccgtcctctccgtgttcctccggtgccgccgccaccgccgcgtcccggtcctcttcgacgagctctccaaggagttctccatcacacctgacgcctcctcctacggcatcctggtcaaggcatactgcatgctgagcaaagacgccaaggcacacgaggtgttagatcaaatgcgtgggcagggtttcacgccgaccaatagtatctacaccacaatgatcgattccatgtataagcagaagaagatggagcaggcagagcgcttgtggaagcagatgttggagagcggacgcaagcctgaccaagctgtatataatacaaagatcatgcaccatagccttcacggcaagacggaagatgtgcttgaggtgatagcagaaatggaggaagctggagtgaagccggataccatcacttacaatttcctcatgactagctactgcaagcatggtaagatggagactgccaaggagctgtacagatcactaggcgagaaggggtgctcagcaaacgctgccacgtacaagcatatgatggcacagctgtgtgcccatggagatttggacggtgcattggtgatcttcaaggaaagctataggagcaacaaggtgccagattttaggacaatgagtggattggttgagggattgacaaaggctggcagggtggctgaggcaaagaatattgttgccaagatgaagaagaagttcccagagcaattgctgtcagggtggatgaaactcgagaaggagcttgggttgaactcagatagcggagatgcaggtactcgggcagaatgtatatctgaagaaactccttctgaggccgaggctgctatgccaaagacacttgagctggaagatccttcttctgatgaaacagaatgtatggcagaggcgtccactagtgaggaaatgccacgggattctgcttaatcagatgttatttatgtatttcaagtttaatttggttaggatgtttttacattgtgcattctctacaaaggaagaatttctaatgctcccaagtacagaggtaaacattagtttctagatgtggactcctgagccactaagagttatattgggctgacaatgcttataatttcgttgttatggatttattgtggtgttcaccttcagtaataattgttacaataatgtgatggctgatctatttggcgtggaagtgaatttcacaatgaaacacatcactgccggaagttcagctatcctggagctttcgtcatgttctgtactaactgttacaaacttacagtaagttgatgcctggattattcggcattgaagtgaatttcacaaggaaacacatcactgcctaaacttcagctatcctggagttctcatttcagttcctgctttggtttttttgagcaatagttcctggttgattccatgcatgcctatgcaagtaaagcattgaaagaaaatatgctgctggtgatgcttgtggtttcggaggttgtgctgctgtcatattgtttatcctatttcccaatacatcccactgaaattgctcataaatcatgttgacgaggttgtaatcttgtatgagtataacccttgtttgcagatttcagacgaaggtttgcagtgcatcagcaacaaggaagacatggcaaaaggccaaaagcaatgaaacaagttgccggtgccacctccatgctgcgggaacactcgttgatccccggtgattgatcgaaacattactgttgcattgcaagtctgaactctgaagtcactgaaatttcactttgtcatttcctggcaaccttcatcccagtatcaactatccacaggctgctgctatttggttgagacttgagactggggttttgtgaaatactacaacaagaaagcatggaggaattaagtgcaactaagatgcgtctcacccgtttgggagtagtatattttggaacggagggagtagtgtttaggatgtatacaaacattatgaaacggcacaccataatgcatacatacatcctatatgaagctcatggtgaccctcggtttgcggggatcatcgtccccaggatccgctagactagctggccgcagtttgcacaaaacgagaagctaagtaggagtaatcccctttcggcgatgcttgggagagctcacagtttcctgcataaatgcagcacgcaagttgaaactaactttacctctattccgtgaaagacataaacagtgttgcaagtcgcaaccccggttcatgaaatgtgcatggtgctgggatcctgttgataacgggattttggactatttgccatcttccccaatgccacactcctaaatgccatcttcccaaaaaacttgaataaattgccattggtccccctacattagttgattttctaccattttggtccattcttgacgccacatcagcagccacctcatgacaccatcaagaaaatgacattaatacccctgccctttcagtccaaatttaacatagtccacggcaaataatacacaaccaacataactaatagatgcacaataatttcacaagcaaacacagcttggaacatacagacaaaacctgcaaacgctagacagaccaatctaaaaaaagaatatcaggaaaaaatttgatgccaaaccaaagagagggaaagatgaaggatctattgttcttttacctgggattgtgtcatcgtttggacactgccggcggaatcgatgaagcaaggagcgatgcgaagtcgaacgaggagtagagacgcaaatcctggggcaggaagcgatgcaaatattggagtttttctcctactcccagtgcaaagggcaaaatagggatttcgccccatccaaagctgacgtggcatcaaaaagaaataaaatggctaggaatcaactaatatatggatccagtggcaatttatctaaactttttgggaagatggcatttgggagtgttgcattggggaagatggcaaatagtcaaaaatcccgttgataacacagtgcaatcagacactctcacatcgcaggtttctcttaatactgaactctactagcagagggccacatcttttaacctacaacatgtatgctaatgctaaaatttaaattttaaaatttaattttggagttaactttgatactttcatcgtagtttttttaacattgacgtcatcaagaccacatgtatgaaaatttcaaccctaaattacatttttatcgctaatatgttgtttggagtattatcagcaatcggtcaaccgatggcagccaaaattttcgctgaatcctgcactctactagagtactggtaactctgcactctactaaacttgccctgtctctctagagccagcaagagagaacaaatttccttctacaaacagggtttctagatagagagaacagacatactagtattacttccatgtaaaacggttgttcctatgacaggtatcggtctttcagatctgccatgaacggttgctttcagcagatcagatgcgtgaaagcaaccaagatccgtgtggaacggaggatgcatgcgcctcagcatgacacgatacttctacactattcatggtttagtgcttgagacgtatcgcttcagctgattcagacgtcccgtttcctgtagtacaaattgtccaccattataatactactaccatagtccacagcatatgctgtcatggggatatgcggtcatggattcctaacttgagtttaacatgaaaggtccatttaaaatagcataatgacaacttctcgataaactagagttagaccaccgttttgttgccgtcattcttatctgagattaagcagatgttgtcagcacgccaataacataattgagacagtgggtttcttttgtagcaacctctgtaaaaaggctccatatttcatttgttgatgtgagtcatgtttgtccactatcccgtgatgctggtacaaattctgtgcacatgttaaacctgaaatttatgcttccaagtttcaacgtcgcagaggctgaagaaccaagtttgtcctaaaggaaattcagttctctcagaaacaagggaatttcaacgtcgcagccccgttcgtttctactaaaaacagtggatgaaattttaaatattcgtggcacgctttttaaactactaaacggtgcgtttcatgcgaaaacttattatataaaagttcctctaaaatatcagattaatatattttccaagtttgtaataatgaaaattcaattaatcacacgttattatcatctcattttacgaggaacacttgatttttatctttatctttatcttcaaaagattcaaatactaaatctagctaaacaaagcgaatccttagcaaaagaatcttcttttaagccagcgtggccggcaatttatcatgcattagccatccactcatccatagtactactgatacagcagtattctgtcactcttcgtgagagatcacgatcatggacagcgtagcgttagcaccccgtgcctaactaggatccaaccgctgctgcttgatcgcattcacatgccaagctagccgctactaaacgatccaataaaacggagaattcaagagcgaaacacctcactcgtgatggacacgggctactcatatataaataatttgtaatatgttctaattcagctaaataaattaaattttatttttctttcgccgactaccaatgtatcatgcctctgtcaatactccaataccggagattattgttgtgttcgttcgtactgaagatgaaaatgaaggaaaaaaactattaccatataattaattgagttttaattattataagtttgtaaaaagatttacctaatatttttaagctttatctatatacaaagttcttgtacgaaatacatcgtttagcagtttaaaatgtgctaatggaaacaacataaaagatatactccctacatttcaggttacaagatgttttgactttggtcaaagtcaaactactttaagtttaactaaatttatagacaaatatagtaatatttacgttaccaaattagatttattaaattaataattaaatatatttttataataaatttatcttgggtcgaaaatattactatttttttctataaacttagctaaacttaaagcagtttaactttgatgaaagttaaaatatcttataacctgaattataatatctcaagcagcgatcaatgattcgatggcaattgcgtggcaaagaaactgagaaatcacacaaagttgtggtcactcacgcttggtgctagtgctagctgcggaatggggcagcagaaatgcgacgagctagctggatagcggcgcctgccaagagctagcgcgtggtggtccatgccaagtgatcgatacagcgagccacgcgcgccgaaactcggaaaaaggcggagagatatcacgagcttcgtttcgcgcggcaatccaccatgccacctcgcctcgcacaagcgatctcgctaagagaagtacaataacacaacgtactgtaaactagctataaacagataaaagaagagagagaaaagcagcgggctacatatctgtagccagctgcagcacgatctctaagacgtaatgtgtgtatgataaataggactagatattaatagtataggaatcaattattatatgaattagctagtattatattagcaatagatgatttatagctactagttggctatttgctctaataatcctcggcgagaaaatgacgtggtttttatataattgtttcgagcccaatcacacaacgatggagacctgggagcaataagagggagaaagactgccacttgatagacggaaacaaaaatccatgtaatgcaatttgctagtaccatcgcctcatcagagcaacttatccgtaacgagggatcatcatttttttaaaaaggacaagttgctaagcacgaccgatcgattctgattgggttaagattccgtttctgtccatatcagtgaatcatctaaaaacaactttgaaatactcttttgaaaatgtaatcccaataaattcatccagtacaactcctgccgttacggtttggtcaacagttcaaaaccgcacaccggatcctgctcctgcgccgttcgatctcatctcgacggataccagcagctttggcggtggggaccccacggctcagtagcagcacaccgcgtccgactgatcccgagccgtccgatcccatctcgacggctaccaaagaaggtgacggaggtgggccccacgggtcagtgtcacagcacccggtttctctgacacccgcacggaagtggggcccagccaaagcccccacaataaatttcgcacagcgcacaggcctctcccatcacccagcaaatttttttctcgcccaccatttcgaacgaaaaaaaatcaatcaccaaccgggaggccgaagcagccaacccaatggcgcagcacaccgccgcggcggcgggcggggacgaggaggtggcggaggctgaggcggcggcggcggcggcggcggggagcacgctccggcaccgccacgcgggcaagggcgcggaagagcacgaggcggcgggcggaggcggcggcgggcgcaatggcggcgccgacgacccggacgcgacgtcggtggagcgggtgttcgcggacaaggcggtgccgtcgtggagggagcagctgacgctgcgggcgttcgtggtgagcgcgctgctcgccgtcatgttcagcgtgatcgtcatgaagctgaacctcaccacggggatcatcccgtcgctcaacgtctccgcgggcttgcttggcttcttcttcgtccgcctctggacctccgccgtcgagcggattggcctcctcaagcagccgttcacgcgccaggagaacaccgtcatccagacctgcgtcgtctccgcctacggcatcgccttcagcggtaaacgtcttcgacgctttcggctttactctgacttctactgcaccacctttgttggattgggactcctcgttgcagcgagtgtactgtgtgtgcttatgtctacctccgaattgaatggagcgagtattagaggaatccatttggttagtgcgtcagcgtgttacaacgttactcttactggtggttgcgattttgggttgtggttatgtgggagtatgatgcagcagatctgatctgaatgtgggagagtcgctggggaagtgtagcatttcgcggtagtgggtagctgggagacatcacggaatcggttgttcttgtgcccctgaagaaaaaaacaacaactactacaacatcggtctcaaaagcggtttctgataagagaactgtactggaaaacttgaagaattgtcattcttggattcggacttgtcaacttgatgctgctttgtcgcagttgagtggactctgctgtttctaccttttctgatttcacgaaacagctgcttgacttcagtgcacctgatttgaattgtgtagcaacgggacgaatctttagaagattttggttttggaagttggtttattaggtgagctaagttgtggatatagatagtcaacactatatttttccctgtgctggtaagaaaatcgctgcattgctctcatttgatgggaaaagccatttgcgtttaggatgcgacgtttgcaggagtaaggacaagctgaagtggaccagcttgcttggtttgactcctcaccttaaaataaatgcatggcgcatgcttcttctttttttctttgcttaggcagacatgacacatgcatgtgaaagcatttggatcggcataaacaattataatggtctgcaggattatttgagaaccatgctacgtggtacactgatgatcattcgaataatttcatgtggcaaggcatgatgtttacttgcagatgcctagtatatgaggaatttcgtaaggatgtcccatgtgcatcagatggatataagttattcttaacaccagaattaagtttgtttactgttttctattccaaaacagcaaagaaaatcaagtaagtgtttccaagaaagtggtgaaccaatgattaactagttatctactatgtttttaagtggtaataatatgtcaatgcaccatgcatgagatagttgcttgattccttgcctcatttgcccaaagcatctcatattttcttttgatgtctgtttacctttatgaaactgtatcccttgctagaatgtcataatgtatgaacaaaaatttgtgccaattgacatatttttgtacctgtttattccaaattccaatgatcaggtgggtttggcagttatttatttggaatgagtgaaacaatagccaagcaagcaacagaggctaaagatgctcaaaatatcaaggatcctcaccttggatggatgattggttttcttttccttgtcagttttattgggctatttgcacttgtgcccctaagaaaagtatgccttaaacctgttaccttctagttttactgaattgctgtatatagggaaaacttatccatcctaacttaattgttgtttcagattatgattgttgattacaagctcacctatccaagtggcacagcaactgcttatctcatcaatggttttcacacaccagagggtgccaaactagcaaagtatatctataaaatgctactttcatgagtgccaattattagcccagtatatccgtaaatgttatgcaattcaactgacaaataaccatctttttcaggaaacaagtaaagacattgggcaagtactttctgtttagcttcttctggggttttttccagtggttctacactgctggtgatgactgtggattcaagaacttcccaacattgggccttgaagcttacaacaacaggtcagaactcagaagtatagcataacattggttttaacaacagtgttgactatgatgtccgttgcctcagcttaacctatagctaatatctggtgaaacactacctctgtcgtctttggctgtggtaaaaactgtagttactaatgtctagtgtctgaccatctggataatagttaattcttagttccaagccattggtctcccatatttgacttgacctgttacctttcaggtttttctttgatttctctcctacatatgttggagttggcatgatctgcccatatatcgtgaatgtgtcggttcttcttggcggtatcctctcatggggtgtgatgtggcctctcattgccaagaagaaaggaagttggtaccctgctgatatctcagacaacagtctccatgggctgcaggcttacagggttagcatccacctttccgctgattcccctttatgaagctaaatcatacaatacagaattcaaaaggctagagagcgctttgagtaatgttttaactgtaagttcattacctttgcaggttttcatatccattgctttgatccttggggatggtttatacaacttcctcaaggtgcttatccgcacaattgcaggctttatatcaatggttcagaacaattcaaaaggcatgcttcctgtttcagacaatggcatgtccatgtccactgctgaagaggtatccttcgatgatgagcgtcgcactgaaatcttcctgaaagatcaaattcctaagtcagttgcatatggaggctacgtcgtagttgctgctctatcgattggcacccttcctgagatcttcccgcagctcaagtggtactacattttggttgcctacatcgttgcacctgtgctggccttctgcaatgcctacggaagtggtctcactgattggtctcttgcctccacctatggcaagcttgctatcttcgtgttcggagcgtgggcgggcctttctcacggtggtgtgctcgtaggacttgccgcttgcggtgtcatgatgagcatcgtgtcgactgcctctgacctgatgcaagacttcaagactggatacttgactctggcatcaccgaggtccatgtttatcagccaggtgatcggcaccgggatgggctgtgtcatagctccctgtgtcttctggctcttctacaaggccttcagcaatattggcacaagcggcaccgagtacccggcgccatatgccatcgtgtaccgcaacatggccatcctgggtgtcgatggcttcaactcgcttccggagaactgcctcactctctgctacatcttcttcgccgcggcgatcgccatcaacctgatcagagacctggcgccgcacaaggtctccaggttcatcccgctccccatggcaatggcgatccctttctacattggatcgtacttcgcgatcgatatgttcctgggcagcgtgatcctctttgtgtgggagaagctgaacaaggccaaggcggatgcgtttggacctgcggtggcgtcagggttgatctgcggtgatgggatctggactcttccccagtccattcttgcccttgccaaggtgaagccccccatttgcatgaaatttttgtcgagggcagccaatgccaaagtggatagcttccttgccggttagtcgtgccatcgtgatcaattgatctttgaagagaacatttgcaaggagtgcgcgccatcctgtaattatctcctccaaatgtatttccagatcacttgttttgtagaaaagccaaatctgggtttcccgtaggaaagaagcatcccacaatccaaatgtaaaaacgaggaaaaatacagctgcaaccaacaaccgttttatcatttgctcgacacggattcctgtagagattatcctttttaacgaaaatggcatgttgaactgagaatccgtgaggtctagcaggtcaggtttcaaaactgagctgacttggaaactgccttttgagcttatgagtgcatctgacaggtttgccaatcaaaactacaagcgagctcattttacttgatcttctcttgagctaatttaccatcctatcctattgttggtttattaccagcataagtgcaacgagcattgaaaattttgaaaatacaaggcatggccaattgtagatcaagaccgacaaacagcgggatgagtaactttgcctgtactgtcataagaaaataagatgcttcaattgcaaacacgttcatagttgtttgaaacacaaaagaagctcctaaagatctaacatgctatcaagctactcgcctgactgccaagggagtagttatttagataaacaacttaattgaacagttaagctgattgcctggtgatctcctgtagaaaaatcacgcgaggcactctgcagtaactactctcgcggagtgcacacatttcttggctccatgcgaccttgaagctgtgaagcatacgtataatattgaatacgatcaaccattcattgtggacttgtaatggtggtcatcgatagtggcatacaaatgtcccagatcaacttggtctataatgattttcctgtgaaagaaagtaggattatgtaaataagcaaaatatatttcagacagtgtgatggggagggatatacccgactgtttcctctggtagattaagacgacggctcacataatctacgcctactccatggtcatcattcctgtatagcacaaattcagtattatctaaagcagagaaactacagaccatgttaaaacattgacagtaccaaacttgtatttggtattagcatggcgttatttttagaaggaaagaggtggccctctcccagattacgtaaaagttactgcatagatattgtagattatgtgtgccgtaaaattatgaagaaaatttaaggtattgcagaccttaaaattaagccctttgatgtgtgtgacatggagggtggagaaccatcggtacaaaactttgaaacatgtaaaagttactggcaaacatctatatgaaagactgaccactgaatcatgggaacttctatattgcagagaacgtaattttaaggtctggtggtatgaaggaaccaaatgtcaattcattattcatgtctacaacttatttatctgaccttttttttatcataagaagtaatgaaagcgtactgcatatctaattaacaattccacactagacagaaacggctgagtgttaaggacaaaaacatggaatattgttagctattctatagcaaagaaaaaaagtcagcagagtttatgcgtgtgaattataatagatcaaagagagaaaactggctagtcaagtgacatctatgggcagaattatcaacaattaacttacataactgctgggtcatgaaaaacattcaagaccaagtcgatcatatttgttccagtaccagtattttgtggtgcagaaaatgttgaggcctgagtagatatgaatgaaaaatttcagacagaaaagttggcatgtctttcttggtaaaataagaagaaatgtccaaaactacctgattagtaagtggactttggttatacgccatgctatccctaggcatagtttggttaggagttcctgttgctgtattagcatttacttgggactgtcaagtattaaaataactcagaaacatgacatcaccgtaaagctcaatagatattgtatggcacaagttaaacaccaacaaatgaaacctttaggatctcactaccttcggcctggtaagctccaagtgcacatgaacgcagtgaagaaagtgatgtgttacatcattgaagttggttatacgcctgacaagaaaccatgaacaaaagcataaattaagaaaaaatgcagaaaagtatttatctggtctggataagcctgtctctaaagcaatatagtattgagctatcctgattcatgagtttatctttgctattgcttttacacacgtcatatgacagacttccaatctaatatagtggtgtgcttgtaggaacaacaaagaatgttacacattaattaacaccaattaaatagccgttagtgattagttgtagttctgttcagcactcacaaacttctgcatgaatactaccccgtttctaaatacagggcacttttgaccactgttttgtacctataatacttggaacttaacaaatcccaatgcaatttgtactaaattcctctattagatatattcacctcaacccatctccatactccattcccgtgccttaattgttaataaggtgcatttttgccactttttgcacaaaatatgattgctttagcaagcatgttttaatcaaaagcgtcaagtacttagaaacagaaggagtattctacttacaaatcattgtagctaagggatcacatcagcattagctgttttattacggtactccctccatcccaaaatataagcatttccggttttgtcctaagtcaaactatcctaagtgtatataaaagtatttacagtatcaaatgagcatcattagattcatcatgaaatatattttcatagtttacttgtttgacgtggtaaatattaatactcttctgatcttcttgttcatctctagtttgacttaggacaaactagagatgcttatattttgggacggacggagtaccacagggtgacattattcaatataatgggccaaacaaattgcagacaattcgctatgctccaaagcaggcatcagtttttggaaatccacgttgcaggttattatctatggaagaccaaagtattcacctcacagagtaagcaaccacctgacgcttcccttgaaaaccttttagaccaccattgacaataacatagtcaccattccttgcaaatagaacaaagcaaacctatcaattttggggcgtagcaatttaaatttcaagacaagtcaaatactatgtaacccttactgaatgtcagccatctccttagtatcagtgctatcgttttccctgagaaaaaaatagaagtcagtacaaagccaagaaattatccaaagtttgttaagcacaataaagcggtacatggcatcccaccagcgattcacaggtaccctgcctgtaccatcatcaagagtgaatgatacatccgtaacccgatcaagcttatttaacatgcgtcctacaagcctaacctgcaatccagggtgataaaaattcaatacacaacatacgatatttgccaacatgtacagaaagcaaactgaccgaagcaaaaccaattcaaaccaagagaatttagattctaaaaaaggcaaaatacaattacataattacgctaaacaaaatcataaagaagatagcatcgtattttgaaaggaccatatacatatttaatattttcaaggagctagtttcagctccaaggagttttttttttttttgcccaactatattttctctaccactccgataggcaacctttggcccaaccagcgcaagtacaatgcatacaagaactgtttgtaatttcccaaaaaaaaatggagtctaatcaccacccaatcaatgttcatttccgaacaccaatcaccacacagaagtaggcaagatcgataccgtggacacctccatgccattgacagcaaaattcgacttgtcgtcgttggtctgggacgcgtccatgatctgcttcacggtgagcgggagcagcgcctgggcgttccgactctgaccacacccgcgagccccacaaggcgtcagtccgaggggagcgcaagagatatccaaaaaaaacaaacaaacgagaaatttgggtaggattaggaggggaaggaccttggggaagccgccgccgccgccgctggtcccctccgcggcgttggtcgcctgcgagggcatgaatccgccgccgccgaagagggagctggcgttccctcccccgccatcgtagttcccgccgccgccgccgccgacgccgacgccgtacatcggggattcgggagggccccgcgcctaaaccctagctgcccgccaaagcaaccggaacagacgacagacgaacggatgagcgcgggagaggagtgcggctgcggcggttcagtttttcggcggaaaaaaccctcgccaacttcgcgttggtatttgttccccgtgttgcgtggccaaaggcagggggggtgcagtgcaccgtgcgcgcgacgcgagccaggttaaacgttgacgtgggtgagcggccgtgcagtggtgcgtgcgtcgtgtggtttccactggggtttgacggatcgggcgggccgtgcgctgagcggggcgctgcggctgcagcctgcacggctgcgcgtaccggtggatcggattgtagcgcgatagccggtagccgggctaaggcggctagtggtggcgactagcgaacgcgagcggctcgtgcacggcacgagtgggttgggagtttgggacttgggacttgggggagttgggtggatgaaccggccccgggtgggatcggtcgcagcgcgagtccgcgactggggaaggtgccgcacgggccgatttgcaggttgggctacgcgatagcagccgaagtcttctcgcttggtttggggcacttgggaatcgttggcatccgcgtagcagccgaagtactcttttcgatatgtatgtgtagctaattgctccactagacatttgaaagcaagcaatcagtgggccgttacacctgatcacgttcttactatggcacccctcgtttcggctcaagaagcagcatgtggaaaataagaggattcagattcggtgacattgctatagcatggcacggtgtgatattggatcgatctggggcgttgaaaactaatccaacggtccgctgcactggcctacctgcaggactccgttttcaccccacgcgcctacccttcctgccagacgacgtctccttcaatctcgccccaatctcgcgtgctcgcatcgccgtttccccacgccaggccgaagaggcgccaggccaccgcgccgcagcgagtggggaggggaccgggcggctgcctcgtcgcttcgcctccccttgcccgcgtcaggccaccgccgcgagctagctgggagccgccgccgcgccaggccggagaggcgcccaccaccgcgccgctgcgactggggaggggaccgggcggccgcttcgcctcccctcgcccgcgttaggccgctgcgccaggccggagaggcgccaggccgccgcgccgccgcgagtgtggaggggaccgggcggcggctgcgcgaggaccctgatgtatctgaact

SEQ ID NO: 60515 - DNA, 2506 bp, Oryza sativa
aggtagtagagcccaaaaagcaccacacctaactcacaaaaagacgcctccttttcgcgggaatcgaatcgacaaaggctcaagaacgagaggccagcacggcacagaagccacaagaagcgatcagaacagctgaaatcgaatcacgaaccaggacacctgctctcctctccggctcctcaaaactaaatcaactacctactactcctcccaatcctctctctgttcttcttcaaggagatacgagatagagagatagaaatagatacagataggagatgagagggaggggagcaagagatttgtactatggaagaagttgggatgaatggatcaaaggattggtgggagaggagattaaaggggatatgtatctgtgactctcgtgcttgcctgccttagctgagggactcaactctgttgaccttttgagcatgagagcgacgcacagcatgcaaccatcagctgctgcctttcgatttctttctccttcttctagaattctactcgaaagaaagaggaaggaggagaggaagatgaagaggaggaggaagccattaatggtggttggggaagaaggaaaaagcctttgcaggcttgtagccgccatcctcaacctcaacctcttgtggcgtccctacccacgctctatgacatgtggggcccactgcgaagatgccgatggatctgagcgtcggatgggcatccaacggatggattcgtgttcttttttttttctgttttgcttggctgcagggagactggagggacaggtcatgtatctaggcaacatatcctatgcacacaggccctcacgtgtacacacgtacacactaactaaaaaatgtcaccaaaaaatctagaaaaaatcatacacatactttcaattgtattacacctagagttaaaatattaacgtcaaatttattatattttagccgtaacaaaaaaacaaaaaatctgacagttttaaggttgtaattttatcagaattttatattttttgttattctctatgtagaatgaatttgaagatgcgactttgcacgtagatatatactattgaaagtacatgtatgaattttcctaaaattttttttgataatttttagttggtgtacacggtgtgtacacacgagggcctgtgtgcataggatacgctccacgagggcctgtgtgtataggatacgctcccatgtatctaacctgagttgagtcagcattgatatgatcatgtgtacacacatgaaaggtttgtttcaacatatttttgtattctaataaatgtgattcaattctatcggggtagcaacaagtaaatcggaacaaaacttggcatttcggcacatctaccatatcacgcggaaagggacgatggatgagctacctgtatatcgactagaaaactaacaagtgtccatagaagtcacgtgcaccattctatttttaaaacgtgattatttttcttattgaaaattagtttattataagcatatgtggtatatcaaaaatgtaaagaaatttttttatgacaacatttttgtattctaataaatgttattcaattctatgaggctagcaacaaataaatcggaataaaacttagcatttcggcacatctaccatatcacatggaaagggacgattgatgggctacttttattcgactaaatcaacaaactgtacatagacgtcacatatatagtcatataccattcaattcttaaatttgattttccttattgaaatttagttaattataagcaagcagtatatcaaaattgtaaaaaaaaaagtttatgaaaacattttcgtgttctaataaatgtggttctttgtaacgtggtaacaaacaaatcgaaataaatagcattttgtcatgtgtcctttgagaggtgtgattcatgcaccaacaaatacaggtgtttatacgttgtacgagttttaaaagtatatatatttcctatatgcatgtatatataaggcacatgtcactcatgtatatagtatggagtaggtgctaagtgcaagttcacacctatgggagggatgatgtaacgaatatatgggatagaatttattcttgcattataagtatctgtcgcacataattttaagtttcttcttgtaaagtactccctccattgattttaaggggcacattttgatttcaatagaccaaagtatgttgattttgattaaatattagtaaaattataagtatatttagtatataaaatttgcaattgattcatatttaaaagtggttttacgtatatatttaggttttacagcttactaatgatatagtatactacaacaaaatagttacaaattttaatctccacacaacttttaaattaaaatatgccttataaaaatcaacacaatagcagccactactactctttacaaacgttgtactatctttgtgtgggttgttttaaaaaaaactgctagaaaaacgtaataatgaaaaaacctctcaaaatcagttctaaaatca

SEQ ID NO: 60516 - DNA, 17042 bp, Oryza sativa
cgacccctccttcgttctcgacacatccaccggctggcgacccctccttcgttctcgacacatccaccgcccccgacaacccctcctcccaaatcgcctacggcctcacggtacgcaacaccatggcggagtcggagaaggcgatgggttccccggccgcgacggagccggtgaagacgccggcccctcctgcaactgatggccccagcggtgaccttatgcagcggcagtataaggaggacgccgacgccacccatggcacacttgtcggcgacgacacggacgagtcgcgccgcctcttcctcgcggacgtggtggagcgactagacgcggtgtgcgctgaagagctcgagcacgcagatccttcggagcagagattaggaaggctggactctgctcgcggttgccaatggcgtcaccgcctgccgacgtcaccaccccagcgatgagcagctcagtgaacgacggggcctgagcggaggaggacccgagcactagttgaccctgactgacaatattgtcatgggtagattaaagaggcccagttgcacttgcacgcgatgattagtctcagttcttcaagtatgggttaatttgttcttgttatctggctctggtatgctattatcctgcaaatggaatgtttgacacaggtagctgggagctagaaatgcatgcagtcacaaggtcagattgatcgatgcagagaacatgggaagtgtaggcgagattgattgcgagtaacgagccgtgggcggcgcagttcttgggcgccgtgggggagcttgcctgcggcatcgacaccatcaaggtggagccagtgtggcatcgcgtccccaccaatctggcgtcctcgcggatcccgccgtccccgctagttctgggcttctggctgatggtggtgctgctactccttaattaccgtttgcctgcaggtcaagaggctcgaagcgaggattcgcgaggcgtgcgcggcctccgccgcagccggctgccgtcgctcagccccgctcgccgcctggccgtctggtccctacccgtcggcccagcctgcgagagagagagcaaagaggggtggaagggagagagaagaggggaaaagggaagttgacgtggcacgctaacatgtggggtccacatgggtcccacgttgattcagccgctacgtagatcaaaaccactgaaagatctcgtgtgatcggttctgtatagttaagggatcccgcatatctgattttgtggttcgaggatgttttttatcccaatgacaagttgagggaccttcagtgtacttttttccgcaatgctactgcaaggttgacgttctcaaatgggcttgggacaaaggaaggatttgggaagagaagtatgtatggccactagtccgctatttccctttccggccttgcccatttgcccatcagcccagcacaggtacaaatctcccaaacactgaagaagaatattggaggacccaatactttcggcttgtaagacaaatagtaagatatacatatatctatctattctattatattattaaaatagctttgaaaggagacaatacgttcgctgtgggggctagaaattcccatattaatcggagaaaaaggaaaaaaagaaaaggagagtccaagtagaaatacaatataaaaatagctgaaattcggaattaaaaataagcaatattgaaagaaattttcatataagaacccaacactgtataaatcaaaattcaaaataaaaataaaataaaatccaaaattagaaaaaaaaaaaaagaggagagtctaagtagaaatacaatttaaaaatagctaaaatttggaattaaaaataagcaatattgaaagaagttaccatataagaacccaatacgagattaatcaaaattcgaaataaaaataaataaaatccaaaattagaaaagaaaaggatagtccaagtaggaatacattttaaaatagctgaaattcggaattaaaaataaggaatattaaaagaagagtccatataagaacccaatacgagattaattaaaattggaaataaaaataaaaataaaatccgaaattagccaaaaagaaaataagagttcatgtaggaatacaatttaaaattagctgaaattcggaattaaaaatacaaatactgaaagaagaatccatataagaacccaatacgagattaattaaaaatcagaataaaaaataaaataatatccaaaattagaaaaattaaaagagagttcaattaggaatacaattttgaaacaactgaaattgaaaataaaaaataaaaatattaaaagaacacaatacgatattaattaaaattttaaaaaataaattctgttagggttacgggtaaggtataccctttacccttcgatacatgccgcgtatcggtatggtatacctgcgcgtatacggacgctctctgcacacattaagggaatccatcatgcagttcacagatggaaagagtcctactcagacaagactgggtcgtcagtgcatcgtgcagggttcgatgtctccaagttctacttgaaaaccgcttgacctgcgatataaaagggacccccctaggaggacctaagaggaggaatctgatggccaacatcaccaccacagcctacgaagtcggagcctgcggaagccagattgccgagaggtctagttggattaacccgatacgatctcgtcggtttcatcgagttccatctttccctttgtaacctgtgatttccatcatataatcccataccaactggattagggctattacctatcaaggggcctgaaccagtataatcttcgtcttctgtttgcttgatgttgtactacgtagacccttgtaccagcgtaccccaatactctctatatccggtctacgggtatcacccgtcgacagtggcgcgccaggtagggggactttgtgctcaaggttctactactatgtcatccagcctcgtcgacaacatcgtcaacaccaacctcaactacgggcttcctgcctcaacgatgctagcgtggactcaagtcggcgaaatcgtctttccggtttacaccacgatgccgatctcagctgggccatcgatgaccagaaacgagaacgcagtggctgtaacccaagacggctccacgtcgaaaggtcctcccgccgaagtggagaaaggaacatcgacgacatccgaactcgagaagaattctaatgcggccaaaccttgtcgttccgaccagaaacacaagccgacgagaataacttccgaagcgacagggtcctggtgccctattcacaaatccaggaaacatactttgcaagcctgctgggtttttctcaacgcccgcgctgagattcgcgcctgcaaggagcgtggaattcagcgtgtttctccaactcgtggtgtccattgtcctattcacaagacaaagaaccacgacctctcaagctgtaaagtttttctcagcgtcacaaagacgtcatctcccaaggtccagcagccaggcaagacccttagagacgaagacaaagaatgaggaacgacactgaccccaaatcgtttcgttggtgttatcgacatcggttcttccgaatcgtcaattctacatctactcgaggactacaactcctcgtcaacaagtacgccacgtgaggtattggctatcgacgggacaggcacatcggcacgcgctaacaccggggcggaaaatcaaacgtctacactggctcagcacatcaggaccctcaacgcaatactgagggagaccccttatgaccccgttctacacgatgacctcgcacaatggacggagcggttacgagagtcagtgaccaacctcagcaacgcgttcgaagaggctgccgctgcaacccacccggaatagcaaccaactgctggtgccaacggcgaaaaccccgaacagcaggaatcaccccatcgagccagccctccacctcgcggcatcagcaatctccgcgatcacctaaacggtcgccgagaagctcgtcgcacacgggaaaacgagaaccgttcccggcatcacgtttcttcacgacatcacgacaatgaagaacgaggaggccgctcgaacaaagaccgagaccgtgatcaccgccacaaccgtcatattcgcgacgatcgtgagcgacggacgccgggtgataccagtcgaggacgccgccatcatgacgaagacggcagagaacggcgccgagacaacaacggagggcgacgacagtattttcgagaacccggtcggcgttctcgtaatcctacaccggaaccaagcgacccatcgacgtcctcatcttcttcctcctcctcatcgtcagacaacccactgcccccagtgctgggtgtagggctttcggtcgttcgttgcacgatgtccgatggcctgagaggtttcggccgggagcaatagagaagtacgattggagcactgacccagaagaatttcttcaagtctactccacaatactctatgctgccggagcggacgacaacgcgttggcgaattatttgccaactgcgttaaaaggctctgcgcgttcatggttgatgcaccttccgccctactcgatttcttcgtgggcagacctatggcagcagttcgtcgccaacttccagggaacctacaaacgccacgcgatcgaagacgacttacacgcattgatatagagctcgggtgaatccttgagggaatatgtccggcgctttaatgagtgcagaaatacaataccgaaatcaccgacgcttttgtaattcgcgccttcaagtccagtgtcagagatcgctacactacccaggagttagcaacgagacgcatcacaactactcagagactgttcgggattgttgagcgatgcgcccacgttgacgatgcacttagacgcaagaacgacaagccgaagaccgggggcgagaagaaatcagccacggacacacctgagtcaagcaaaaagaaaaatcgcaagaacgcgaaaaggaaagctcaagcagaagtattcgcagcagaatatgctaaccctcccaagcgtccagacccacaaggtagtgacgcaaggaaagcatggtgtcccatacacaagtcgaacagacattctttggaagactgccttgttttcaaaaaaaacgctcgagaagcacatgacatcagaacaaggcaaacgagtacgcgtggtcgagaaggatacggagatgaccgctcaggagtcggacccagcgtatccaaactctgacctccacgtctcacacattttcgggggctctacagcatactcctccaagagagagtataagaaagtggagcgagaagtctgctcgacgtggcagggggctgcacccaagatgaagtggtttgaacagaagatacaattttcggaagatgaccatcccaagaccgccgttatcccaggacgctatccgatcgtggtcgaacccactattcggaatatcaaggtcgcgcgggttctcatcgacggtggcagctcaattaacctcctcttcgccagcacattggacgccatgggaataccacgaagcgagttgacacccaccgatcaacccttccatggaattactccccagtcttcgtccaaaccaatgggcaaaatcacgctgcatgtgactttcggccaagcaaacaacttccggacagagcaaatcacctttgatgtcgctgaattcgatacagcgtataacgccatcatcgggagaactgcacttgcgaagttcatggccgcatctcactacgcgtatcaagtgctcaagatgccagggccgaagggaacaatcaccatccaagggaacgcaaagctggcggtacaatgtgacaagcggagcctcgacatggtcgaacaaacgctaagtccacccgccacaaccgagccacccaagaaaatgagcaagacaaacaagacgccgaaaccggatggcgcaatcaagaccgttcctctctctagtgccaaccctgacaagaccgtcaagatcggggcatcactaaacgagaaataggaactcgcgctcatcaccttcctccgcgacaatgctgacgcgttcgcttggcagccgtctgacatgccgggggtccccagggaggtgatcgagcacgaactcatggtgcgacccgatgccaagccagtaaagcaaagactacagagatttgcaccagaccgaagacaagccatacgagaagagctcgacaaacttctcaaagctggctttatcagagaagtacttcagccagagtggctagccaacccagtcatggtgcggaaggccaacgggaaatggagaatgtgtgtcgacttcaccgacctcaacaaggcgtgccccaaggatcacttccctcttcctcgaatagaccaactagtggactcaacagccggttgtgagctgctgagcttcctcgacgcttactccggctaccaccaaatcagcatggcgagagaggacgaagagaagacagcattcatcacgtcgttcggggtattttgctacgttaagatgccatttggactcataaccgctgggaacactttccagcgcacggtccagggcgcacttagcgaccagctcggcaacaacgtcgaggcatacgtcgacgacattgttgtcaagaccaagaaaagcgactcattgattaacgacctacgggaaacgttcgacaacctccgacgatatcgcctcatgatcaatccagagaagtgcaccttcagagtaccgtcgggcaagctgctcggcttcctcgtctctggcagaggaatagaagcgaatcccgagaagatcaaggcaatcgagaacatgaagtcgcccacaagactcaaggatgtacagaagctaaccggatgcacggcagcactaagcagattcgtcgctaggatgggagaatgaggacaacccttcttcgctctctgaagaagcaagataaatttgtatggacacaggaagccgaagaggcatttattgcactcaagcgctacctatcaaatctccctgtactcgttgctccccaacctaatgaagaattattcctttatattgctgccacgccatactccgtcagcactgtaattgtcgtcgagagagagaaagtccaacgaccagtatactatgtcagcgaagctctccacgacgcaaagaccagatatccacatatccaaaaaactgctctacgcagtaatcatgacatcaagaaagctacgacattacttccaagcccacagagtcacagttgtctcctccttccccctcggtgaagtcgtgagaaacaaagacattgtcggccgcattgcgaaatgggtagtcgagctaagtcagtttgatgtccactttgtaccacgaacagccatcaagtcccaagtactcgccgattttgtagctgactggaccatgcctgataatcaatcaaacaaccagatcgacaacgtggataatggcgttcgacggtgcactcaacagccaaggagcaggggcaggattcatcttgacatctccttccatagatcaattcaagcacgcaatccacctcaacttcagggcgaccaataacacagccgagtacgaaggactactcgccgggataagagcagcagccgcacttggggtcaaacgactgatcgtgaaaggggactccgagctagtcgcgaaccaggtacacaaagattataaatgctctaaccccgagttatctaagtacctcgtagaagtcaggaagctggagaaaaggttcgatgggatcgaggtccgacacgtataccgcaaggacaacatcaagccagatgacctagcgcgacgtgcgtccaaacgagaaccactcgagcctggcacctttctggacatcccgacgaagccatcagtgaaagaggcaatcggcgagatcaacacagccgcccccgacatcagctcggaggccacagaggcggaacgcgccattgccaatatcgagaccacagacgattggcacaccccactgatcaaattcatcaacagcgaagagttgcccgaggacgacgcagaggctgagaaaataacccgtaaagcaaaaatctactgcacgatcggcaacgatctatacaagaaagcgccaaacggagtacttctcaaatatgtctcgtccgacgatggcagacacctcctcctcgatatacatgaacgcatctgtgggtcacatgccgccggtcgcacattggtcgggaaagcctttcgacaagggtttttctgaccaaccgccctcaaagacgcatgtgacatggtccagcaatgtgaagcctgtcaattccacagcaagcacacaaagctacctgcacaagcgctcaagaccatccctcttacttggccgttctcgtgctgggggctatatatactcgggccattcccacaaggacagggcggctacaagttcctattcgtggcgatcgacaaattcactaaatggaccgaagcggtacccacgggggaaatcaaggccgccaacgccatcaagttcatcaaggggatattttgcagatacggactaccgcatcgcatcattacagacaacggctcccagttcatcagtgccgacttccaggattactgcatcgggctgggagtcaaaatatgcttcgcttcggtttcccatcctcaaagcaacggacaagtcaagagggcaaacagcatagtactacaagggatcaagacccgtgtctacgacaggctcatgtcacatgacaacaaatgggtcgaagaactcccatcagtactatgggccatacacaccacaccgacaacgtccaacaaggaaacacccttcttcctcgtgtatggctccgaagccatgctccccagcgagctacgacatcagagtacacgagcacagaagtattccgatgaggaacaggaggagcagcgaaacgacgatgtgaatctactcgaggaacatcgcgaacgagttgccgttcgagcagccgcctaccaacaagcccttcgccgctaccacgagaagcgcattcgagcacgcatactttcgatcggcgactacgtcctccaaagggttcaaagccaagcagggcgaaacaagctctcacccaaataggaaggaccatacacgatcacacaagtcttgcgaccaggcgcattcaaaattgcagacagcgatggccacgagttggcaaactcatggaacattaaccaactacgtaaattctatgtatgatcaataccatccatacctgtaagacaacttacatcatcaataaagcctattttcaggcgcatattacaatcacattgttcatgcctgacgatccctcacccagatgacacctagcgttgaaacctatcctcatgtccctttacgccatgctgacaaggcctccgaggatcctaagggatcttcggctgggaacgcccagagccgataaggccttgtcggattctgtagagacaaaagaccatgttagacctgatcgtgtaagagttctccccgtgcgtattaagcaagccgcgtaatcggaaatgaactttccaacttcacggctgggtttaggatcagtgcttgttcaacagaggtaggtcaaaggtccaagagccttgtcctccgggaaccattctccgacgacaaggctgggggctagggagagtgtacaactcaaacgactgcccaaagtcaagaactgaggaggcactcttacacactacatccagagtaagaaggactcgttacgatagatctcttttctatttcataagatactttttacaattccgcacaagtccaaaattatattacatttttccctaagatgtctgtcacagggtacaaaggctaccaggaaggccaacgccagtccatcgactggaaaacttcctccgcaagcggcgccatcgacttcgccaggtgttctatctccgccagagtcctccgagaacgagcgaatgtgaagaaactcgaggtgcagctgcggacgatgatctcgtatgcaagccaacacatgccctccggcatatcggctcgaccgacggcattcctgcttcaaggcttcgtcaatgcgcttgccgacgccttcgagctgagtacatgccccattcagccacgagatgtagccggccgccgattcctcgggatctccacggggcacccggagctccctacaaacatgggccatggacgtgcagcaactctttagataagagtcgaaccacacctcgcgacccctgagtgcctccacggcctagtcttttttcacctccaccatcgccctcttgagttccgcgacttcacacttcgtcttccaatattggatgcgacggtcttggtcggcaagtctactctcgaggtctgctcttccattccgagaacacaaaaaccaagttactccgggaagaaaaatgaaggagatgaaaacaaagatcaccaacttaaggaggtcatcgccacgcccgtttccacgggtgagtcttgtcccatatcatcctgcgacataggcgtttggagggtaatcgccggggcgaccaccggtaacttgggctgcccacgctgctggacatcctcgacatcgacatccctacaaacgacaaccaaaagtactcaggaccagggtgccaacagagatcaaggcagcgattgcacgaataaaggcagttgaagccgacaactgttatacaaagtgtagtcgattacaaatgatctgaggccctactcttcaaaaagcgggagaacagactctcccagttcaccaacctcctccatcacgcccttacgagcgtcgttggcagccccccggtccaaggtctgctgaagatcgagtttggggtgcgccagtcggacacacgctaggacgtgacaggcccgtgtaaatcccgtttgacgcctcctccacgaccctggccgcatgcttggagggtatcgcctccatcgccgtagccagttccgcaagtgaggacgtcagcgagaactcgtcggggttcgctgggatggttgtcgtgacgccacactgcccggcgagctgatgaagaccggtgtaggtgacccgcagcgacccacggatctccgacaggttgttctcgagttccgacatccggtcctcgagtccccgccgttgccactcattaccggccaccagctccctcatcttctggaggtcctcgcgaacctccgccaggtcgcgttccagtttgtcggcatgcttgtttgccgacgacgccgccgccgtcttcgcctcctcgatctcacgactcacgccgcgagcgccagcctcgaggatgcgtttcatctcagcttggagctcccccaggtgaggacattggcagatggcccacgagtaggtctgagggcactggacggaccgcttggcatcgcttcatggctctttggcgcgacaacaacatcggttgaggttgccgcaggagacgctccggaggccccttcggacttgtcctgcgccgctctcgcctgcgccgcccttgcctgcgccgacctgcagaagatcctcaaatcaagccgccagaagaaaaacgaggagaggatctcgacttccgcttacttacttctcgcctagcgtcaccagcttcctccgctgcggaggtggcgaagacgcgtccacggcctgggtaaatcaagcgcgagttgaggtgacatctcttgaatacgagattaacaagccaagggacttaccggtggggaggatgctctccggcgcctaccgagaacggaggtgaatgtccttcccgttttcgggacacggctgccactagtcgtggcagcagcggcgatggccacgttaggcgtctcccgagcgacgctctccttcagtgaggccgtcgcctggtggtccgcgagcagtccaataacgtcagtcagagggagagcctacaccgcatgaaatcattttccgacccgggaagcaaaaatagtgaggttaccgagtacactcacgttgattgcggcttcacgctcgatcgcctccttatcataaagaggcatggggacgtcgcttgccgttgtcaggccgctgatcattaattggccgacgcggcgctccacggtggcgtcactcaagcctgcagatcaagaacagaattcgataaattagggagaacatgcacagaaggggatcaaattaaacacaagaaaaataccccgaggagaaacccgggtcgcgtcctccggccaagagtagtcaaaggctgggtgggcgagagcctggagcagctggatccgcctactaatgaagtcggtagcgacttcataccccgacaaacctcgcgctcagaggtcatcaatggcatcgatgaacgactgaagagcaggggtcaaggcgggttttgcggtccaagatgggattttgtctggttgttcctcaggaacgacaaagatcggatctgaatcctctatctgaagatagaaccaccttgcccgccatctgctacgagaagaagggcactggaaggggatatatcgcgacttcaggccatctcgaagtcggaaacccacacatccagataccctagtagattccatccaacgcaactcgtagtagaagcgaaagaggtcgagaaacggctctaccccaatgtaggcctcacaaagatgtgaaaagatgctgaggaaggcaatggaattggggttcaaatggagcagagaaaggccgtagaaattcaagaccaagagaagaaactcagaaggcggaggaagaaagccacagagaatatagtcctcgatcgcaactatacggcccaggacaggttcaggttcagtacctcctggttccctctccatggctccgcggccggggagggcgccatcctcctgtagcttcttaagcgacgcgctggtggaggtagacatgccgagatccatcgccgccggagatcgccggagaaggggctgagatgaacaatctagggctttgcaggagcggaggagacaaggaacgcctggaggctggagagcttttttcacaacgggcggacttcaaaatggatcctcaaaatcctcttaaacagacgcatttccgacggtgcgaatttcaaggaaaggagagagagattaccgccgaaaatttctaggtccgttacgcgcggcagtttttcagacttcagtttaaattcactcatgaccgttgggcttcacatagtgttgtcgattgcgtcctatctctacggttcgcacaccgagaacgacaacagcctcaacaccagaagtcgcgattggttacacgagtccatttaagcagaagtcgggggctactgtcagggttatgggtaaggtataccctttacccttcaatacatgtcgcgtatcggtatggtatacctgcgcgtatacggacgctctctgcatacattaagggaatccatcatggagttcaacagatggaaagagtcctactcgggcaagactgggtcgtcagtgcatcatgcagggtccgatgtctccaagttttacttggaaaccgcttgacctgcgatataaaagggaccccctgggaggacctaagaggaggaatctgatagccaacatcatcaccatagcctacgaagtcggagcctgcggaagccagattgccgagaggtctagtcggattaacccgatacgatctcgtcggtttcatcgagttccatctttccctttgtaacctgtgatttccatcatataatctcataccaactggattagggctattacctatcaaggggcctgaaccagtataatcttcgtcttctgtttgcttgatgtcgtactacgtagacccttgtaccagcgtaccccaatactctctatatccggtctacgggtatcacccatcgacaaattctaaattagaaaaagaaaaataagaattcaattaggaatacaatttataaataactaaaatttgtgataaaaataaagactattgaaagaaaagaccatctaaaatacatgacgagataaattaagtatccggcctataaaggagtagagtggtggcgattgatacgacatataaaaacgttaataaaacaccaaataaaggagggacgacaggcatgccatgaagcaaacgagcaaggcagttgtcgagacttctagaaagtaaaaaaaaaccctattgataatcatattcgatttttaaaatctcaatgataataaaaaggagaagtagcgggcgggatgtatagaagtatagttgcagagccgccgacggttgacgggacttctagaaaataaaaaataaattccaacgatagttatgttcaatttttagaatcacaatgacaataaagagtagacggcagacggaccgtagaggagaatagtggcatcgtttggtgagacttctaaaattataaaaaaatgaaacccaacaagacaataaactctaaaaactacaaggtccaaatttttaaaggtttggaacttctaaaaaataatgttcgattttaaaatctcaatgacaataaagaagggagacagcgggcgagccgtagagaagtacaatggcaaagccgctgatggtttggcgggacttctagaaagtaaaaatgaatccaaatgataattatgttcgatttttaaaatctcaatgacaataaagagaagagacagtggacaggccatagaggagtataatggcaacgtttgacgggacatctagaaattataaaaacgaaacacaacgtgacaataaactctaaaaactataagatccaatttttaaaggaaggagatgacatgaggggtagcaactggtctgacttttaaaacactatataattagaaacacagggatgataaggtttggtctttcaaaaacttaagacaacgagatagctatttaataaattttaaataaaatcatactaaaatatatatgattttatttggatgttagccgtgtaattgcgcgggtcacccagctagtttaaactattctaaaactaactggagcagcattttttccctctcgtcttgttaagatttgggttttccggctaattcgcgcgcgacttttcaggataagtacttctctcctctttagtatccctcttacccaccttttccccctccatcccattccatatctccatgtggttgggctcttttctcctctaagagcaggtacaatagcaggctataagccagttgcaagcctgcaaacatattttaagtagataaataaggagagagaatggcagcgagctacagattcgtagccagctgtagcacggactccaagacacattgtgtgtatggcaggtgggaccaggtattaatagcgtagtatgtaactattgtatgaatgagctattagattggctatagatgaattggagcttgtagtaggctatactattaaacttgctctaaggctgtattcgttattcctttcccaaccagaacagtacgcatggaaaatgaagcgatccattagcacatgattaattaagtattagctaatttttttcaaaaatggattaatttgattttttttaagcaactttcgtataaaaactttttgcaaaaaaaagcaccgtttagcagtttgaaaagcgtgcgcgcgaaaaaaaagagggagatgggttgggaaaagaggtgtagatgttcttaccctatgtttcctaactcatctccctcgttttccacgctcatgcttttcaaactgctaaatggtatgtattttcaaaaagtttcgatacaaaagttgcttaaaaaatcatattaattcatttttttaaaaatagctaatatttaattaatcacgtgctaatggaccattccgttttctgtgcgtagtgttctggttgggaatgagctccaacgaacacagcctaaaggctgtctctaggctctattcactttatcctcacaagtaagagattgaaggggactgaggggattaatttcacacctcaattggtataaaattattcctctccctaaatcccgctcaattcctttatgagtgggaacaagacctaacggtggtgtttctctgctgcccttctggctcggacaacaacagtgctaccactgcctccttggccacgacctcggcagcccaatggtggtcggtgctcgccgtcgcgtctctcttggcccaatttttcctttttcatgaagataccctgaagccatcaagagagatgggctaggccggttacacgtgggctcacttacatgtgctttctatggtatggtttggtttgtggcctaaataggccttactaaattttgtcagtgcaaaattttggcaagtttttgcatgactacttttggtaaggtaaagttgtgtttggattggagccaaaacagcctaagttcactattgaaatggcctattttcttaggcatgccaaaatttggcttcaaaccaaatagacactaaacactattgaaattaccaaatattggtaagcctaatttaggcctcaaaccaaaccagccctatgtatttttattttatttttctaactagatgtcatctacatatgtgaaagcagcaagctttctcaaaactaataagccacgtcatgtgaataataattgccttaggatgagagtaggaataaatttagaccgttggatccatttatgtgtataccaatcacacatcaggagagttccagatgaataggtcatgtgcatcgatcagtgcatatacagatagtttcagatggtagtcagagcaaaactagtatcaactaaaaccacctccaatactgtcatgggatctgatttaaacggtttttttcttttcaaagatgcgggaggggacggtggtgaaaaattctggtatagtggtttaggatgtctattaaactcgatataaaatgagaaatagcaactggatttattctttttagcattccgcaatagagaatagccgaaagtattgggtcatcgaatccaataatattttgcagtgtttgagagattgtacgcacatgggcaaggccgaaaagtattgggcctacgtgctatattttcagatggaataagttcacttcgtgaccctcaactaaccttaaaccacaaaaccagatatctcgactccaaactcctaaaact

SEQ ID NO: 60517 - DNA, 10697 bp, Oryza sativa
catcgccgtcgtcatcgcccggcccccgccactccgcgcgctagcctccaaggggcggaggcagagagcccctctccctctgccgagtcgccccgctccctcccccttttcccgaatcggcaaaagagcaagccccttttctctccctcctttttccccttttcctcccgccggcgtcatcctccctccctcctgtcgccgttttggccgctagccggagcgccagctcgcgccttgaccgccaaagtcggtttccaaaccgacattgccgccccctataaacccaggcgccctcccttcccttttctcccattcttccctgtttctcgcccgcgccattgccgtccctctcgccgaccgcagccgtcgcgtgtgtgccggaggagccggtgcgcactaggacgcggaaggggactccgggcgctcgtcttcctcctcttccccggcccgaggccggagagatcactcccgcgccgtcggcctctcgtcactgcgccccgtcccgcacggtagtgtctctctccgttcttcctcctcgctccatctcctccccctagctttcggtagtagcttaagtagactccccgtagttagccggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcgacctctcgtgacctcgtcgccgtttccctcttctcccgccgccggttgtcgctaccgcaatccgccaccgtcgagcatcctccggcgaatccgagccgttggctcgcctccccttgtcacgtgcaaccgcccggtgtgctcgctgttgcccgtatcgccgtggttcgctccgccgctcgtcgccgccgcccgccgtccattcgcggccgggtcgtcgtctacctcccgccggcccgcgtggcatccacgtaggcgccacgtcggcgccagcttagccagaccgggtcgggccgaccccggtcggtccctccgcgtgcgcgcgatccaccgcgagccgtgaggctacgcgtgggcccgccgcacgtgcgtccaccgcggaccgcgcgcatgcactgcgtcccttccccgcccgcgcgcgtgcgtcgcgtgctccctccgcacggtgagccgagccgctgacaagcgggtcccacccgggaccgcgcgtggtgagcccggtccaccggctctctctctcctccctcccgcgcgcgcgcgagtttgggccgccttgggccggccggcccatttagctcggccggaccgctccatttctcttgggccgcgccctagccgtccgagaaaagtctatattccctccctcccttcttttctttttcttttccaaaaaggatttaattaaatccttttcctttagatcaaaaattcaataatcttagaaattcaatatcttcccaaccgtaaatccgtttgactccgttcaacttccaaaattccccaaatctcgagatctatctaatggcacgcttagaggtctttaatagggctttattttcgccgtttgttgagttgttccgtttcgcgtatagtttcagagcccgaagacccgcagtgcgaggatttcgaggatcaagctccagatctcgagcaaggcaagccacctttgaacatcttgagcctatatttgaaatttaattatgttgcttgcaaaatattatgcattgatagatcgcacttaatctgtttgtcccgtctgcaaggcagattggcagacctacctaatttgtcgcatttgatccttcctttgttaattgctataccatgtccccttgtaaccacccagttgcgcctcgatactcgtgcactctgtgcaagtatcgacggtcgccttcaaacttaaaatctgagtaacaacttgggtaaaactggagttttacaaaagacttggaaaacccgacacctgggtcggtgcttgcgaactaaatggattttccaaaaccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtcccccggcgtggctgatccccacgggctgggtgacccgggttagtaatgtcatgtgggtaaagtgtaccccctctgcagaggttaacaaactgttcgaacagccgtgcccacggacatgggcggatgtgaggtgattcctagcgtagttttgtttgtctactgcttgtgaaattgctgttgtgaaaaggggttcgatgtttgaaaaatctgcagctgatgggatcagctaggcccgggtggccgtttggaaagttgttggcccgggtggccgtttaaaaagctattggccgggtgccaaccttgttgcaatcctaaagattgacacattgcacatactccgaccggacgagacgcactgtctcatccgtgtcgtttgagaagcactcacttagttattttcagaaaagagttcaaataaaatcaattgcaaaaacaacagccttcccttgaagcctgcattaaacacttatttcccctggcttgctgagtacccccgtactcacccttgctctatataaatatccccccccagttgctgaagaagatgaagcggatcctgctgatgaggagttcttccaggagcaagccagctacgatgagttttagggtttcggcctagttcccaagtcgcgcctgtgatgtttggcccaagtcctggcttccgtttcccttttgtaatgcagttgtgagcttgggatctgtccgcagcccaacatgactgtacctctactctataataaagagacctctgttgctgtggtattctgtctccctgtgataccagcactgtttcctgggactggtatcgattaacaggctaaattggagcatcacgggctagttccggtcgggactagttcggggcgtgacagatcccatattcgacttcaaatgctacagctatccaactaaacacattcgttttcggtggactatacaagtcgaaccggcactagagatgatctaacgaggataagacaggacaccctctattcaacctcgtaccagattggataataacctgatacaaatcaagatagatgtttatatatttatagtactaaaaatatgttttatactatgttcctaaaacacaaaaattaatcagcgaggcctcttgatattgtcttatcgcgcgacgccattcagattcgtccacacacgctgcgtcatagccgtttgatcgtgggagaggtggagaagcctactacacatgcatgcctttttttattagacatgcatgtctttttccccttcttataaagttttatctcaaattacttattcgatctataatccgattacatcagtgtgtttgttataattaaatcttcacaacaagatcttacatattatattacgacgaaaaaatatttatatttataaattacttttattatatactccctccgtcccaaaatataacaacttttagccctcaggatttatcccaaaatataacaacttctccaccaacattttcttgtcaaccaatcacaacccttcaccattcacctttctcacgtaccttcactactcatccattcacaattctccaccactcacttctaactactttcttaataaccgtatccaactctaaaacttcttatattttgggacggagggagtacgtatcgtaagttacttttatcatatataaattacttttagattttattaaattatttatacattcataatgctctaagttgattatttttattattgtttttaagtcaattctataatgtatggactttaaatttaatttttagatataccatttttttctccctacaacgaatttacttctaatgttgtaacaaattatttccattttgtgctaagttacttttatgatttatgtaaattacttttagactttattttatttactttcataaatgtatttacttgaaaatcttctctacacttttgtttgtgaatttacttcacatagtttcttatttcaactcagtcataatgtaattacttttaatactatagagagttacttctattacataactaagttacttctataatttaaataaattacttttaaattaataaaatgtttcgaatatattaacatggatctcgttttatcacatatttcgagcagagtacaatgatgcaaatagatcttaaaaataatatgtgatttaaaagatataagtcattaaagatgttttaaaaaagtacaccattgtattttttagctaaagagagatttatatgtggatgaagtggtcgctaattaaaacaaaccagctatcggccgctccctagtcgcgtcctttctaaaattagggcttgtctagttagtaaaaacttttgcctatgcatgtcacataggattatacagatacacatttggagtattaaacatagtataataacaaaacaaattatagattctaccaggaaactgtgagacgaatttattaagcctaattaatccgtcattagcaaatatttactgtagcaccacattgtcaaattatgatgcaattaggcttaaaagattcgtctcgcaattttctagcgaactatgtaattgttttttttttgtctatatttagtattctatacatatgtccaaatattcaatgtgacagcataaaatattttgtttgggaactaagcaggcctttattttaggatggtgagggcgggcttatatgtgcttcccccaggaataagtccatttttcctccctcatctcttgcgcttgcgtgaataacatccctcaactggaaaactgggtataacgcctccttcttctctgaaaaccagagcaaatcacctccctcattggtttggctggcgttttcgtctgacgtggtgtcgttgacccgttgacgagctgactcagcgtggtgagacccacatgtcagtgcaaactctcctttccttcttcctcctccctctctctcgaccttctctctctcccgcggtctctctctccaccttggccagagcagtggcggtggcggtagggagcgacggtggtggcagacgatgtcggagcactgatcgccgtcgtacgaccaaagtagcgagaacacgcaggacgtggagaaggggagagagagagtcatccccgtcaccgccggtgccgccgtcctagagatccctcgccgagctcctgtcctgccaccaccgccgtccaccaccgccgtccaccaccggtcgccgtcccgtgctccttcgctatccccgggcggagaagaaaggaagaccggggagagagggggggagagccatccgtcaccacgagttgcgtggccctggagcgttgcgatgctactgctggcttcttcctgcgatgctactgaggttgaagaaagcctctgtctaggtaattctttttgggtgtagctatatgtatggcgctatatttttcatcaaaaaatagtcggtatgtatttatattgtaagtccctaaattacatacgtaattttagtgtatttacaatgtaagtcttaaaattacatatgtaaattcgaaaattacatactattacatatgtaagtggggtgtaaatgaggtgtaactactgtgtaagtggctaaaaaaatcgattgtagcatatggcgccatatttctagcaactccgttctttttcttcttttctctcactcactccatcagctgctagctttgctagctaggagtagctagctgcttgtgctcttgctgtcgagaggaggaagaaagactcgaggtggttggctgtcatgttgtgcatggctacattcagagccccgacggtgatgtcatcgactgcgtgccgctgcacctgcaaccggcgttcgaccacccgaagctcattcatttttgtttcgatttgcagtgatcgtttctatctccggcgacgtttcttgatcgtgtttgtgactgtgtgcgcgtgcaggttgagccggagccagaggagaggcccaaggtcggcggcgcggcggtggcgcatggggaggcggcggaggaggaggtcgtgttcccgatggcgtggacggacgaggacgagtcgtgcctggaggggacgatgccgatgcggcagacgacgaagcgagacgtgctgaggtccagctcctctctctatttcaggatgaagcagcctcgtgcctgcgtgccgctggtgtcgtccgcgtgaggaagaagatgggatgggggttgctaacaggtggggtccataagctgactcagctagttaatggaggagccaccgccacgtaagtgccacgtaggacaaaaccgcctccgaaaccgctgagggaggtgatttcctctggttttcagagaagaaggaggcattatacctggttttccggttgagggatgttattcatccaagagcaagagatgagggaggtaaaatggacttattccttctgccaacggaggtgtgtcgtgttctctcggccgttggtgaagccatctgctgaaaggaagcccaagaaaaagctgcaaacctgggcttgcgatgggccagaaaattttccgtagtcgcgatgggctcaaccgctcgagaccgaagggtctagcaattttgggaggcccaagtagaggagatggaacatggaaggaggacactagaagccgatgggttacaaggtcttctcctcccgctcgccggctcctcctcgcaccaactccggcgagcgcggcctcgccgccggcagcggcggcggagggggtggcatggaccggtggaccggtgtcctcaacgtcccgctctcccgaggtggccctcccttccgcgtcgccgcctcgctcgtccttactccggccaaaaccctcgccgtaagccccaatcccctgcaccgtcgtctccttcctcgctggccctctctctctctctctaatccgaggcctgattctgccaggtcccatgcgccaacgcgattctcttcacgggcgaccgcgtccggggcagcggcgacccggcgatcgagcggctgtcggacgccgcctacctggctcggctcctcgccgggaagctcaccggggaggccaacgcgtgggtggtggatgccgcctgcttcgctggttcgtttgcagtttaccgagatctcgttccgtccgtggacgccgtgggcgaccccgagcggtatgatcccactggcttcccggcggcggctggcgttaccatcattttaggacattgcattcgtgaggtttggtaaaattctgtaatttctctattcttttatgcaattagaatcattacaatcaagcgtttattcgaatactttgtacttgtatcttaatatttccgtagtagtatgtttagatacttacatatacaggagtaccattgaattactgatgcaatcgtgaattcatgaggcacattattcatcactggtttcagttatagttagtatacgatgctacaataactgaattcttgatattttgttaatttttggttaccaacacaggaatttcgcgctaacatttttttttgtcaacgtaaggtttcagcctgctatatgaatcagcttctcagattattagttcacatttggtaaagtaaatatgactttctaaggatgacttgattgggtttctgggatggtgatttttgtctttcttgcttgatttaccttttgactacatgagcagctactactgtattttttttttttgctaacgtaatgcttagcatattggatatatagatatactgccatggtgcgctaaacttcaagaactttgcttataaaataaatacttcctaaaataggagaaaacgaatgcattatatgttagttttctttttactccaatgcaatttctgtcttgatagttgtttacctactgagatgtcaattgtttattgcaatatctcactattttgagtcttcatttcatgatttcatccatttatcgtgtcaaattattgtgctgaattgctttgtactgaattgcatttcttccatgcacaatttgtggttaccagatacaatctatggttacgaaggccacaatgaagggttcatcaggcaatcaaagtcctactacatcactgttaaaatactgtcctccgaagactgtcatcctggggttcagtaagggtggagttgttgtcaaccagctcgtgacagaacttgcctgtttggcctcagaatcagcaaagatatcagatgatgtttcaggatcaagcccacctcttttaactcgcaatctccttgttcctatttcagctactgagtttttgtcaagtgcgtctgaattccattatgtggatgttggcctcaatcatgctggagcgtacattaccgatcatgcagtgattaaggagatagcaaattatcttatgcacactagtaagaatctctgttttgtccttcatggtactccgaggcagtggtctgatcctaaccgctcatggatccagatggagaaagaggtaatgctgcgcttgcttcaagatgaagctcaaaggtgtgaagggagacttgtgttatcccaaaagagatattttgatggcaaacctcgcagtctgctcatgcattttgaaattttggaagtaatggacataggctgactctatgtaaacggtctgtagcttttttactcccgtcagggatatgcatagaataccagaatgtgaatatatctgagggtcttggatactttcatccgtgctgacttcacggtatcccattccataagttgttttgtgcatgagaattcttgacagaataatcaaccacagttggattcctcatatcaaatgatgatctatgaaatgtctataagatgctttatccacctacctttccatttgagacaaatgtccacgctgaacttgtaaatggtaattggagctttccagcaaacgtaattttttccattctgacctcaagttggtcgtgatgaactgctgaatagtttggattacggatgacctgccggcttaccattctggtacgttatgctgtcacggatacttgttttttttttggtcaattttttttcctacagttcaagtgagaacaggtctctggtatttgctttgccaaattagcggcacatggtatcttgctatctactggctccattgtacttgtcaaatgtatcaagaccagtgtatttagctatatgacatttcgacaaaatcagtcttggccgttaggttacctattttgagttatggacacacgagcaaggccaaaacatgtgtgccgggcgtgcgacccatcaacctactagcaataggggggaaaacttagcaatggaggcccggcatagaaagtcgtggaattacaccatacctggaatttcatccaaattcaacttctgatcagtttcctgtatcagatgtcagaacgaactacatgatcgttccattgctggccgaattgcacagtgcagattcagcggtgaatcattcgtagtcaaaagggaagaatatcgccgtccacaccaactttacattatccatcaaacaaatcattggttatactaacaaagtactccgtaagataacaccattagtggttctgttagtaaagtagtggcactatagtatactactactgcctgctgatccgtgattccagctacactcttttaactgttcttgtctcactctctgtcgaacacctgaaccagtcaaacaacagtgtgctcgaccaagtggctgccgaattaacaaagttaaaaccggacctgcctttcatttcgttcggttgacaagttggcagaatacttcgcagtgatatcttaatcgtggcatacagtttgggggtaaattatgcctcggaatcctgtccgggcggccgcgaccggatcacggagcttggactcttgcgaacggtgtcgttgctgcctttcaggttttagacgtttagtcgcggtacaatccgcaacctctcgctgcgggacaaaactcgagtaaaaccgcacgaacggatcaaacgctagacgccatcggcgcgagtccaaaaaactactttttcgggggggacgcaatatcgcctcttgaaacggtcagttcagagaatcagagtcccagagatagatatcctttctgtaatttttttccccctgaaatgcaatgtggcatagtcaggtagtagcttatcaaatgcgtcaggttgtttggggttttgcgaagcgaatgagctcgtatactcgtatgcattgcgtgcatgcttctcggcgttggcttcagagttcagaatatcatggacttcagcagtcctgaataaaccggatttctgcattggtttgaactctgaaatcgacctgtgaacagaatcaagcgatagattcaagagataaaagcaatgctgctttcttttagtaatttcactgg

SEQ ID NO: 60518 - DNA, 15756 bp, Oryza sativa
  unsure (1)..(15756): unsure at all n locations
ctatgcctacaagtttatgggattgcacagcagttggtgcatcgtttccactggcttgtccctggttacataatgggtggtgagaacagagcaaaagaaaaggcaagattgcgaaaaggtatatcttgttcaaggacatattttgtatctcattaaatatacttttatatagcatcatatattgaggacatgtttattgcaggaatatcaattctaattgctactcctgggcgtcttctggaccacttacaacatacgtcatcatttgtctacccaaatatgcgttggatagtttttgatgaagctgacaggtctgatagccatacattcattactcggtttaccctatttcttagaaggtttttaagtgaacataactctttatgttattggtgctcatattcttgcagcattcttgaacttggttttgggaaagcactagaggatatactagagcacttgggttcaaggaatgatacttctaaccaaaataaaaacaaaatggaacctatgaaaaggcaaaaccttctgttatctgcaactctcaatgaaaaggtgaatcggttagccaagattagtttgaagaaccctgtgatgattggtcttgacgaacagaactccagtgcccatgggaagaaccacacttctctattatctgatgatgaagaggaaatactggaaaagcacaacgttacagtggaacaagcagttgacgatttcaagcttcctgcacagcttgttcaaagatatgttaaaggtagcagaaaattgcctccttatatcattttaagtcatgttttccctttgctcacttagtttttatatttcattcagtttcatgtggttcaaggctcgcgattcttcttaccattcttaaatctctgtttgaaagacaactgtctcataaggtaaattctctatatccagaccagaagctgcttcggtttcactatgttgtaacttttccacttcaagttttgcttgccaccaataaatactaaaagtcatgtgagttaaactattctgcgtttgtttgtgtcttctttttgcaggttgttgttttcctgtcaacatgtgactctgtagatttccaccatacagtactcagccagcttgagtggagccctggcctgcaactggatacggataagaagcaaaagtttattagctgcaaagtgttccgtttacatgggaatatggaccaggatgatcgcaagaaatcatttctgggattcagttctgagaaatctgcaattcttgtatctactgatgttgctgctaggggcttggactttccaaaagttaaatgtatcatacagtatgattcacctggggaggcttctgaatatgttcacaggtacctgaagcatctccctgtctaaaacatttatttgtaggtttctgatttattgtttccaacatagttataattgtattatttgattgtatacgaacagacaaaatgtattgttgcagactaaagcactttactctttacctggttcctttttatgtggtagtattgttcattgatttcctgttacatgagactgtttttgtcaaaactctgcaaagtttttagtcttttgagtgctattctgtcatgtaatttcttgtgaagatgttaaggcatttgatgtaagctaagctatagagacactttctcttgtgcttcccttttgctatttatgttcttttttttgtttatttcaagtatcagcaactttattcgtttattttagggttggaagaactgcaaggattggtgaaaagggggaggctctcctgtttctccaacctattgaaaccgactacttgagagatctagagctacatggtgcatcacttacagaataccccctccaaaaggttttagacagttttcctgtaaatggacagaggcttcacaaaaggaagcaaatatctttagatatgcatccatggataatgtctttacagagagcattggaaagttttgtcacatccgaggtaatgtatagaacacattttcgttctgtttcttggtatcatatttggctactcatgcacaatgagataaatagtgcacaaatatgattccgttgatcgtctattgtgaataccatgagcttttgaccttttgctgatcttagcaaatgcattgtcatgtgtcctcttatccaggacacgacgaagaagcttgcaagagatgccttctgttcttgggtgcgcgcctacactgcccaccgaggtgaactgaagaagatttttatggtcaagaagctccatttggggcatgtagctagaagctttgggttgaaggagcaaccctccttgttgggaaggtcacaccaggtgcaactcaagaagaggaagaaagaacagaagcgcgaaaggcctgcaaaaaggaggaaaatcccggccaagagatgaatctccatagcagaaatgcttgtaactcgaaaactaatggtggatcatgatccactccaattttgtggaactaacagccgcagcttgaaggtgaaaacattgaccccatgaagctttcatgttttggccagaagcctagagaagagctagtgtactgcctgtaatctgaaatgtatcaaaagacacagaatgttttgctcagtttgggattatctactgctctgctagttacccattttaatcagaaatataatccatgtgtttcttccttacgatattgtttgctcaaaatattatccatgtaaaaactggatttgttagaaaggcttattggctggatgcaattgaatgatacagtacaaatgttctaactcggtaagcacgtttttcagacaagcaatgttctacctcattgagttaaaaccatactatcaaaattacattgggactctgaaaggaaacaacattactgcctttaacggttttcataatacaaagtttgctctaaatggcccccttaatctacactgttctggtgattccttcctgaccaaacatggtgcacaaacttccatccatgggcaacatgtcatcagaggagcttctcaaaagtgaaccaaactgtatatgagtgtccatgaaagctgcagcaaaaagaagcaaattcagtttcgaaccaaaacaaacggaaacagggtagttacagaaattggttatgtttttctttttaccaggaaaagagtgaaagaggcaaacattccctcctgaagtagtgctccatggcctccaaagtcttcctcatcaatcttcaacaggtatgcatagtaccagtaaacgagcccagtagaaatagtcacaaacctgtgtacaatatatgtcatatgttaagaggaacatatcaaaagctcagatgctggtattaattaacgatctttacagagttcactgtgccatacagaagaaagaaaacagtaattactgaaagtataataatgaaacaataattacagtaattctgtgcaaggtattgcttactagtgtcatataaacagaaataattactgataattctgcataaattttcagggtactcagctaccgacaggttcgataatcatgcttgcaatgtactccaggccaaattaaattgtattgccaaaagctcatcttaagtgatacagcacatgaatctaaagaacctagtagcattcacagtttcacacactaattatactaaattcaagatggatgtttgcgcatgcttgcttatagcttcagggtcttctaattatcagcaattaaaggttcaacgcacagttaatcttcaccgaagataacctaaatgcatctagggcagcagatgtgcacgtatcatcgagctaagatcttgcagttacaggtgtcaaaacaaccaaaatccacaccaaagcaaaaggtggattttgtagacaatgacctcctgtagcgcagatcccaattcccaactaaaaagcagaaaagttattaacatatgataaatctgatcccctatctgcactacaattgaactcctcaatgtgaggaagagactcaacaagacacatctgactacaaatccacgaatccagcatagggcgagatgggattggaggcgtgagcaactcacagtgcgatccagatggcgccgacgagggggacggctccccagagcaggccgcaggcgaggccgagcacctgccggatccagtgcacggcgtccagcagttgatccttttgcaaaggagagcccagccaagcaagcatccatcaggcaaggagaatccggaggccgccattaatggcggcaagaaggaggaggaggaagtataccttgtcccaggaggcctccgggtcgaagtacctggcgagcttggagtgtccggcgccgccgttctgctgcgcctgcgcgcgcgactgcttcgacggcttcgtcttcctcatctcgctcggcggcggcggcggcggcggcggagatgggatcgcgagggagcagtcaacaagtctatggatggagctggtttggttggtggcgattttgcagatgcctccttggaaagtttggatattgcatttacgtccctactagtgatggtcggctaatgattggtccatcattaacatgtcatctcattacgtgcaaacatagaaaaataagagtaaattttataaagctgtaactttagtgacaaaactatcagtttgctgcaacaatagcgtcggaaattatcacaaagctgtaacttttacgttatattgtcacctatatgtactatagcagcatataaggtaaaagttacagttttgtnataatttcccacgctattgttgcagctaattgaagcatgtcactaatgttgtagcaaactgatacggagtagttttgttactaaagttatagttttctgaaatttactctagaaataaaaataaaaagctctttatcaaagcctaatttcgagcatgagaattattccagattacaaaattacagagtttcaatgaattttctactatggatcattggagagcaagccgagaggacacatctttcacaaaatcagtgggcgaaattacagcagttcacctcttaaaaaaaagagagagaaaatcccataataacactataacagttcagtacattggatagaagtacaccatgagatcactgctcgctaaacaagcgattcatttgataagggaagtactaacacacaacgccatcaagtacaagatctgacaagataatttgaatcatacatacaaccggcaatgagttccctgacagttgatgaattatttgaagatattactttagttactttcttggatctacaatgcttgatcagttaaagagccagtctgctcaggtgacaacaaattgcctcagctgacaactcacctgattccctgcaggaacaatgtgaaaattgtcaagattcattatccgcctttcactgtgattagtagtatcacttatcattcatgcatagaatgcaaaaaaataaataaataaataaataaataaataaaatcacatatccatgttgttgtctgccttgaaatatgatacatcatgcacataaatttggaatgctcgaaatgttatggataggataatggcccgaaaagaacttccaataagcatggtgcaaaattcagtgacagttgttcatctaaggaattcatatgtaagattgcagattgcaattcttcctgacagggtactaacccagtagtaaaaaccatccttgactagcctaaaaggtgtaaacctcaatgatcattcgtaccaagttttgaatcgcctgaatgcaaagttcacaagagcctaggaaggaaccagcaaagccctattaggctattactactaaaaactcaacttgtgcaaaagagcaaatgtgcatcaaagcaaaagggcatattgcctccatgaatatgcataatcaaaatggttctcccactcagctataacatctgtgggaagtgagtagaacattctaaactgacacttgagcctcactgctattttggctcctcaaaatataatcagaaactggaaacaaattttaggagaagagatggttaccacaaaatgtggggagcgccgcacaatagataccgcagaaccaggagatgctgctgatagggcagcagctcctcttttagaaggtagattccgccccttgttcttactctgagaaagactcttatcaagaacattttcagttctagagtcaagtggcattaacattggaggtgaaactggtatagaggaagcatctggacaaacaactgaactcatgagaagacctcctgcggaaatcagttgcacgagttagattacaaccaaaaaaaaggaagcctgtgtgcataaatatgggagcaaacaaaggatcggtactatgagaaaagggaggatgagaagtcatgaagggagagaaaactagtcatgtctacagtgcacattatggccagttgcacggcaatgcagctggagctgagtacacagcggcttggaggagagtcgtaattttccgtgagatggctgttaagtgttaacagggaagcttatgggtaatgcttaggagtagatcaattacatagcatatttatgtggttccagtacttgatggcaatcatggcatatctgtagtttggtaattagatcaatctgctaaggatatggcatatttaaaaaggctattgtgccacttgggttgaggacacctcagttaggactaaaggccctatcccctaatccctaccatgttcattgcaacgacaattcatactgacagttaatgttcagtaccattcacagtagcagcctcagcctggaacctttctctgacgattcttacaaacttgaacagatcgttagtgaggttcaaatccttcatcaactcttcagaatcttttatacttggatcacattgaagtactgttgttaggaaaaaaaaagataatgtcaagtacagctcaaaaaatcaagcattcaagacacttggccaagtttcatgaggaacttcaactcacagttatatcgatctttggcaagctttaaggtaaccgagtactccttatcagggctttgcaagtctattttgttgaagatgaactttacaccttgaggaagaacagggcaaatgccatgaaagatggaattggcataatttaggggcgattccttatattcctcagtaaagttcacttcatcccctatgtgccactgttgtcccaatgacatgtgggctttaaacccacgagtcagtgagctgataagtggcatataaaggataagatgaaatttaaaaggcataaggaatttatcccataatttacttgaacattgagctgattcatcactcaccttctcctccaacaacctggaaaccaaggaacttgctgtaccagattacagcttcttctattttcttcatccgtgtttcatcctcaataaactttgcttcaagagcttcaacagctgccacagtacatgaagtatatcactatcgtatgaacactatatgtgcacagttcaagaaagacattttctaagactagcaatataatgttttgaaaaaccttaaataagccacagcaacaaaaaaaaaaaacccaaaacatagccctaaaatgataggtaagttaccctcgaggtgattcgatatgactgcagcatggtgatctctcttgttccgctgatctgtaaccatgccctcaagcttctcatttatagccgcagtgcttgaaatcgtctctttggtaagttggtactttgactccttgccggccttaactgtaaatacagtttacaccaagatttcaggcataccatgaaccatttggcagcgaagtgcagtttaatttaccagacaatgcttctgcaagaccatcttccaaattccgcaactgaaggttgagtccactcagttcctctgcaccatccaaaatgttatgaaaataaatgcacaacagaaacacaaattttatcgtcgaacacccttacaggaaaaagaccatggacaccgactggcaatgatcaatgatcactattgaggtgctaaaaacgcaggggataacaaggcggacaaccccttcccatatggcttacaagggatatataaaggagaaatgtaggagccctaacagataaaagattagaagtctactaggaaactataagagaaaacgataatcctgtaatacaaagtcctattaggaaactcatcggaatgtattgctagctgaaattcagcaatatttaacacaaaaatttcagcactcatcggaggggaaaccgggtagagttacttcaattcactcaaattcaattcacattcagtaccaagtaccaaccacattttccaaataaaataaaatcgaagatacatcagacacgcgtccaaagttcatttcgcacaaaaaaaaatggggggtgtttattgaaacgagagagattgagggggtggggggagggattaggggagggcgttgccttggcgggagatggtttgacgggcgatggagcgggaggagagaagcgcggcgcggtagttggcggaggtggaagcttggcgctccctttcgacggccatcccgcgctggtacgccgccagctgcgccgccatctgccggcacagctccgcccctcctcctcctcctcgtgtgccggcggcggtgcctccggcttccatgctaccaactccctgggcactggcggcgtccggcgtcggcggcggagggatcggcggcagccgacggtggccggagtgcgggttgaagtgaggagttcgaacccaaaatttgtgagaagaaatttctcctttttggtctgagaaagaagaagaagacaaagcgggatccattccattgtgtgggcctttttgtgaagcgtattgggcctcatattgggcttaggcccagatcatcttgaagaagagctgtgcttttacccattttgaaggctaaatttgaccatattttctccactttactcatttgactctacatttcaaaaatgaagttattgtcttatcctattctctgaagcaagttaacggtgttgagactagagctcaaggtcaaaatgtcatttatgcccttgcttatttgacactactttctcacaggttctgttcatttggttcaattttgtgcccttactgtgtagtataaaatttgtaatgaaatgacatatctctggcagtttaactgaatttgacatatccgtgacaaagttgacttagatgtcacaaaatctgtgaaatctaagtgaaacaaaacctattatattgttaaacgaatagaaaaaagagcctccacgttcgctctcatggcctagaaattctcacattaatcggagaaaaagaaaaagcagagtccatatagaaatacaatttagaaatagttgaaattcagaattaaaaaataagaaatattagaataggagactagagtccatatagaaatacaatgttgaaatagttgaaattcggaattaaaaaataaggaatattagaagaggagaatagagtccatatagaaatacaattaggaaataactgaaattcgaaattaaaaataagaaatattagaagtagagtatagagtccatatagaaacacaattaggaaataatagaaatttagaattaaaaataaggaatattagaaatagagtataggtccatatagaaatacaattaagaaaaaaaaagaaattcggaattaaaaaataaggaatattagaagtatagtatagagtccatataggaatttaaaactaactaaaatttagaataaacataataaaattaaaagtagagtttagagtccgtataaaaatacaatttacaaataactaaaattcgaaattaagaaaaacatgggaagataagtttaaagtcaatataggaatacaatttagaagtaactgaaattcaaaattaaaaattaaataatattgaaagatgagtttagagtccacatagaaatacaattagaaataataaaaattaagaatattggaagaagaggatagagtctatatagaaatacaatttacaaaaaattcggaattaaaaaaaagaaatattaaaagacgagtatagagtccctataggaatatatataatttacaaataactaaaatttgatattaaaaataattaataactaacacatatataaaatacaatatgaatattacacattagtaattttgtaaagttattgcaaaatttaaaattatgttgtcattttaatatatttgaataatataatgacaaaacatatatgttattatatgagagaaaatataatgatgcaagccgcgcaaaattgcgcgggccaccatgctagttaaaaagaaaaacaaaacctttgagaaattagcagttccaaaaaaaaaatccaactgaagctggatgtatgacataggatcgcccaataccggaaagatggaaaggcacaaaattaacaaattctgctaaagaataccaacaaaacaaccacaagtcgtagagcgaagcgatgcgagggatgatttccagtcggccacaagatcgatcaaaacctgtgatgactgacgagacaaaaatgaaagaaacacagccaattcatcatcatcgaagaagaagaaaatggataagatcgtgtggtgcagagtgcgcgggagatacaagtgcggaagcaatcgcagccacagccattttttgtgtacacgtagacgtctcctcctctttcttctccatctccacgttttttgttttatttatactactccctgttttttagttttatttatattactccctgtattttagtattttaatgtataacgccgttgactttttaatcaacgtttgaccattcattttatttaaaaatgttatgtaaatataaaaatatttatgttatgcttaaagaatatttgatgatgaatcaaatcacaataaaataaatggtaataatataaattttttaaataagatgaatagtcaaacgatggataaaaaatcaacggcgacgtcgtgcattaaaatatgatatgaaggtagtatttaatttgcttttgtttcctccaagcaaccaccacctccactgcgccggcgtcactaccgaccgccgttgagtcgtcgtcgtaaatatcccacctctcctctccggggcagccacacgcccctacctccaagcttggagagactggagccatggctactgccgccccgccggcggcttccggtgcccgacgcctcggccggccgcgggcggggctgcgcgtcggggcagtggcggcggcggagggcccgtcgtgcctgtacgtggggcccatcgagacggccagccaggagatgctcgaggcgctctaccatcaggttccttcacttgcttgctgcttatcctcttatttcctgctcaatcattttcttatactgccaataaattcaccccctatacgtgttatcttgcttgatgttgtaacagtccccaaatgcttatcccttaatgcatagaaatgttggaatataaagtgaattgtccgtctttcctcatcagcaacacaataagaagtaatcaccatcttgttgttttttctctattgctgttttgataggccagggattcctactacagcggccagcctttgattgtcgatgacatgttcgacaaagttgaggtataattcttctaatcttttctctatctatatattcagcatatatgtactcactactcagctcagctaatatgattcaacatgtaaggctttaagatgtgtaacaaattgtatatccatgcccagttgaagctccgggtttatggatccccatccgtagtgaagtatccccgttgcagcctcaagaggcaatcgacgtacgcagacgctgaggttaccttttgggagggaaacaaattcagtatctctacatttgatctcacgactctggcaatactttcgacttacagtccgatgtttcgattggcttttgggtgtagggcaggaggacaaatcaatgttcatggcactctcaagcatctggatgctgctgctcttgtttggcacatcggcatttctcgttccctctctctgtattctaagcctcacttttggggatgcattcggagcaaggtatctcttgtatggtgcaaaatcgtttgatgtgataactagggtaaatgacatggttttaatcggattgggctatctgattggttatccgatttcatctgcatctggtaagggaacttctttgtaaatattccgcggtacaaggatttcgtgttccctgatatgccatgttggccacatggtacaatttttatgcgttgattaatcatcttcttatttttgttctttcagttggtgcactgcaaggcttgctgacaaacaatttggttgcactaaaaggttcttgcccaaattgcggtgagcaggtcagcttccttctacaagtagccaatttgaatgtttatccatatttcatgaagttcatcttttcggtcatctaaagtgtaacctgttcctgccaggtctttgcatttgtcaagacggataattccatcaaagctccccatagagcagaatgtcatgtctgcagctgcccactggagtaccgcactaaagttgaggtatgccaaaaacaacaatgaagaacaaatagctgaatgaaaatgtctatgacagtaaatggcttggtttcagagtgccatatggtataggagagggtgatcattttagattttggtgcatgctgtatgtgtagtttgtgactctaaagaaacaaaacggataatgtctactttcttgacattgttatccagaaatccttgtcgggaactagaagaacatgggtttatggcagagtttatcttgtgaagcaagggcatccaaggaagcggaaatggttgaaagactaaattgccagtgctagatgctgaagaaagtttagaggatgattttaagttatgtggctattctgaacttctgattgactgaaacatatttagagatgttgctcttactgctccaatgtgcttatttgtttctctgttcaaccaatgtatcttgtaaagtggtaaattccttggaaagattgccaaacatgaacaaatgttaaattgatgatgcagtattatgaataatggcgtgccttctcatatatttgttcattagaaatttatcttcatacatgaagtatgaatggcaaacagtggtctgttaagagcaagttcagtaggatcgaatttgttcactagatgttggacactaatagaaaatcatttatcctgttcgttcagcaaagttgcagataaaaaatgtcagacagaatcatattcttattgctttaaatcgcactaagcatactatatgtaaccaaatcatttcttttttctattcgaagagaacattcatccaaaactggtttcagaggggaagatctagaactcaaaaatatgatctggggcagcttgtagatttaaaaatcaggaaaaactggatctgggcacatctgttgcctcgaacaaaaatttcgcagcattagaactagatataaactgtacaatccacaatgcactgaactgaatgcatgcagatataggcgaccacatactttttacttcagacaagactctgactagaagctgcaaaaacaactaaaacaggcaagcaccaaggattcacaactctcctcttctttacaggtccctctaagagcctacactactcatctcaacagatctatatctgatcatatgatatatgattgttcacttaaaccagcctcgcatttgcgggcttccccttcgatgacggtttcgatccattgctgcctgcgttcttgctgctggacttcttctgcagctgaggatttgcccctgtctccttggaatcctggagctgttctaatacagcaacaacctgctccatgttaggcctgttcttggcctccacagagatgcattgaagtgccagtgttgcagccttctgggccttggcaagggagtactgcccgcccaaccgggcgtccaggatgcggaagatgcgccgcttgctcatcaggtatggcctagcccactccaccagattgtgctccccggttgggcggttcttgtccagtgctcgtcgtcctgatagcatctctagcagcacaactccaaagctatagacgtcgctcttggtggtcagatggccttcacaacatacagagaaatgtgtcagttaattcaataatagccaaatcactctatgtttggcacccagatgccagcaagggaaccatagattgacagtaaacacgatgtgtaatgaagctcaaatctttgtcgtgcatgttcattcattgtgatgaaatgattacattctaggattcagaacatggaagtaatatgctacctgttgcaaggtattctggtgcagcatatccataagtccccatcacccttgtggagacatggctcttgtcaccagtcggtccatcctttgccagcccaaaatcagagagctttgcatcatagttctgaaaatacagtctgtctatcagatcaccagttaagctatcttgtgaacacaaaggataatagttctgaggactccgtaccgcatccaaaaggacattagaggtcttgaaatcacggtagatgactttaaccttgtcactgtggagaaatgcgagcccttttgctgctccaagggcaattttcatccgaaggttccaggagagcggctgaaaatgcgtactccctgcattttacaacacattttagcatgttgtattccaaattgtaaatcagaagctagcaactaggaaagtacaaaaaaaaactacttactcctgaaaagatgattttccaagctaccacgtggcatgaactcataaacaagaagacgctgctcatcttcgacgcagtacccaacgagccttacaagatatgggtgtgacaactgtccaagataattcacttcagcctgcacaaattgaaaggaagataatgtcatacacagtgcaaacttgacaggaaagaatcagccagtgggtactaaccagccattccctgtgaccctggtggccttcctgattcaacttctttacagcaatgaccatccctgtgcctggcttagttggtgcgagcgtcttctcatcgatccaccctttgaagactgatccaaagcctccctcaccaagcacactgtctggccggaagtttctggtggcagtcctcagctcattgaaggcaaaggccttgacatttgctgcctccaggatctcatcctcgctccgtggtgttggcggcaccgaggctgcagacacactggagttgctagcatacttggatgtcccccctaaacaacagaagacagtacaaattttcaggccgtggtccattagattttagcctgatcaagttgttgtttctttgcttggtttgggtattaaaaggcaaaaacttcacagataagttaagaggttgcaccaaaagtattgaactttctgcataatacagtcaataacattgaaaaaaaagcacgcagattttggtagaaagtagcaccaaaattagaattttccacttagcctgatttgagcttctgcacttggaacgaacaaatactagcaacaaaggaaaagtcagataaagttatatgtgcgtttccattggaagcttcctttcctactcctagtctggagaaggagaagaattgagctttacgcatgaaacaaatccaagaagagctcaaactagaacttatacgcacgcactaccagtgctaggagacaaggcatgtgattggtgaccctaaacagcctgtaggaagccatta

SEQ ID NO: 60519 - DNA, 26596 bp, Oryza sativa
atctcttactcgaccctgtccaagtttagacacgacgacaatatactgtatatggcatgtgcaggactatatttacacattgatcgttttctcgacaaaacaaatataatgtgattatctgcacttggctctgtatgtaagtcctactatctccaactcgttttccgtccgcacgcttcacaaactgctaaacggcgtattttttaaaaaaagtttctatacgaaagttgtttacaaaataatattgatccattttttaaaaaataaatagataatacttaattaatcacgtgctaatgaatcgttccgttttccgtgcccaaaagatcagcctatcaagcccgcagtctgcgtccatcagatttcaactttgcaaggcccaccaacccggccacaggcagaccgcactcctgctgccctgcggccatatcttctttctcggcccatgacctgcacctacgttcggtccacagaaaaattggaggttagcccacgtacgaaccgaccgaagcgcgcaccggcggcatcggcgcgcgaagaccgtgcgcgatcagctccacgccacgatccacgggacgggagcgcgcgcgtcgccgtcgccccttcttcctggacccgttcctcggtcgccgcgcgtcccgttccacctctcgacgtacgcacggccaccgcacggcgccgcgctgaacaggccctttttcttttcgtttttaacaagggaaacaaggcgttcaatgctacttcaatgtgtgtgtgcccggccgggacagcgatgtggccgagtggcctgccgctcggaaaaaaattctctgcggcagtgccgcacaggaccgcctgtgcaacaccacgcgcgcgagtgacccgtgtctgatctcttgctgcagcagcccgagacaatcttcagatccgagcctatctcctacacccatatctaaacaatttaccagaacgttccgtgattatcaaagcacgattaatccttaaatgtttcgtgatttctatgttaacaacatgtaatttctgatcccttttcaaactatgatttttatgtcatcaaattgtaatttccaaaccctttcactactagaaaaaaacattgttgcaaacggccgaaaacgatcttttcagatggaagccggtccgcctataggcaaaggcatgtgaaaatcaccgaacaaaataaatgatagttatgaaaaaattcaaataagatgagtggttaaatagggaaaatatgtcgtgatgacgtggacgaatctcatacgactattttttgatttaatggtagtttctaaatttccactaaatatgtagtgtccaaaagttaagggtgttatttattaaaaataaaagtatcttatatcaaaagaaccctgttaaaatcgatgagtctggctcggctcgaaagaacgtgctgtcgatggatatggctcggcgagattggctcggcgacgaagatggtcttagactgcagttggtgattggaccaccaatcgcttgcttgcttgcacgccaacgccaatgcgctggcacctggcatgggtatgcatcttgcgcgcccacgtacgctccatcatctctggattcatttccttctctctttttcttttcctgcttgcttctgtggttggaggaccatatactagtcgattcctcgcaacagataagaccccgtttcgtcgttactgtatttttggatttcctcttccatgcaattccatcgttcttccacgatcccatcgacatggatacataaatccgcgagatgccgagatattcttctgcgccaagcgcgcaggttattccaaccatgtcgctatcttccattcgtctccacgtccagaaacgcaccaatctcatgagccattttctcctccctgagttgaccgttccagttagtttaacaccttaacttccattagctgatagtaatatactagtagtactcactccgtcgcaaaaaaaaaaaaaagacaaaccctaatttccgtgtccaacgtttgactgtccgtcttattaaaaaaattataaaaaaaattaaaaagataagtcacgcataaaatattaatcatgttttatcatctaacaacaatgaaagtactaattataaaaaaattatataagatagacagtgaaacgttggcatgaaaatttagggcttgtctttttttttttttttggacggagggagtacgtagtagtagcttctatcatcaacgacaaatctcccgttgtcttgtcttctcttcgcaccctaagatttccacgtcgtcgatgccttttcgttgttcgcgtcgggttcaccagctaggtggttcgccatgaagtacaggaagggggtcgccggcgagtccaacgatgacgacggctcgacgaaacgaggtcgtgacgctacaccgagcatccaggtggagatcgctgagtaccatggaggcggcggcggcggaggaggtcttggcaacgggggcggtggctcggcgtcgttcttcgagccgtggcgggaggccacgccgggaagcgggagcggacacgggagctcgggcaggggcggcggcgggcgcgagccgccggagaagcggctcacgctgttctccctccgcctcgccgtgctcgagaaggcggcgagcgggctcgggatgctcgacttcatgtgggcgacggtggtgctcctcggcggcttcgccagcgcgctcaaaatcaccgacttctggtgcgtcaccgtcatcctcgtcggcgagggcgcgcgcgtcttcggccgcagccacgagctggagtggcagcaccactccacgctcacctccaccgccggcagcgcgctgcgctccagctcacggctcttccgccgcctcgtgcacgcgctcgacgacccggccgccgccaccgtcaccggcggcgctcgcggccaggacgcgcgcgacagggcggcgcagttccagcgacagatcgtcgccttcatgaagcagcgcgcctggcacgcacccgacgtgtcgctgctcccttacaccggctgggtcttcgtctccaagaagatcgggaggctcctcaactggctgcaggtgctctccgccttcacctgcgtcgcgctctccgtgatgcggctatggcggcatgatttcggcgacgagcccaacaagcggccggcgctgctgctcttctacacgttggcgttgatcgaggcgctcctcttcctgctcgagaaggcgtactggacatggaagatctccgtgcggaagctgctcgagcaggtgagccgcgagtgcgagctcggtgcgtatggccacgtctcgctcacgcgcttcttctacgacgcctactcgcgctgcatcaacgggagcatcttcgacggcatcaagatggacctcgtcaccttcgccgaggagctcatcctgtccgagttcctagacgagcagctcatcggcgtgcgcatcctgcagcagttcgccgacgccaagggctccgcgcgcgacacgctgcgcaaggtcggcacgagcgcgcgctccatcgagcggctcgtcgagatgctcaactggaagcggcccgaggaggaggaggtgcgctggtgcgcggcccaggtggtgtccaagctcgccggcaagcgccagaacgcgctccgcgtgtcgggcatccccggcgccatcgagtccgtcatgtccctgctctacgccggctggagcgcgcccgtgtcggcgacgccgcacgacgtctcgccggcggcgcggaggagctacgaccacccgcagttcaaccttctcggcctgctcatcctcaagaggctcgccagggaccacgacaactgcggcaagatcggcaacacgcgtggcctcctcgccaagatcatcgagttcacgcacgcgtcgccggctctgctccgcaacacgctggcgccggagtcgcaggtgcgcgccgtgaagctcgcgctgaaggtcgtcaagattctggtgtccacgacgggcagcaccggcaagatgctccggcggggggtcgccgagaacgtgttcacggtgagcagcctgcgcgtcgtcctgcagcacgggcagcagcacagggctctgcagaagctggccacggacatcctgtcgggcctggccatggacgacaagggcaagcaggtgatcgtgggcaccggcggggtggtcaagcagctcctatcgatattcgtggatgccgagacagagctcggcggcgaggccggcgaggcgctggcgatgctggcgctggagagcgaggcgagctgcgcggcgatcctcaaacgggacgacgtgctcgaccacctcgtgtcggcgctcgagggcgacggcggggcgcgtcgtctgaacgcggcgagggtgctgcgcaacctgtgcgcgtacgccggcgagaagcatcgaccgcgcctctccgcggtgatcaaagcgatgcctgtggtatgcgtcttatccttacaagatgaaaatgttagttatcacactctgcttctacttgacgcctcccgcgtgaccgcgtcccagacaattacgttttggatatcgatgcattgtttttaaatctgacttaattacattgcgaaaataattaagatttttcatattactatctccaattctccattctaaaaagggatttttgtagaagctttgttgagtcgtgagaccgtgtcaccgtgatgacttttttgctgacatgcacaattggtttgatggtttaggtactgaaggccaccatgaccggcagcgacaagatcctcgaggtgtccgtcggcctgacgacgcagatctgcaagttcatcgacggcgatcggttcgccgacgagctgcgcggcgccggcatcgacgagagagcctacgtggagcggctggcgagcatcctgcgggagcacaggtacccggtgatcagggtgccacggatgcggcggttcatcgtgcagcaggtcatctggctcatgacctcgtcctcctccgccgatggcggcggcggcggcggcggcggcgcgaactacgtatcgcttctccgggaggccgggatggagcggctgctggagtccatcgccgacaccacgtcggagctggagtgctaccacgtgttctccggcagcgtgggcatcagcaagcaccgggagagcttctcggctgccgtcgacgccgcgctggagctgctcggcggcgatggccggagctcgagctgagtgatgagaaattgcccgggatctgctgtctttattcctgcactaacacagatcctttttcttcttgtttattttttttaaaaaaatatttttcttagtaaaagatagcttatcctaaacgtgatgcctctcgtaggtgattcagttcataattttgtacagaacgaaccaatgaacgacagcagctgagcagcaagtacactggtctgacctttcacttttgtaggagtatgaacttatacaatgtactacctcaatttgttacagttgtaactattatacaagatataaacaccatctgatagtaagattcattgagatacattggttaaatacagagtcattcactcattgccgtctacttttctttgaatgcatgtttcaagtttggaacgccaaaataatcacatgatattgaatcgtttcgctggtactcattcatcatcgaaaaaatccaacgtcccacatcatttctgtggaattcaacgtttctgaccgcctccacatcgcctcctcccatccggccagatcgccgtaattttccatcccctctcgcacagcgcccgaatctcctctccctccctctcaatcgacgccatcgatcgatctccgtggcctcgtggtcgtgttgaggcggccatgctgcccataggtgccaccgacaaatcgccgtcctgccgcctaagcacagtccctattggactctcgttgcgccggtgatccgatgggggcttgtgcttgccagttgccacgcggatcaatgagttcgagcaatgtgctcatgtgcggaatgagaggagagaccccattcttggagttcgctcatgtttatatagaggttgacataaggagaaatctctcttttgccccttggttacacaatcctagcaaggtttttttttaaaaaaaaaatacaagcatattccatgggtatattctccaagtatattctttcgacattttccgtagggcttaaagcctattatcgacaaccttgagaaaaggtatttttccatagggtttatagcatatttcccgacacccttggagataaggatgcctatgcgccaacaactccctcatcagtgatgtccctagagtctacgggtgcgatgttgatgctatatggtgtcagccttgatctctggggagtaggggaggtgggggaggggggggttctttttggtgatcttcaaggcgagtgacgttgactaaactgttgatccgattctatgtagttggcgtagtaaagtcttgctgctcttgtcttggcattgtcttaacatggaaattacagatgttatatcttacccatgtcttgatgttctacccaacttgtcgagctttgctcatcttgtcgggcttcaccaaacattttagcctttcacttcatgttggccttcacccattttcagtcaatgcctaacatgttaggttttgacgaacatatccagcttcaccgatcaagttgactttctcccattttcggccttcgtccaatatgccgggcttcgctgatcatgcgggcttttgcccatgttcgatcttcatcgatcatgtcgtatttgcacatggtctcttcgtcgaacatcttgggcttcaccgatcatgttgcttcacccatgttcggtgattgctcaacttgttggtcttcactaatcaagtcagcatttgccaatgtttggtctttgtctaacctgttgggcttcgccaatattcagtcttcgccccaacttgttgggcttcgccgaacattttagatggtctctactatctaagtcaaagactccttagtcttctcaatgttgaaaaagaaggtttcgaacacatgtctcacttcgttaatcacgttgatcttttcccatgtttggtcttaattgaacatttccggcatcatcgagcatgtcaccttcgctaaacatatcgggattcggtgccaataatgtcactttgcccatgtttggtttttacccaacttattgggctttgctgaacattttaggcttcattggtcatgtcggccttcacccatgttcggttttcaccaaacatttaggatggtatctaactatctaagtgaagattcccttggtcttttccatgttggagaagagagttttgaatatatgtctcacttcgtcgatcatgtcgaccatcgtcaatgtttggtctaagctaaacatttcgggcatcaccgatcatgtctccttcgccaatattctctcttcgccaatcatgcatgtcgcttcacttatgtttggtcttagccgaatatttcgggtttcgccgatcatgtcacttcacccatattcggtcttcacctatgtccgctctttgctgcacatttcgggttttgtcgatcatgtcggccattgcgaatgtttggtcattgctcaacttatcgggcttcgccgaacaaattaggcttcgccaatcatgttggccttcactcatgttcgctcttcgccgaacatctcggccttcaccaatgtttggtctttgcagaacttgccgtgcttcgccgaacattttagactttgccaatcatgtcggccttcgcccatgttcaggttgacgtggcagctcatgctaatggtgctgtcgtcggtggtgcttctcatcatcccggcgttcatgtacggctgcatcattgttggctttgctcgtcggttcaggtagcagtacacccacaccagtgccatcaccgagcatgccgtgttgtttgtgcatacggtgtactcaattgtggtggagtagatcaccatggctcaattctcagcggtgctagaagagtcggcatggctcgggctcaagcaggggcttgccaagggcgttagcatcaacagcaatggcatcacctttaccatctttgctttcaacatttcgggattcactgattatgtcggcctttgccaatgtttggtcttcgcccaagttgtcgggcttcgccgatgtttgctcttctgcctaacatgttgggcttcgccgaacatttcagaattcactgatcatgtcggccttcgcccatgcccgttctttgacaaatatttcgggcttttccaattatatatgtcagcctatgccaatggtcggtcttcgccaaacattttggactttgttgatcatgtcaattcgcctatgttcagtcttcgccaagtattttgggcttcgtcgaacatttcggatggtctctaactatcaagtcaaagactccctttgtcaaatatcacaacaaagcatcgtggacaaaacgattatagctcagctataaacttttatatttgtcaatttaattatttagtggtgattacattcggtactaaaataaatttaaatgacatcaatatttatatatagctaaaatggtaaaaagaataccacttttacattaacgattctcaaatggatttgctaaaaaatgtcgacatttttttttgcttgggaactgtcgatttgtgatttgtatttcgtcagatcaacatcaagatttgtgcaaacaaatagtaaaaaattgaaggcacgcggaagaatggggaaccaaccaagaagaagtgatgttgtgatcaaggggaacatatcgtacacaagcttctcgtgcacactccgatccatacacaccaactagcaaatatcacagaaaattctataaaaaagttacacatacttttaatagtattacatctacgtgtgaaatcttatcttcaaattcattataatttagccgtaactagaagaaaaaattctgacagatttttacacttaaaactatcggatttttcacttctttttattacggctaaaatataatgaatttgaatacgatactttgcatatatgtgtaataccactaattaggagtaaatgttcaaatttttcgtagaattttatgtgacattttttagttggtgtgcacggagtgtacacgggaagcttgtgtgcataaaatatgttcccgtgatcaagtatgtatttaggtacatgctccttttacatagtagttacagtaaaattatagtaaattatagtatagttagatttgaatgttttttaacaaaacactatcgaaagttatatggctaatcgaacggaattgctaaagcaatatcgacggttctttcggctgatctgtgtcggtttcactggccatccgacgacagattgaaatatatctttacaatcttcaataaaataaattaaatctcaaattaatttctaaattcttgaacaaatttaaattttaagtgtataaagagtttataagctatatacagccattctacaatccgatggaggaagctgtctttagctatatggataactaaggcaaaattacaaatggctagagtcgtttttttttaatttcattaagtacgaattaccccattgaactatcacgacaatatgaattacccccctaactataaaaccgcacatttgacaccctaaactattaaaaccggacaaatttcccccttggcacaatccatagttgttttgatcctacatggcatacacgtgacgccaacgtggcaatctaattagaaaaaataataaagtaacaatgggcccacttgtcatatactcctacctcacccctctctctctttttttcttttctctgccgctgggggcgcggcgggcacggcgaggaggacgtgcggtggctggagggcattgcggaggcgtcgcacggtggtcgccacgtctacggcgggtgcggaggcagacttttgcagcgatgagggacaccacggtgacacaccattcctccctttcccctctccttctcttccaactccctcccctttcctgcagtgcggcggcagcggaggcagtccaggcggagaagaagaaggcggcggtggtggtggttcggatggagaaggaggtggcgacaatggtggttcagacagagaaggcggtagcgacagcggtggtttagacggataaaaccgtggcggggagagtggggagggcccgaccattgctgtcaccttcacccgagctctctgccactagggggcacagcagtcgcggcgaggaggaaggggaatgggcaagaaggcaaccgcgtgaaggggaatcgatgcctccgccgccaccagctgctcagtccgccaccacctccgcaatcggcctcctgagctcgtgcgcgtgcgagagagagagagagagcgtgcgccggagttgtgtcgtgcgccaggtcccgcctccgcctgcatcgcggccacctggtatgcctccgcctatggcaccggccgcctgagcgagctcggcctcaacactgtcacatcctgatttttgtttcaggatttataaattatttaataaattaataatagaatttatattaaatgatctttaatttacaagtgaagttaaatgtgggaaataaaatttcctaaatataaagcatggatggatttaatttttattaaattctccatgattaagtcaactctctgaaatattctcggatttttcggagctcaattcttaaatgatacaaagaacagttcagtaattatttgatcaataatgatctaattatatttgttaagagcttttcttgtttaaaaatccttaaattataaattgttgtttaaaaggaattattagaaatgatcttaaaagcctaaaagagaagatctaattttaatttgttaaatctcaatataaaattgggctagataaaattttgttaaatactttgcttaattctataattcctagatttttctgggatttatttgagctaaggaagtatttttaataaatggaattgcatttaagaaataatttaaattgaaaaaggtttttaaaagtcttcttttggctttgggccgaaagccggcccaaaaccctctctctctctttccctcggcccagtccggcccaatccgccgagccgccgctctcctctctctctcagccgctgacaggtggggcccgtttgtcaggcctgtcttcctcctcgcgccgccgccgccgcccgaaaccctagcgcaagccgccgccgtctccttccaaattcggtcgatcctttccttctccggccgaattgattgaggggaaacgatctccgggatctcctccaccttttcccctttggaaacatcggctaaatcggcttggaaagtgtttgattcgaggtcgaatcggatcggctattctctctccgagcccgatctttccttctcgtcgccggtcgccgtgggccttcgccgccaccttccaacccctatataaggatccccgagctctcctctacccgctgcctccctcgccttcgcctctcgccgtcggaagcgctctagcgccgtgagacctcgcgccgccgtcgtcgccgccgctccagccgtccttcgccgccgttccggtcgtcgccgtcgctcggggaggccgccatcgtggtcgccaagtcgccgccgtcctcgtccgccccttcgccgtcgccgaagatcgccggagcaccgtcgccgccgtcgacccgatctccgccgccgcttcttcctcgtcgccggcgccgtccgttgctcttccgccgtggttttggtcaccggtgagttcgccgcgtcgccctctacccgttggtgccctccgttcgtgccgaagcgccgccgttcgccggtgagcgtgcgccgtccgagccgccgagccgccgccgccggtggtgacgtcatcgctgacgtcatcgggaccgtccgtcgcgagccggtcgtggaccgtccgatctcggccgtccgttttggatagggttgatctcggccgtccgttcccgtgaaccgccgccgtgcgcccggtccaccgcaaaccctagccgctgacgcaataatcctccttttccttttcaaaaataattcattattgcgtcataattcaattaaaatccatataagtgttttaatccgatttaatctttaaaaattcataactaattcattgtaactcagtttaatgtggttcaagttgcaaaagttgtataaaataaagatctacatattaaaattgtccataaattgaattaaatttatttaattctttttaaatgggctttaattatatttaatcttgtaaaattcataataaattcatttgaagtcagaatgaggccgttcaagtctcataattcatctaaaatcatgatctacatgtttgtttactttttatgtattgtttatttggtttttattagtctttttcttcgttttacgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagtaatgtttttcgtgattagtctcacacctctcataattagttattgatgttttactggtaataatttgcttagctcctggtttggagttagatctgtacagccgggtatggttgttcaggatggttgggcctgtgcagcatgggtgtgctgttcagtgttgattaaaatttctgattaactactccactgttttatttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagtcgaagaaaaaggatccagaaggagaaaacgtttggcttataccccagttgagctgcctgtgggagtggagccggagcttcgctagattttattttccgctgcagttttcttcttagtgaggactaagtgcctcataagtaagtatttatcgttttagttaatttgatgaatctgtatattaaattgtcagtttatgtacctcggctgattcctggaccaggattttatgcacaaataagttcggaaattactagtgaatttccgggcgtgacaaacactcgccacccaggcgaactctgcctctgctgccgaccgcctggtccgccttcgcctctacagtcacttgcccgagcgcgtgcagggggggaggagagagagacccgagagggagagtcatgacaggtgggcctaggatttttttgtttgattagattggcacgttggcatcacgtgtacaagctcaagtcaaaaccgctcaaaacagtgtcgagggaggtaattcatccagtattaaaagtttaggatgtgtaatgtctggttttcgggttcaagagggtaattcgaacaaccgcgccatagttcaggggggtacttcgtacttttcctttcattaaatcccacttattattgtataagctacatggaaccatatgtattttatcatgtgacacataaacctaggtattatgaccctaaagtttcacaaaacaacaccgttaaccattttaacatagtctgctatctcttccctttccatgcctttgattcatcccggattgtgttgatgtgcacatgaacaaaagtgcacattcctatccgctcttcattcaggcccggtccgcccatctgctgctaggtctaagaatggaatttaagacgtgattctagaactcaaaagtgtagtagataatatagttttgtgatgcgttaggaccttaatacccaggattatgtgacacttaccaaaattcatgtggttcatgaaacttagaccataggtgaggttcaataaactttactctctctctctctctctctcttttaatctcagctgactcatacgctgtcggattcatggacagtgcactacatacagggagtcatagaaggtatagtagagatactggtggatttgctccatcttatctgtaattaagatacacacatgcatattaatttattacacatacatgcaaacgttacacgattttacccacgtactagtatatagtactcactctatttcataatataaaattttttagcattgttcatattcatatatgttaatgaatctagaaatacattaacatctatataaatgtaaacaatgctaaaaagtcttatattataaaacggagaaagtatatgtgtacgtatgtgcatatgcttgctgtatatctaatcaaacagctgggaggggtttgcgaggaagaagttggtgacgaggtctttgatgtcggcgccgaaggtgtacccgtccctgccaccgagatagatcacctccagcatcctcgtcaggttcaccaccagccgcgccgccgggagcagatgatcagcccgaccacccatctccacgcactcccggttgatcgtcctccacgcgcgctccgccatcgcggcaaccgccgccacggcctcctccccgcccacgccgcgctccgccatgtagcactccaccgtgctcgccatgtccctgccgctcctcccggtcctgtaggaggcgacgtcgttgaggaagcgggctagctccccgctggcgcgggccagggcggggacggcagccgcccacccgaacgcctccgcggtcgccgcgccgtcgccgtcgcgcacgcccaacagcaccaccggggccagctccgggaagccggaggacatgacagacacgtccagatgctcggcgaagctgggcatgtatttgtcgctcgaccattgggcctcacggaggtagtattccgacaactgcttgtactgtagcatgtatatataagacataaattatggtaggtgcaggagaaacaatcaaattaaattgtgtggatgaatatgatgatcgaacgtgcacgttgaatatgatgtgtcttcattttctgtgtaccaggattttaccccagttttggcgtaagacatgcggtacttctcggttggctccaagcaatcctctaactcttcaaagttgttcagtaactttatgtagaaggcatgaagatattcgggtagaatagagaccgcgctcttatcccatctacatacatacaaggataaactaatttagtgctctttgattaaataacaactagaccatcattaacttttatataagtacatcttttgttcttaaaaaaaattacaaattacctctgtatagctttgttgagcttgtggcactcctctaaggtggcgtgggcgtcgtaagtatcgtccatcaaagacatgagtccaaaaactttggtgaacatgatacgtgcgcgagagtactcctcctcgtggtatatgccgcacgtccagaagtagttctccacgatacggtctctagcataacttagcttcacgctattgtacaggtctttccaccagctgcgcatacatacatttgaactcatccaaaagctggtttgaactaattggtgaatttggcaattgaacatgcacttattagtcataatagattgacatagccaattggtgactactggagtacatccgttcgtagagcaaagctccggtactttttactagtagtatattaccatcaatagtattaagggtatatcagtaatttactaatacagtgattagaggtaactttatcatttatgttttttcttgggctagatcgatatgtggtcatccattgcattgggatcgctcatattccatcgaaaagtaaaaaagaaggaaaaaaattagtcactggtaaatgacaattttatccacatattgatgtccatccacatttccagtaccgcgatggtagtataaatagatctaaaccttcgatcaaatgaaatcaacgatttagattattttctattaccagtagaaagcatcgtagtggggctcctattcatattatatatatgtcgttttaactttttctttaatggagtatcaaactttcttaagtttaaatttatagaaaaatataaaaatattttttaaaaacaaacatataattaaaatacatcaaataccatttttaatggaaccgagggtatagtagatgttgttaattttttatatgatttataaaacttaagtaaatttgacaagtaaaataagacaaaacgacttataataaaaaaagactaaataaatagggagcaggtaagttaaagagtcaaagagggaaaaaaaagtgaggagaaacttacatggtgagggccttgagctccctgaggtggagagacctgacgagctcaaagtccagtttggctagctccagcgccacgccgtcgaaagctggttcgtgctcgtactcggcgatgtagcgtatcgtctctagctgcttgggcgcccgtggcagagggatgtcgaaggcgcgggagacctgctcggccatcgacgacttcagcttgccttccacggactgaattaggtggtgcctcgcgaacgcgatcgcgtcatccagcgcctcctcgccaggcatggccatgtgagccgcgttgtacaggcttagcaggcccctcgtgtcactgcttaggctcgctctgaaactgcctctattgtctctgaacttgtcgaatacatcttttttatttttttttcatgcgcggatagttcgtatcagtacaagaacccatatgtcctagttaacatatatatattgtgttctggagatacgtatgttggttaaaacatatgttaacccatatgtgaagaagtaaactctttaatattgtacctgcagttaccccaaagccgtgctggcgaagtagacggaatcggagggaagtaatgtggaggccgtcgtcggcggcggcggaagggcagtcctgttcctggcggtgtacgcggcgtaacatcgccgcgatctcgcgacggaagtggctgtctatgccgaggcgttcgagcgtgtcgactagcatcaccatgttggcgacactgctgccgctgctgctcgtggcctccaacagcttgcggcgaacttgctcctttagctgttccgctcgttctctcgtgcagtactgatcatcctctgatgatctcagctgcttgcttaataagtagtacgtcgttttaagttttggtttgtaacgttccaccgaccatgttagcttattcaaaagattataaaattattatttattttgtttgtgatttgttttattataaaaatacttataatttatcatttttttatatttacactaattttttaaataaaacaaatggttaaacattgcaagtaaaaagttaaaatgatatttaatttgagatggagggagtaatatgttgtcaaattactaattataagcctatgtattatgtatataaggaaataagtagagtaataatataattgtatatatgtgtactcatgttgtgtttaatcttcatgcctgtgaatcggaaggggtgtaggtgatgaagaagtcgccccacacggatggtgcaaaagcttggccggtggtagcagtggtaacctcgctcacagacatgttgccgatgagcgttttgtcagttacaaaacttgtcgacttttgcttgctaggtacttggatggtctaactacatctctcacggtctctatttatagacaaacaaccctctccttgtacagctattgaatcacctagctagcgaaccctagcgtatctatgcatgttgggtttgcagttctatgttaaaaagattataattactaattttatagcaagggatataagtacaaccttttttttttgttgcactacatttttgaagaatgctgcgatagcttgggctccctcacttcaccttaaatatacggattatctctggtgttggtctactagaaaaacgattttttatggtgttggtctatgattttcgctagtggaaaaatgccaaaaccgccagcaagatcgtaacgagggggtgaggggcaccgaccgccagtgaaaatggatcttcgctggcggccacgttataccgtccgccagcgaagatatgttcattttgtctggtggtcacttagatgcgccgccagcaaaaatggataattttcgctggcggttgggttaaatagttcggtagcgaagatacaattatttttgttggctgctcacttaagcaaccgccagccaaaatcgattttcgctggcgttcttaaaaaaaatccgcacataaaaaaaataaccgcccgcccatacccttatccacctaccaccaaaaataaccgcccgcccatacccttatccacctaccaccatagaataaaaatatttccaccaaattccagcaccctcctctcctcctcccctcctcccaggcggcgacggcggggttctcgggtggcggcggcggctccggcagctgtgcgtggtggcgacggcgacgggaggcggtcgtcggggggtgcggcgacagcaatgagaggagccgtcgggggggtcgactgcgacggggggcgtggcgagctccttctcctccccctccccctcccacgatggcttggtgctgcgacggtcacgacgacggctcgttgctacggggcgcagcgagctcctccccctcccctccccccctcttcctctcccagatctagccggaggggagggggcgacggcgaccgcggcggtgacggcaggcaggcggtggcggatctgacgacagggtcggcagcacgagagcaaccatgacgacgacgaccatgaccacggcgacaacgacgacgatgctgcgcgcgggccgggagcacgtatctggcggcttcttccctcccctccttctccctctcccagaggggaggtggcagcggcggccgtggcggcgacggcaggtgggcggcggtggcggatctgaccgcggcggcgacgatgacgccgctatcggcggctcgatgcgtgggcggcggatgtgatattcatgtttgctttgttgaatgcttgttgaaaatgtggtgaaaattgatgtattgttctctggatgtggatttgagtatggatctgatgccgatttgaattgattttgaatatggattgaaaaaaatgcagctgctcaggaggtcgattgctattttttttattggaaaaaaatcttttcactggcggtcctcttaaggatccgcctgcgaaaatagattttcgcaagtggttctcttaagggtccaccagcgaaaatctattttcgttggcggtcctcttaagagtccacctgcgaaaatagatttcacaagcggttctcttaagggtccgccagcgaaaatctattttcgtaagcggtcctcttaagcgtcccgcctgtgaaaaatcctattttcgcaagcggatcgcaaccgccagcgaaaatcttagatcttcactggcctttgccttgtggcggctccaaataccgccagcgaaaacctaaaatgaccgccacgaaaaatagttttcctagtaggcgcaatgtcagttatagaactatcttcccatataattggtatccactaagagatatcctctcttactataaagttataacccactaactgctaaagcttaacatgcaaagatgacacatcatcatccactaacaagatgacacatcataatctactaacaatcattaaagttaaacaccatacaaacatgctatattatctataaatttataatttatttaattttagagcttttaaaatgtaagcatgttaaatcatcatcgcacataattcacataatattttaatatatatctttattattttttataatatgctatgtatatgtatagttcatcctcactgactacttagttaatgttatttctcttttctcttagtgcttaaatgattaatctatgatccaaattttctttctcattttcttctctcaataattcatattatcatctcaattatttttattctttagatgattaatctacggtccaaactatctcaatactcttcttctttcatacagtcatatcaccttacttttatatttgaatcatcattctacatgctgttcaaatttaaattatcataaaccacgttaacttacgtaatctcatgttgtatatctattttacacattatttttacttattatcatactcaactgcaacgcgggatttcacctagtttacttctataaacacgcaagaaacataaccgtttgaatcgagaagcttctaatcgatctaattcaatcatttattagtcgtgaagaaagagcactgcaaattaaagaacatatatgctcgtgatatgtgttgcagcctgacgagacgcctggcctgaaactgctagaaaggaaccaaactgcaggcacacgagattagaaagtagaaactgatcagtgcggatattgtggcgaacccaaaacgaaaccaattgggatagccgcgcgattaaacatttgggatatataaccggtttttcttaggttgctcttaagttatatcatttactacatcggcttactgtcggttagctcacgggaataatttttctaatgataaaaatgaatttttcaaacggtttctgacacaaaggctagctccaaagtctgctagtgccacatatctgcttttccttttggctaacttgagcgggcacaggacattgtgtgttcttttcctcataatggaatggaataagaatatgcacgcttcacgatctcacaaacagtatgatctttgctaaaactttttatagaagaaattatatatgagtttcttagaaaactattttataagaaattaattgacttttatgaaataattatcataaatcaatcagttttttcacccaatcaattatccttccaaaaccttatcttagtgccattaccaagagctgtaaatatataaattttacaatgtaagatataaaatttaatgtgcaaatacatgttaaaagttgattttttttatgaaaatgtaccgtcataaatatagctttggtatgaccgaaacaaatctcatatgtacatacccaccaaattaatgtaaatagcttgcactaccccacaaaaataaattgttattaatagtgagttaagatttttctttattttagactgcttacacatctacatggttgatgctaaattaactcataaaactcaacatgcaagtgtgacacatcatcacccattagcaattattatatagagtattataaatcatatttaagtgtgtcacatcatcgtccactttattatctagggtattttaaatatgatacaaatatgacatatcatttgcaattttgttgtttttttaacttaatatgtaagcaatgttaaatcattatcactacatcattttcacattatttaaatatacttaatgtcccacattatttgtcagaaggatttgagcgtgatttccttatactatctatacaggtgatgctcactaactcataaaactcaacatgcaagtgtaccacatcatcgtccactagcaattattatctaaagtattttaaatatcatgttaacatgacatatcatttactattttgatgtatatttagagcttaacatgtaggtaatatcaaatcattatcgccacatcattttcatattatttaaatatatttaatgttcccacgtaagtcgtcagaaggacttgagtgtgatttccttatcttcaaagaacctatagtacacttgtaccctgataccatcttgttttcaaacaaccttagtacaatggtataaattatctgcagtatcatgagtcgtgtcatgagtcatgatcgtttgcgtacatggacagatgacgaccgtgatatctcatattccctccttcccataaaaaatcaacctagcatatgatgtgatacatcttgtatgtttagattcgaaatactagaatgagtatcacatgtggtattagattggtttttttataggacggggaagtatatttttgtgttccaatataattattgtttgataccaggaggcacagggtagttgttcttggacatgctgacatgcatattcaaggtcaactctctcggatgatgctcaattgcgccaaattttgcagaatgcgtctgtggaaatttctatattatatatcatggggaaaaaaagtacatttgacatgtctaaacttttttttaaaaaaaatcaatctaaccttttaaaaccggatacgactcttcaccctcttcgctgaactctaaactaaaacggggcaatttcataatgcttagcaaggatcattgaatctatccatacttatattaattaactagcactattgaagaaactatctttggtcgatcagccaaatttcacaataatcccgatcggccaaatttcacaatagtctcggttctaataaaaaccgggaataaaaaacatctttagcctcggtttaaaagctcaggggtacttttgatctttagtcccggttgataataccaaccgggaaaaaagatcggcatatgcggagatcgaggcgtgcgcgcggatcggatcgaggaggcatacgcacgcagtttctatctcctgctccctcgttctatctcctcctcctctcctcgctcaccctatctcttcctctccttctcctcccccctccccctcctccccacttctctggcaggcggcggcggtggcggccaggcggccgggtcggagggcagcacgactggcggcggccagccacacggagggcggcgctcggcgcctggcggaaggcggcagcctgcgcagtggcggccggttgtgcctctaccggattttggttgttttttttttgagaatttatgattcggatctgagatgtatttgatttgtgtgtgatgaattttgtagaacttgtgatgtaatttttttaagattttgtaatatatttggagatgatcgatttgagaatttggaggtgatgatcgatttaggattttacgattcggggataattgatttgggatttcacgatttggggataggggatggagtgaaattaatatattaaaaacaatgaagaaaagaaaaaaaaataaaggagtaaccgaacttagcctggctaaaatacctataattatgagttatgtgtcacgtgttaaaatacctatagttttgtgcgtttggagaatgataggtggggtttaatgaaatttaatctaagacaatactcaatttatttagcatatgattatacagtagacatatgtgtagcaattccctaagaaatatatagtctatactaagtatgcataacctaactttaccctacatgtggcaataatgcctccaccgagctgaccacgtcagggatggaggccttcctactcaaacgcttccaaggtcatcacacttcacacaccattgccgttgcacactcatatcacagtgacggaagacacatctaattaaatactcacgaagttcagctgcacatacctgtcgctcaatcattgtgtcctcaacgatagatgcatggctacacgatatttacggttcagggtttcatagtaaaaattatccgtgcattcagtagttatatatgggtttatggctgggttgggctttgggcatttgatggctgaactgattgtcattctaggccttcggctggtttgcctatccaagtccctcacagtgcttttgctctctctaatatagcaatagagtcaacaattggtgataggaaaaatacgtactatgtttctggaccggctacaaggtagaacccttgcagagttagcccccatattttttgagttaatcctaataagagcgaggaaagcaatgcactgtattgcaagctttggagcttgtttagttctcaactttttctttaaacttctaacttttgcatcacattaaaacttttctacacatataaacttccaacttttttcttcaaacttccaattttagtcaaacttccaattttggtgtggaactaaatacaaccaaagggatggcttctctagtcaagtaattttggactacttgtttcaataagatttggttgacggattgatcttggaacgaggggtttcagcagtatagttagccatatagcccgaggccggacggcccggcccaaggcacatgaatttggcccggcctaggtacgacatggctcgactggggtcgggcccatgctggcccagcccggcccgatagctaggtcgtgcctgggctactggtatggtgaaaaaaatagttgagggatccaacatagacttacttcagtcgaaagagggatataaaatagacttattcagccatataagactcagcccaaagaaataagggaggcaaaataaaagtattttatagggaagcacgatgagcactcatgccttcgggccatgagtaggcccggcccagcccgacgtgtagctcaggtcgtgccgactcgattgatcttggtctaggcccggtcgtgtcttggtcgtgccaggctgggcagcctatttgaccatttatattcagcagtgtataaatgaaagcttacgaagacaggatcctatacgagtaagttggcttatgacgtttatttcctttaatccatcaagtttgcctcgagccatatgaccaactatactgttgaatttgcaatgcagtgcaatgtagaagtgttctacattaaaaattttctatgtgggtagcggttaacagttgctattggactttagatcgtcttgtcaaacggggcctaccgcatccggctgtgatcaagttgatgagaccattaaacaaattcttgtgtgtcttttgttttctttcgagaagtataaagtttaatttttatgaagttgggcttagtttcagctgcaccttagccttttacaacacattttttttccagaatggtggagtaaagttattaagggtgttccaaagagctacggaaggggttcaaatctttgatcggttctgtaatctgggacatttgaaaactgattgcgttttcaatggtctaatcctaatatggtggtggttttgcaggctgtggctaatcagaatagtagtttactagtttatggtatttagcaggatcccatggctccatgagtttatttgtaagttgcttgggtttattggtcaggcctcgcttatgtgtgacacttattggaaatgttctttttggtggagcggttcaattccttgacctctccttgtttgtaaatatttcaatagtcttggaataaagcgtagttatccttcgttttttagaaaagaaaatagcgactgttttagaactgacagttgataatcaatgataatagcactactgattaattaccaagattatgattattattatcggttcggtagtagtcggtctgccaaaccaagtctcgctttctggagtggccaaatgctgctctcttcctcccttcatcgatgtcacacttcaggagtgccaggctcgctcaaatcaaataagagaacttgatgagccgagaatactagtataatgcagcatacgggctacaggaatgtagcaatgctaggaaaaagtaccccgaaggtctctcaatttgtcatcgggataaaaaaacgtcatcgaatcacaaaaccagatatgcggggtcccttaactatacaaaatcggtcacccaagttccttcactggttttgacccctgttttggtccacgtgacgactaagtcagcgttaaacccacgtgtgccccacatgtcagcgtgccacgtcaacttccccttttccctcttctctctctgcttctctgcttcctccctccctctcgctctctgctctcgcagggcatgggaatgccggcgctagggcgcccacggcggcgcgtgcccccggaggatgatgcggcccgggtcgtcgtcgccggcggcattagcagcggcggggaacggg

SEQ ID NO: 60520 - DNA, 10772 bp, Oryza sativa
atcgacctgtgaagagaatcaagcgatagattcatgcgttcaaagcaatgctgctttcttttagtaatttcactggacagcgtgacaagttgatggtcattttcctgcgacgccgatagagttttcgctgaacggggattggcactggcttcaaatcaatgcaatcggtgaattattctagctgctgtgctcgttactacccatgagacaattgcgacgggatgatgtggatgccgtggtttctagcagggtacgacagtggtaggcgtgtctgctcatttctttacagtgcatataccaatcgtatctcttttctctgcctgtctattcgtctccatccttgtgaatgtaaccacttaattacctggctctgatagcaaaatatcgtatagggacagttcgcttataaactaatccagctactgaatgaccgaattagcgtagtaatcttctgccacgattgaggacaaaataaagagtgtagagagcgcagactgcagagaagtccagtagaacaataccggtaagcaagcacgttagtcgagccgctgatgattggtcagtggtgtattctaatctggtaccctattaagtatgagagcaaaaactggaccaagcttggagaacaggagtacatactactattagataaggtgtacattatacagtgatgtagtatgtatcaggggtcacaattccgacgaaaatcggttgaattctgcgaaatttcaaggttttgatgaggcttgaaagtagaagccatatgagatttcgatgagttttatctaaattcaaatttgaattgataaaaaagaaaacaatcaaataaaatcttgtaaatagtatgatattcatagaatttattgggatataaatttttgaaaaaaatgatgtatttcacgtatttactgaaatttatagtaggaaagaaaataataacgaattaaaaaaggggaaaaataagtttacctcttttaccgattgaaatttcgattatttcgccaaagccgaccggttttcgcgagcttatcggtaaactcaagaaatttatatttaaattttggtttatgaaatttgtttggaatctaccggcttttcaccggatttcacgaaaaccgttgttccaccagagcacgaaacggaaggctatctcgaaatcgtaaaccctttatgtatatcttcgtccagttggccagttgcatgcgaacagattaaggattcgctgggaaacaaactggataagctaactcaaattaaaacgcgtggcgcggtacgcgacctggcacgctgtgtgctgtgtgcttcgctgccgtgcggtacgggtgcgtgtctggaggcaggccggccggccggccgcctcgctctcgcgttgcgttcgcgtcggcccgcccgatccggagggaccgacccacagatcacgcgcgctgacgcgtagcgagcgtccgacaaaactggacgggggccgcgcgctcccgggcgtgtgccgtactagtagtagcccgtaggacggggtccaaagcgcagcgcgcgcgacgtcgggtactcggactcgggtggccgggtggggggcgtgcgcgtgtgtggccggcgataagttggcgtttggcgcgcgtggtcaaggcgccgaacagtgtttggctgttggggttgggctggaacttggaagtccgctctagcgtttgacttggttctgcctggtccttctagcaaggtggtggcaatcacaaatttttggagtgtttgcatccacggttactacagtaacctcgtgcagtaaccgttgtggtttttttatcttagttttagtaacctcttaatttttattttagaaaaggctatacgcactaattttttcttactaaattcttactaacactgatgtgtcctatgagtgcatctaaattttttataacttacatatacttaaatcaaacggttgagataattgttagtaaaagtttagtaagaaaaatttagtatgtgtagcattgctcttttattttttagagtgtatgagatttttaccgcacggtaagtaggttaccgtggtacctgctctcggtaggagtaatccctttccaaacagtagaaatctgtcgcatggtttgacgtggattttagcggcgatgtgtgtcacctttctttcacggcttgtaaagccttgaatttggaacagaaacatagtttcattttacgtatataattttaaacgaaattcgagatttttttcacttcggttgtatttcacgtacgaccagtacgtgacaacccccaccatatattttttaatatatatagagagagtgagtgagtttagaaacaataaaatatacggcatcatcttttctcttatacttatgtttatcagctaaaatttaaattttcaaccataaatttatagctgattttaagattttttcatcgaattttattttccaaccttttattttagatcaataagaacacgtatataaaagttttattcataaattattttccgtttgcgaatatgttgtttagcttattccaccaaacagctgaatgatatggctgataattttctgaatagctaaccttcaaacacgaatggtaatccataatttccggctactgatgactttttacaaggcgctaaaaagggctaggttgtcagttgtcacgtactcctacaatctctatcagagcaaatctgttggcggcagctagtgtggccatgcatgcgtacaagctcacgcacgttcttgtccagtactgctacttctgctaggctgctacttctccgtgggaaacagtaagaacacgaaaccgagacgtgtcaagcagcgcttgagctagcggcccccctgctcgcttggcgtagcagcaggcggcggcggcggcaaaaactcgatctggtgacatgacggcatgcatcgtggcgccacggcctgctcgacacgttggtgaacggctatcgatcgatcgatcgatcgatcgtttcgtcgcgatcagcccaatccacgcacctggtcgtccggcaccgcttcatttaatcgttgggcgcgtacttcttcccgaagttttggtacactcatctttttgaaagaaatactccctccatacttataaagaaagtcatgtttaaatcaaactttaaaaatataaatcatgaataactcttaagttattgagtttgaaaatataaaaattatatgaatagatttgtcttgaaaaatactttcataaaagtatacatatatcacttttcaataaactaggaaggtagcccgcgcattcgcgcgagcatgtatcgtaggctgcatttgagatactcgtaagtaataggccgattgtgttaaaatgtcgtatttgttatatagtaaactataggcatatggatcttatatcgttggtttgattataaacagagcaatagttagattagaaatcaaacgtgaaacttataattatagattatttatattttagttaaataggaacgtaagagaaatgaaaagtgtagagcttgagccagagaggggaaggagcgggtgtgtagtgatgggcgtgtgtggaggggatttttttttttgtaatttttctaagtgattaagtgaaagccaattattaaatgtaattttcctaatatttgcaagatttttttaaaagatgtgacatgccacttatcaagatatatttttctaaaagtagattatatagttgaaaataatgttaataggtcatcaatctaggtgaaaactgttagctagatgttttatttttttcttttaatatataagattttactaatttttaaaatgtgacacttggtaatttaacatgtctctaaaaggtcatacatgatgactttgtatttttctaatttttattacgtagaatgattaagatgacataatacatattgtcaattttttaatgtttcagtgttgttcgcttgttggtctatgttaaaattaagtattttaaattttacatagtaaaatatgagtaacataaatcaacggttcaaataaattaaaaataggatgttatttgggttgtcaggtaaagaataggtggcagttcaaataacacattttattttttaaagtgaaatattggtaatattgattctaaattatttagctgtctaattatgaaacaaccgttcaaacaaactaaataaaaacagatatactacctctgtttcagtttcatattataagtcattttgaacttttttaagtcaatttttaagtttgaccaagtttatagaaaatatagtaaaattttcaaaaataaaaaacatattatggatatatatggaacgttatatctaacaaaacaattttgtgtgatagatgttgttaaattttttatatatttggtcaaatctaaagaaatttaattaagaaaaaagttaaaatggcttataatatgaaatagagggagtaaatttttaaaattatgattattttgctatgtaactattatctttttttttaaattgttagttaaaaatagatttgttatttataaaagcatgcatcagatcattaatcatttatatatttaggcatgggacatgcaatcaagaatccacagccattctcgtgagatagaagtgaagaaattaattattaagtaataaaacaaaaatcttaactactatagagaaaaaaaggaaagagatgaggagaagggattgaggggaaggaaatgagaacgtacggtagtggttgaggaatgatttttttatgagataaatccaattggcccaccagttcaagttatatattttttttaatttattagagtgccacgtggtggcttaggagtgtttataggaagtttaatgaacttttagtatataataatagatagatagatatatatatatatatatattatatgttgttaataagtatttaatttatttagatggcatgcaaacttgcaaaatgcaccgtctataccacaataacatattgcttatatatagcaaaatattggatgtaaaattgtcaatttaattataaatagagcaacgttttaatagaatataaattagctatgtacatttaaattatggtcaacttaactcgtttttaatttgataacataaaataattaagaagagaaagagatagagatataaaagaataggaagaggaagagacaggagagcgtactacgttcttatggttttttctttttccggcccatggttatacgaagccacacgtatgcacgtatgtttttttctttttctgacccacaacagaggaatggattactttcttaaataatagatctaatctaatggtctaaaatatcgagtccaccaatttaagtgaaaatcgacggtaagattatatagtgtcatgtggcggtttaggagtgtttgtaggagtgacacgtggcggattgagagcgtttgtaggaagtttaatggacttttagtatataatagatagatagatagatagatatttttatagaaaaaagaagtcaaagttgtgttttggagaccgtgtcgctgttctaaacgatttcttttacgagtatgaagagagtactatattatttgaagaataaagaatttattaaaactagactattgcgctaaccccggtaacatcgagataaagttttcggatcaaatttgccaaaatttcggcactcgtccgtcgtgcgttgatcgctccgagagtcgaaaaaagaaacaacgcagtgccgagaatcgaggtaccaagttatacaagcccaagaaaaaaatgcacacgtacatcgtacgagcctcgaaatgtacttgatggaacttaaatacggcagcacgcttcatcaagtatttcgtcgtgcacctgttcccgaagccccaatggatggatacagttacgtggagtagtcgggtacgtacggtacaagcgctggacattctcgactagctgctatgtaaggttatgcatgtgaagtactatactacgtatgtacaaacttcaaattgtacataacactagcccgtcaatgactccgttatatgaaattttggaactatttggtatatatgttgaggaaattaatcgtaaaatatagtgttattaaatttggtaagctcgagaatgtgaatgagtttttaagaccccataatttggtatagtttgatgagtagaaggttccaaaattgttaaaattttgacagggattggtaaaaacgtgatactaagatttcgttagagcatcaccaacagtatcctaaaatttcaaaggtcaagaaataatttaatcacctcctcgattgatcacctctatgtataaaaataatgtgataggggatttgatggtagaagctttaaaacaaagtaaatttagatgatgatattttagttaatgtacgcatatatgcaagttttataatattataagatacggtgagaaactgatatgcattatatttggggtggagtgaatattaactattacaaaactgtcgacgtttgatgtcgcgattccggtatttgcatagtatgagaatcgttggtactaggatatacgcgagactgaggtaaaagagacggggacaagtatttttatacaggttcgggccctgaatgtcaggtaataaccctacatcctgttggccgaagccggtcgttgctcttattcaccataatcacaccagtacaaaatttggggtagcctatctaactgttgtcgacatggcggtctgaaggtctgactcgtagtcgacaacagggtagtcttcctcctcgaatccgtgcccggcgagatcaaagatagcgctttcgtctctcctgacagtatccggagacaccgtaggggactagctgtgcctatctccgaattcgatatctggcgtcttgtcttggcgtatgttggcttgtattggcttgtggctttgtggcgtctatgttgtccgtggtgggtatgtcccctctcctcctagggggctttgtatttatacccatagaactagggaaaccaatatgtatacaatccgagtagtacttgtcgtttccatgtagaagtttggttgtctttccttatctggaactcctcctatatccacatgttgtttccgtataggatatggtatgtggtgggtcctgccgagatttagtcaactactattagttatgtggtatctataaccctaacgaaaactgaaatgtagatttatttattttttagaaaaaaactataaaatttttatacaaaacacatcgttcgataattcgagaaatatacccacgaaaaatgatggattacctcagtccatgagctgaatcaaacacaacctaagttagacaccccagcctcgttgccgatgctatgctactcttcacagtcgtaacgcacagcacacggcccccagtaggtctcgcccatgtcagcccagcacccgtgcacgctcacgcacacagccactgcacagtgcacgcacacagcacagacagaagaaaaaataattaagcgcgggatcaatcaccatctcatcttaactcgcaacgcgccttggatgatcaagcggcgccgggcaaaaagtcagcccgtgacaagtgttagctagctagccactctgcaacggtgctgccaattatggccgtgagatagctagaagatcgatagctgcagacaggaagccaggcacgctgcgatgggaacgtcgtcgatcaggtatagtcgatcgttgtaccaccattttgccaagttgcgagaccaaattaaagcatggacctgatcgagctctccgacctcgatctcttattttaccagtgaaatggtggtcacacacacagcagctagcaggcgagaatcgtgacatccactgcaccgcccgggctcgccgacttccctttcgcggtgagtacacagtagcgccccctgcttggaacccaatatgaccagttcgatttgtcgtgtcaagcggcctaacctgctagctatagcatgtgtccacagctagatggtactatatatcagtactaataagtgtgcctacacaaatctttcgtgtctatatggattaattaagttattgttgttgtgaatgggatttgatcaaaacgtgaaagtcgatcagcagggctgtatcgcggcaactgtgtgaaaccatgattttaacggggcattttaatttgtcctgcggctgatttaatttggtaagcagaggtatactactgagaatgaccttccacataaagcagtgcatacagaggatctaatattctaattcaaaacatgaaaaactagccacagtccacagaccacctcgtcccaatactttacacatggacatcatgcccgggataagatctgatttattttgatacggtacagaaggaaacattttccatggactaaggtaagtacattagatatatttatgtctgtgccacaaataattcctcaacaaatttgttggtacactgcataaattcgcatgttcaatgagtatacagaatgtgtaattatgcgaacagttgtgtgtttgagtttgtgttctagtcaaagaaaaggtacggatcgactttctcccttggtgagatcaggaaaaaaacagaaacatgcatctacgtgtaaaaagagtgcagattgagtctctctccacgtggtaggagaaatttaggaatgtcatttctgtggttcagttaacgcaaccatgcttatctcgcttctcgccctatacatctagctatcctttatacagttataactgcccaacacgaccccttttgagttttgaccgagatggggagtagaatatactcctagctagtcatctctcactgcatgcaccgtatgtacctctgtgataagttacacagatgaatgtcacaaaagttgggaaaaaggattttaatgtacactttcttttaacacgtggttcaaaaagttttaaatatttttaaaaatatagatagaataaattattatgttatatgtccctctataaacatagagaggtttaactcgatctacgtgaaaaaaggtcaaataattaaaacatgtcactgtgtgtaatattttttgtgattttaatttgatcttgcaagtttatatagtgatattaacatcacaatcgtctatgaagtctgatttttagaatttctttataactatatatttagcacgcatgaaactatggtgaacatgtttaatttactttcatctaatagtctcactattttacaaacttaagtcaatccgagctacaaaatttactgcatttaaccttgttaattagcaagggcaagacatagaacctaaataaaattgggacccaaatcttaatgaggcttgtgtccgaaaaaatgatatcttaatagaacaatcattggcaaagtcttatcttaataaaacaaaatagagaaaatagctacaaaatctactcttttttttacgtaaaatagtaaatacatctcaaccagggtttaaaatttcatttgagctatttctattggggctaccgaatggaccaaaaatttgtctgagataatttgaatttttgaacaaaattttccaaattctagaaaaaagaaatttgggcgaaatttcgaaaacttctgtatgaaaatttgaatcatgatctcaacccaaatcttttgccggttcgtacatacggagtatatattattaatattacttctagctccagtaatactaacttcactgttctatattaatatttgatatatttctaggtttgataagaaaccatatgtattcaagttgtatagtaagtgaaaagcttaagcctgctttggttatatgatttattttccatttttagagtctaattaagtcaaaaagaaaattttacagctactctaatttcggttgtgtttagatccaagggtgtaaagttttggtgtgtcacattggatatgcggacacacatttgaagtattaaacgtagactaatgacaaaacaaagaatccgcctgtaaaatgcgagacgaatttattaagcctaattaattcatcattagcaaatgtttacaatatcaccacattgtcagatcacggagcaattaggcttaaaagattcgtcacgcaatttacccaccatctatgtaattagttattttttcgtttatatttaatactttatacatgtgtctaaacattcgatatgacagggtaaaaaattttgtcaagcgatctaaacaggacttcatttttcacaccgggacagcaaaattgccacaagttatttcgtatcaaatcacacgacccaagtaactagtccctacatgcagctcgtcaaatcaggctagtagtggctttgattagtgcaagccttctctctgattactctttgctgcttaacgcggaaaggggaagagcgagagagagaaaaaaaaaatctttccggccgccaacggtcaccccctataagtagaggagcccatcttagctttctcctcgcagatgcaattgcgcgaacacctccaaactcccgagtcccctctcctctctcgtcttcctctccacgacgacctctccgcttaattgtgcgccgccgcctcagagcgccatggacttcagcggcgacatcgatgacctgatctccctccagctcctccacgatcagctgctcggggtcgaggccgacgcgtgcctcccggtggcagttcatcacgatggcgtcgccgcgttcgccgagcatcagcagggtttccatccccggcgttcttgccgcagcagccgatgacgatgacaccggctgggtacgtggacatggcgaatgatcagtatttgggtgcgca

SEQ ID NO: 60521 - DNA, 9059 bp, Oryza sativa
ccccgccgccgacgacgtcgacccccggcaaacggaagcggcacgagacggcggcggccgacccggacgtcgaggtgatcggagaatcatccaaatccgtcaagaccgagacgtacacatcgccggcgtcgtcgtcgctggcctcaacgacaacctcaacggtgacatcatcatccacgtcgccttccccctcgtcggaggcagctgcctgcggcggcggcggcggcgagctgttcgtcccaccgatgccgtcgagctggtcgtgggatcagttggaggggttcttcggcatcctctcgccgctctcgccgcacccgcaaatgggattcccggaggtcgccgtaaactaattaagcgcgctaatgatctctctaagcatgattaattaggcgcaataatcggcaattaattagtggcttctagttctcgacggccttcgctttggacacatctcaggagatttggcttggagcagtgtactatactgtacagaggagagaagatagtatattagcgcatgcatgtgacgggtactgaatgtgtgcatcgacataggtgttggagatacactctagatatcttgaaaataataagaggaaataatagtataggatgggtgataataacattgtaaattaattaattaaatgaagagtaaatgtgtactagtttgttttatgttcttttcttgggatcagatcgatcaatcggtgtctatccagttgtgtttgcctttttgcgccataaatttgattatgacttccgagtcttcaaatagccagggtaggagacatgtacaacgcacaagattttagtcatatgcatctagatgctgtaaatgccgtttgcgagaaaaagttccatatatatcttctgtgctttggatcgactagctctggccagaagtgtagtttaattagccacatcgaaatgagatattgtacatttccgtttagatgttaattcttgcagaaacggaaacaattctggttaacttcaagcaacaaccttatgccatacaggtcgatctcacactacaagtcatcatctagtacatgtgcatacgtactaatcagtaatcacatactagacgtatgcatacatcgatttcatctacagcgtgagtcatgcatgtgtgatgcacacagctaacaatcaagaggttgaactgagttagaatttcaaacgatgtccacacttgatttgattttcttggacgtgttcatatgtgcaataagtctaaactgtcaccagtaattctgaaagaaacacacgtacatactattgatctgtacgtacgtacttactataggtgttggtctgaatgtagtgtgtttcaaacagttgacactgatatacagtagcgtgtttaatttgtggattgcatgtgaatttttatgttgtcgccaaaaaatttaagttccagcctcctatcatataatgtcatattgatgtccacaatgtaaattcaagctagtcaaactatatgagtggccaaagggtaatacacctttaaaaagctaatgatatacggaatatgatatcagaaacagatgaggtttgcacataggtaaaaaagtttgcatgtgtttgctttgttgactacttgagtcttgagctagcatcaacccaaattaaaaatgggccttgaacgaagcttaaaaccctttagataagtctcatgcatgcatatatgcaatcatgtcaactcttgtcaagattacgtgctggtaaaatactattgagttatatcgtcaattcgtcataagtcagaacagaatccagatagccacaacaaagtgagtttactgccacatggttgctcggcgtcagtttctttgcacgactggaataacctaatcgatcatgatctaattttaattacattgagaaaggatcgatgccctacggattagtattggtcacttgttatggaagatggcatgaagctgctgcttatttttttcttacctagcgagggaacagaggaagtacgtattccctctttttttaagttgtaatttagaacactgatccaataaacatatttttaatcattggtttttctgtcttctaaatttattttttagataaaacaaatatgtcaaaaagaaaacaatacgaaagatgttatcaagaacactaatatatactccctccatcccaaaatataagtatttttaaacttcgacacgatcttcgagatgttactttgaccaataatatctataaaaataagatgttttaaacaaaaagatttgcatattatgatagtttgtttaatggtaaatctagtaacatcaatttgacatgattaatcttttttatttttttcgttattaatagttaaagtgaaaaatatttaacttgttactatgccaaaaatgtttatattttgggacgctgggagtactatatatctccatatatcaaatccttctttcaatctgtacatgcatattagagattagatattttgaggtttaattatgcatattatgcaacattatctatttgagaatggagccaatatctgtgtgttgtacaaagagatgcagtgaaattaacctcactcccgtgatttcatatatcacactaccgcatccaaactcaactgacagaaaggataactacagatcgtctccatgtacttggtccagcaagaaatttggtactgcaggacaacgtgtcgtcagtgaatgaggtggcttagcctgcatcactccaacgaacataaagtaagttcagtttcaacagtcaacggctccacgttgaagagatcaaagtgctcatctataggggaactttgttcgtgtagcattcacgtgcatcgatcccgatgcacgaggtgcagtatatgtcagcatgctggtcaagaaatgaagcattgatcaatcgatcgaccgggccgttgatgcgttgagaattataccctactacacgaacaaagggaaaatacccccatattgtggtcgttttcccttgctttccgttacagaaatcaaaacggaaatggttctaggcttctagctagctaggcgcgtactccctccatccaaaaatagacaaaccctgaatttccgtgtccaacgtttgaccgtccgtcttatttgaaaaaattatgaaagaaattaaaaaggcaagtcacacataaagtattaatcatgttttatcatctaacaataataaaaatactaattataagaaaatttcattttagaaggacagtcaaacgttggacacggaaacctagagtttgtctctttttttctttttaagaaggagggaggatctgtgtgtgaaagaaacaattagaaaccatgtttgaaacatgctggcccaaatacatgtcaaattggctctgaatttcatgaagcacagcggaacaggctgccataggacataggtactccatccgagacaggggaaaggctaaaatggccgaagaatgcactcgcaattttttgaccaaaagtattcgctctacaacactagcccgtaaccaacacgtccaaagttcgatacgccctactcccccgttcaccatcagactaaaaaagcgtacgacgccgccgtcaacggcggcgttggtagcagcaaaaaccgacgtaacaagccgcaaaaccttaccgacccaggatcgatcgatcaagagctagcggcgtcaaccgggcgaagaaaaaccagaaattttgaccgctataatcatgaggtgatcagagaccgccggtcaagctgtttacggcctttgcggtgtgcgatcgaattgaagctgtagctagcaggggaccgtgctggccttgtcgctgttaatgcgttcgtaggcagttagttaaaccggcacaggggagttttgacgtttcatatcgtacacaaccaatactaatggcaaggtggtgctagtagcaaggtgctatttcatacagccttttgacaagttgatgaagaattggacttgagagagtagctgaggaagaatttcgaatgggtatatatggtcagagccaatcggacatgagccggttcaaagtaaacctgaatgctgtttcagcacagcctagagtcaatttaaccatggttcagaagtacacgggattcaaattgagatcctgaaactaagtttgctactagtattatcaggagtaggttaatttagtagtactacgaaacaatgttccagtaggctctagaacgaatctttacaggaaataatcttatttttctgcatattgaataaatttcttgagattaaatatattaatcttctctgtctcaacgctctcattatgtcttttgtcggagcaattaaaagtcagcgtccactgtaattttgctggctagttttagttgacagattgaacactcgaatgaggcacaaacccatagaattcacttcattttggcatcaactttcttcgtttcataatcacgagaggcaattcagagaatcagaaacagaaaggtgagaggaaagcgagaggctttacagtacatggctacatcatcaaggtcaaagcgatagcgatcgaagggctagctaatctgcaataaatacgcctgcattccaatctctcgatatcgctctatttttatttctttatgtgtgcaagcaaaaaagtcagaaatcttgttagagaatctgctcaccgttggcagattgaggctggaaccaggagatgatgacgacgacgagctcttgcaagaaagggactgcaagcagatagagggccaagaaaaatgttaaccaagagaaccttactttgatgtgcatatgtgtcttggtctgatccactgtctcctgcaattaactgcattcttacaaataattcaatggttgacatgcgatcatgaactgtcgtcagacgttgtcaaatcaaaccaattgaccctagagagacgacctctgccgtacatgtacagtgcccagcagactatcgagagtaagagtttgacttaagtttctctttattcatgtcgctctcgccatgggagaaaaactaattaaaaaaaacaaccaagaactgtctgctgaatgattggtactgctagcttcaaccttgcatgctgcacatcgactacgcgtgcctgcacaatgtacagacgctgttacgcatgtaaaatacgttgcctgaaactttggcatgcaaattgcgttgtccttgagatgaaaagaggaaataacaaaatggttgttccaaactacaaacagaaatctatatgcaagtactactaatgttttctggcaaacaatactgaatacggcgtgcgtgacaaataatctcggatcacgagttttgtacgcgtgcgtacgtgtatctgaactgttgtccggccacaaaaccccagcctccgaagatagccacacggcacactgcaaaccaaacgtgtagcagcagagtgagatcgacagacggcatcggtcggcatccgatcccaacaacaacattgacaatcagagcgaaacaggtgttccccaagccaccagttttaagtcagctactcccgctatttcagattttataatcattttagttttgatcaaagttaaactattttaagtttaatcaagtttatagataatatattaatatttataataccaaattagttacattaaatctataattgaatatatttttataatatacttgttgggttaaaaatgttactgttttttctacaaacttaattaaatatggagcagtttaatttttaccaaagtcacaacgacttataatatgaaatgattataatgtgaaatgaagggagtagctacttggcggcagctacagtaatgaagtcttcacgcaacgttgacgttctggagtgagcagtaatcgagacgctacgtcgtgttccgcagtagtcgcgctcgtaaatcgaatccatgatgcggatcgacggcatgcgagaccttgttgtcagtgtctacagtaactgccccgccgtcgatcgttttccgtggcgcagcagcagtactagtagctccaatttgcgagcccattaatgccatcagctttgccggtttgaggttaaccccgtacacacgcacgctcgctcggctcgatccgtcgatcggcattgcttctgtctctctgtgatcccgtgaaacaggccggtgatctgacaccaaaaaaagtgtttgcgagaccaataataatagggagagatgagagcttgcgaaacattttctgatgctcctcgctgggtgtaaacgcctcgcgtcgccgccgccgccgcgcgcgccggcaaggcgcgggcagccgcacaagtcacaacctctgttgctaccgcgcacacgtacgccgcgcccgcgcgcgcggcggattttggctggaggctgccgtgatctgtacaatccccgtggaaactgaaaacccggatttttccaacaacatcaaaaatttttcctcggtttccgttctaaactccaacaacatcaagatttttcctcggtttccgttagcacacttttcactaaacggcgtatcttgtgcgaaaactttcaggagaatagctaatatagtccctaaagtttcgctcctgggtcattttagtacttaatctttcatattgtctaaacaagtcctttaaatttgttatgtgggctaatatagtccttggtcccaccaaaatcaccacatggacatgccatgtcaccttcgtacgcaaaatctatatgatttgtccaatttacccttacgcataggaaaataaaaaacaaaagaaaaagttaaaaaatatatggtatatgtaagagcaaaaatatacctcaaaagggtgaaaaaaaagaagtattttttctatggttatgtctaattcacccttatatttatttttctacgatatatgtaagggtaaattgaacaattcatcatagattttgcatgaatgatgacatggcatatccatatgatgattttgatggacccaagaactattctaggccttatgacaaaagttaagaatttctttcgaccatttaaaatgttagggactaaactgatcctacagataaactttagtgactaaagtagctattctcccaaaactttctatatagaagttgctataaaaaaacaaataaatccattttcaatttttttaataattaaaacttcactaatcatatgctaataacttatctcgttttacgtgcgcacttaatcttaatccgataagcagattcgaacggggtcgaaaacacaaatataccgatatttcgattaagttctttttttataagaaaaatcgaactgaactattaagttttggtaatatttgtttggattttattagtttttatcggtttatcaatagttttcgtgaaataccgctcttgagcggttttgatccgatactcggagtcgtaaactctggtgtcatgtacggtggcggcgggctgaccgggtggttgttggtatgtgcacacggttgccccgggcgttcaccgttcgcggctgggggtggtgtcaccgtgtcagcaaggtgagattttggggtagagggccactacgtgacagctttgggccgggaaatccgaagttatatccacattgcaacgagaggccgtccagattgtatcccgttttgcaggtgaaaggtcgtagctatcacgtatgagggcgagagaccgtccaagtggtgtaccgtttccagatgaacacggtcgtaactggtatcacgtatgggagagctagagaggtgtacattagctccgacagtggcttcaggccttcaatttggtcagttccagccaaaagcaaatacattgccgctaccatgtggtgtgaaatagattatctgattttggtgtaatatttgagggtacatgtaaataaattaattactataaagtgcaaaaaatgtttttagaaagtattctaagcaacttgtacacgcaaaattttgtaaaatcaaaccgtttaggagtttgaaaagtgtatatgtgattatctataatctgtaaggggaaaagaactgggcctctgtccagggcattggagatgtgagagaaatagagaacaaatgcaatgaaaatagcagcactttgctgtagctgtagcagtactgaactttatcacaaatcaaacggccgtacaaataattctaaacggatatgctgcgtgtaattccaaatgcatgttgtgcagtgttgccatctgccatactcacattttggagtcagtccgtaatttggagtcaaatgtagcctcacattttgtagaccctgtccaaatgcctactatgcattacagtggagatgttctatctagaaagtcagataaaatggccctccatgacatgtgaaattcacttaaactctttttctttcaaagcaccaaacttggttttatccataacgagcagctgggcatcctattcaccatagaatggttgagcctaaatcaaagtctcctattttgaaacaggaatatgaattgccattatataatgataatttctttggtataagaaacaatattatcgaaacgagataggcaaatcggcaggtataaacgagtgtattacataaggtgttacataagatcacatggactaatacatcatagttcagtactctgtaacttttaacttattccaaaaacaccactgatgacacacaacctaggtaaaaacagcagtacaactgatggacaatcgcatagaggtgcaataggttcaaatccacaacccagtcttacttgctatctgcagaggcctcgactatcttgacagcagaccaaactcgcctgtaagttcaatgacacgtcatcagcgtatggcagtaaaattgtgaaagaaaaagaatcttgacattgcatcaaagcaaggtggaactctgcatccagtgccgactgccgaatgaaattgatgtgatgtttaatgaaattaaacttagtttcaccaaatttcagctgtatggaattcagacaaggtcatccgaacagtctagtccttgataatgtccacagaaaataaaaaggatgattgtccaaccacagcagattacaggaaattgcatctacagaatcaaagtcttgaaattttgatatatg

SEQ ID NO: 60522 - DNA, 605 bp, Oryza sativa
tccaatgcattgttcttgcaaagggaatatagccttttttagctcacgaacatgtgagcacacagccacacaacacggaggatgcagatgtttagggaggagaaaaaggctacagattctttcgtaatccaccctgtcctttgttcttttcctgccattcggaatttagtggtgacccaatgacaaagacctttccagtgtttccaattccaaggctgcaagtattaccgtgaatctttctgtcagcaccataaaaatattacaccccttttttgggtcctgtagtttatcctttaacctaaagatcttgattttctacaggtggagcctatgatgattaaccatctggaattaatgcataccacataccagtctttcaatggtgaaattgagcaagggatctgctgcaaacttttgtggccatgtggggttttacctgaaatttcaggtattcctcaagcttttacctcttgcagacttcaactggtaatttaagttcactagtctccttccagtctcgtataatggtggtacaatttacatctggttcagtagaaagtagtaaatagaaacaaattatcaaaacaagcagggctgcaggaatt

SEQ ID NO: 60523 - DNA, 1761 bp, Oryza sativa
agatttaaattttggtgggtaaaaaccccaaccaaattacttcgatttgctttcgatgctccccatatcaccggtggtgctttccagttagtttggattttgataatagaaaattttaacctcattgaggcttgactttgaagcattgaaaagcgtggaactattcatagacatatttttgttctttgttctttgttcctactatagtctagcataatttgaacaacgcaagaagtactccagtaaacaatttctttgttttggaatcctcaaggagccaattgggtagaacatctttatcggaaccaatagtggtacgcgtttgaatccctgggacctgattaagctccaatattcatacgacgtgcgcggcagagtgcagagtccaaactcaaacgccgaatcctgtatcaattacaaggataccctttcccatcgtgcaggcgacctgagtttttttttctttttcttttacacatgagccctaccttaagccggcacgccggagagttgacgtcgtcaaacaggttttaatcgcactcccgccaaagtggccaaactggctacctccgattgattcggtccgtgaagccgcaagccggaatcgtgaaaggattttttttaaattactttttgtactttttaatttttttattttaaaaaataaacacttctgaaacttatttacaaaatctagacattttgtctatatagagaacagtgtgaccaaataacactgtcacaccgttcaaatcttgaaaataagtcttggaaatatttagttttaaaattaaaaaattaaaaagttcaaaaagataaaaaaagatctatgaaagccggcggcgaaatgctactccactttttcccatcgtgctggtgctcactgctcagcgagagcttgacaggaaatatttctgaattcccatcatggaatgaaccatattggttgtgtgaaagtaggaactactacttgcatatttcggccggttttaggtcccaactttttcttcaaaattctaacttttctatcacatcaaaactttcctacatacataaactttcaacttttttctttgaactttcaaatttaggctatgtttagttcagcgcaaagtttggattttagttgaaattggagatgatgtgactggaaagttgtgtgtgtatgacagattgatgtgatgaaaaatgactgaagtttggatccaaactttggatctaaacacagccttagtcaaactttcaattttaacgtggaactaaacacacccttaggttgtggttttcaaattttccgtcgtcagagtttgctccggtgtcagtaacactgtaacagagctgtaaaaggagccaaacacaaaatgtacatcttgagtggttgcaacttaaccgccaagattagaacatagctcatgcttttgcatataggagtacttatcttagtagtagttagctcagtcatgtccatcacatagatatcagatacacccctgtcattccagttagttcagtaatacctatcacactatcagggctatcagtcctgattaccttcataaacttttgtcggccgatcacactatctccagcatagcaatggtcaccgacacagccggacagtttcatctgtggttatagctgtatataaacccatcgcaatctggacaacagcatggacaaaataagggcaaagagagcaatctcatgatgatgtagtaatcttgatcggttttatttttgtcataaacaagcagacatgca

SEQ ID NO: 60524 - DNA, 620 bp, Oryza sativa
atgcgaaatatctagttttgcggtttgaggataattttgtatctcgatgagaagttgagggaccttggttgtactttttccttcacatgacgagtactaagactggccctggacgataggaagtccagaatacatccttagtgtacacttgattatgggcctcgctatggattaggcatgcctggcctagcaggccactgaaaggaagcccaccgggctgacagtgcagtagttgggcttaaagcatttgtctgttaggctttttacggcatgcgagtacaacattgctcccgttttagcatttgaggttgcaagttatttgtcgttcaaccttaacccaaaagccaagactagcttattgtattttaggtcatgtttaaaattacatgatgaatttgatcattatagtggacttttaatcttcggcctgggtctatggcccaagtgacctgagactttgggtccatctctaagtcaatcgttaatatgtgtggagattatggttaccccatatctacatggcggttatattctagctggatatacggtaccaaatatagatagaatatctttatgaggactcgggttagattctaaacttgtatgtcaagaaaataccc

SEQ ID NO: 60525 - DNA, 1663 bp, Oryza sativa
catttcgacatgtagaattcaagaaaaattccacatgtcaaatccgattattgtttgcattgttttcttagggttttatcctgatttcctctgcattttcttggggtcatttgtaatttacaatttggcttgggaggaaaacttcggggtgtgacactggatcagaagcacttggttgagtttcagaccgaattcttggtcctccgctcccttgtccagtttggtggcggggagatcggcgttgagcgattgggggatccgacttcattaaagcaaattcctgggtgtaatatccttcattgttaactgattcaacaagaaaacaagatcatattttgagaaaggttgcagtgtatgaatacgtaccagtggaggagggttgaatgcattgaatggcacaacgggcagcagatgtgagtagctgacaacgatggcgttcgagaagatcttatacatcctttctttcatgaccttgaagtcaagagaatctggatcttcacgatttgggtcatgcttgccgtcaaattcgaaggctgtgcgagatctttctttgattggagctaaccgacacttgataaagtgccgggtgatctgttccccttgaaggccctgttctttcagctttatcatcctctccatcagttctactgcttgtgcagcttcatctcctattggcagtgagttccatgtgtcctggtaaaccgaaggaagacaacagtactcggggagtgcgggctcaggattctgaacatagaaccagtttgcatgccagcctttgtttgaggttttgaagggcatggagaaatatttttggctcaaggttcctctgagttggaaaccagctcccccaacaacgcacggtttgcttttgtttggctggggcttggggaagaagatgcggcggaacaaagcgaaatgaggcctaatgcccagaaaagcttcgcatgcatggataaaattggcaatatgcactatggagtttgggttctagtgatgcaagctaatcccgtagaagttcagaatcccccggaagaatcttgaggttggaagagaaaatccgccatagaagaaatgagcaaataccacgatttcatgtgtatcgggggttgggaatgcctcaccaaatgccggtcgccacccgatgatttcttttgctggaagaacgccgtgcaccaccatctccttcagattatcttccgtcacatcggagggcgcccactgactctcgaagctttctctttcttccgccatgaatgtgaaatggatggtctgatttagttcgagatatggctggaaaaagatggggaatcggagcggtgaatgcggggagaaatttcgtgaagtttttgagggcggattggagcggattgatgaaccctagtttgcccggcgcagttttgcactgtagcaagaaatggggaaaatggcgagagtctcagcggggaagacgaagagacgtttttcacttcggtattattagggtatcgggagtactaatgggcctgggcctgtacagtacttcagcccagtcttatttccagcgtggcccgttgtgatccttagggacttaggcactttttgctttggcaatttgtgttcacaatgatgcgacccaatgctgttaaaatcctttttagtgcggttttataattctttaagaatt

SEQ ID NO: 60526 - DNA, 2201 bp, Oryza sativa
ttaggtggttaatgcaggcttaaagggaaggctgttattttgcaaacagttttgttttcaagttttcaacaatctaagtgtgtgctttccacaaccagagcgagacaagtctcagcttggtcgggaggtgagaagaacaaatttatttatcaagatttgcacaactcccagagttggcttcaaatctggttttttttcccaaaccaaaccaattttccaaacttcccgataatagtggtccccaaacgaccaatcacttccagggacacccggtcccgctgtcccccggacagctaaatgcttcccaagcattaggtttcccaaaccttaacaccttttcataaaacagggtaaaacaaaaactacgctaaggaatcacctcacatccgcccgtgaccgtgggcacggctgttcgaacagtttgttaacctctgcagagggggtacactttacccacacgacattactaacccgaatcacccagcccgtgtagaatggccacgtctggtgacctaagggctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccccgattagcaatttactcagccaggggcgtcccattccacccgtgtggtcgcactattgtatgctcggatgtaattccaaaggaatcggtccttagatgcgaccgcacaagtattccgcccaggaatggccttgtgtcgcgagttttatttttaaaactcattttctttcacaaggcaccgacccaggcgtcgggttttccaaagcttttgcaaaccaagttttacccaagaagttactcagattttaagtttgaaggcgaccgttgatactcgcacagagtgcacgaatatcgaggcgcaactagatggttacaagggaacatgatataacaattaacaatggaaggatcagatgcaacaagttgggtaggcccaccggtctgcctttcagacggggcaaacaaattaagtgtaatcctatcaatgcataatattttgcaagcaatataattaagttcaaatataggctcagtatgttcaagggtggcttgccttgctcagggtcttcacgaagcttcacgaatcttcaagatatccacgatcgacgaaaatccggtaaccgcaactatgctcaaacaaacaaaaacctaaacaagagaccaagaaaaagaccctatttagactaaataatagtgccattaaatagatctcaattttatggaaatactggaagtggaacggggtcaatcggacgattggatcgagagatacgaattttggaagtttaattagaatttctggcgaaggaagatatttgtggaacaaggggggattgattcatgaaatttatagaaataatattctcaagaatattattgaccgtctctgacgtgcgggaccaaaggaaatgatttataaggaaaatgattcatgaaattttggaatagagaattgttttataggatcaagggaaaaaagatttattaacccacgaaataagataaaatgatttactgaatttatagaagagagaattatttgtggaatattggaaagacattctcaagattatctttgactcattgacgagtggggccaataagaaggtgagagagagagagaggagcaattggagggagcaattgcggacttttagctcttcggtgtgtgagcaccggactcggaagagggagtaaaggtaaacttcctttgttttgttaggccgaggaggaaggctggccaatgggccaagcccacgagccaggggagagagggggagggggacgactgaccggctgactgggcaggggcgggcccggtcaatgccacgtgggcagccacgtcggatggggagagaaaaaggggggcgggaatggcatcggacggctcacggcgcgcggcggaatccggcgaacggcggcgagccgaagcgagcgacgaacaccggtggctagaggaggtcaaggcgaaccgattccacggctcggattggggagacgacgcgtgacgacggccggcggcggcggcgaagctcgccgggatgccgacgtggatgcgcgatgggaagggatg

SEQ ID NO: 60527 - DNA, 56406 bp, Oryza sativa
  unsure (1)..(56406): unsure at all n locations
ctccccctagccacctcagcatcgccccgccacgtcggcagggggacggcgccaaagaggctggcgccagccactctggcgccccaaaaaggaccatttttgggataagtttttctaggggtctacttgcgaaacaagtttttcaaaaagaccaaaatgtgaaaaatccagcaggcctaggcatcagtgccgcagggcgatgctaagttgctaacgatacacacataattgataggttcagatgaaacaaacaactgcaaacaactcatggcagcaattagtaagtggatttcaaaatcgcacgataatggcatgcgggtatattgctcgaacgtgttattacatgtttgatgatggaggaaatgatacaaactttggtatatgaatgattgatgtatgctatatgctatgctacaactgttgtacaaagagtgatctgagaagactggcaagatcacacgagtacacgacagaagcgcaaaggtcagaccgtcagagattttatctcaccgtaataagatacaaatgtattcattctatataaactaaaaaaactggtacaactctatcagatacagacatttgcttactacaaacctgtgttcttgacatttcacctgcacaagcatgtccgttataatgtcagaagttgcaacaaagttaattactacaatcaattactggtacatatcaagatacactaatatgttcatgctaggaaaacgtcagtattgaacccacataagcgggaagacaccatccccaaatgagaccctttttcttaacaagtattcctattacaccactaagtaacaaaattcttcatgactagaaataacataaggcttcaagaaacaggcataaacaagctacttcatgaaatttcaggaaactgcaaagatcgatatctcctaaaaaggtttacttagggtatgcttgatcaaatatttagcatatgagatgtacttttatttctcagacatgaagacaatatcatattttgaaaacaagagaaggtttcaagcgttgaaaaggaaatgaaaaactggcatttgctagtaattgccaagataatattgtgaaaagcaattttactaatcttgatcataccttacaaataaaatgaacaaatcttcatcagttattgctccaagttccattcttctctctaaagcagtcaaccctccaccatctttaatggttgttcttgcacccctatggaacagaaatccatttaacattatccatgtagtcaaacaaaaattaacagtgactaattggttttttttgttgtcctgaggaaaatgggaggacaaacacaggattaaagggattgtaataatagcctgaggaaaggaaaatgcttttttgttgctgtttccctctctgttcctactaaactgttgaaatgcatcattgatgatctcgaaaaggcacaactcacagcacaagtggtatgccaaccaactgaatgccacctgataggcgctataggtatgatgagactgaaaatgagacaaacctccatagaccagtggaccttagacatgggatgagatgactagtatgaatccaagtgtttggcgaacaagtcatccaattgattttatacaattttggttatattgataagattactaaagacattgtcaggaccccagaacatatcatatatgcctcagtgtctcattctgtacttttatgctgaatgaaacaaaaaaaaaatagcctttatgtaaagagttcgatacttcagcttggcaacagtggaaggatagctgtaattatctatattccatactgctagaaattcaatcctacctctttagcagatgcttggtaagtgcatcatttttccttcggacacaatggtgcaacggtgtccgtccatggaagtcttgcttattaatatccgcaccaaaaagaagcagaagctctgccattatagaatggccatattggcaagcaatgtgcaacagggaacagccttgtagacaaccttctggtttcccagaatcatcctttacatcacaagatgctggatcaaataacttcccatctgttactgaaggatcatgatgaacatcattgtttaactcatcatatatcatgttagggctcacatcagccaacacaagaatgcgatatgctgccctcacatcattcgtccttacagcctccaatatatcaatggtaatttgattggtatctttggcaataagaagcttgtcgacatactgcatagatcatttacagtaattaatgatggcacaacaaacagaaggtcatcagaatcaagaaaacagggagctctaaatcttccattcatacatgaagttaatactatcaaaattagcaatagaaactatttgaagcaaaaaagaacttgagggttgttgcagcctgcattactcgacacttcgttgcatatggatcacactacaaaagcttgtggtttccggccagccattgatcaattatgcaagttttagagttgaaataccaagggttaattgttaagtatgcaattcattcatgttctatcaattatcttcagtatttgtaccctgaccgcaacagttccattcttggaagtctctctttacaaatgagattcttctgcatctctgcagaatgaaggatctcctgaagcaatctgttgttaattggttacaaactttatagggtcttttgtttttttctcttgtttcttcctgtaattatttcctataattattctttcaataattgaaaatcacactgctgggcaaagacctggcagtactttcagtcaaaaaaacagtacagtcagaaaataaaatgataaatcaaactacaaatctggttgtgaaccaatccatagactgagttctggctccaattatatctatgctcttataaaagaccatagtggtggtggtgagtttgcctccgccaccaccaactaacatgtgggcccatgagattggtggaccccacacgagcaatttgattgctctcttctgtttaccatccatttgaaatttgagcaagacataagctacactcttttaattttgccttttaagatgaagaacatcgcttcacccaagtagaggcaagatattcttttactaagagaactcataattatgttttatattaaataaactgctgcaacgcatggctattgtgctagtaaagtgtaaaatggttacatcataaagatttcccatgatccatacaactgctgctaactatatataatatatgtgcatgtgaacatccccagcctcccaaaagatttatgtgatatcagtcatgtgagtcgtagctacagaactgaagctggatagcaaaacaacacatttataaaataaaaggcaagggttacattggaattcaatcttcaactagcacatgactaacaaggatatacatcaatatcaagaaagcattgctaggttcagcatataaaaggatggacagaataatttacctttgtctgtatgtacctttcctttattgaaaaagcatcagtaggtttaggcttttcaatgaaaagaatagcatcattaaactcgtttattctgcatacacatcaagaagaaaatagataggagaaaggagcaaacttagtttttccacacacaatgaacatgtctgatgccaatgccattaatgtatgaaatatattcattggcactatcagattaaaagagagatcttccaactcatctgtagaagataataaagctaacctatcttgaacgtgtgaatgaaattattagcattaacatttctaaatgatagaacaccttccttagctacactgattatattcacctaccataatgaaactgatccatttcagtgcaagacagaatatcccattggaaatttcaagtctgagttaagtcaagaatgctatagtccattacaaatgcggtagtgcagtattatgctccttaaattgacaataatccaatgagtaaaataaaagaaaataaaatgactaaacaatacatgcagaagtacaaaactannnnnnnnnnnnnnnnnnnnttggcaaaaagcatattggctgatgtttgtattagtcaatataccactacttacaaatttcagaagagaggtgtaactaggaagaaaattgtctaaagcatgaaggcaaaacatagttaagaaaatatacatttacatacacttcaacatacccttgatcttctttcggaagcatagcttcccaaatggaattagtgtagtcatttccaagttcatggaacaagtccattatcactggctcccataccttgacatctaatcgcaaggatcgaacctacatcaaataagtacatcaaaagcaatccttaaatatggaccacactactgctaaatctgaaaatcaaatgatatttgaaatctacaaatcacaaagtcacaagagagtgtattgcaaaattaatgttcttagctctgaccatcttatatgcattagaaaatacaattgaaaggtacaacaagaaacacaaatgagcaaaaatctaaaataaaatagttaatctttccatcaaattatcattaaggtattatatcaagtacatatagcattatcacaagaaactgtgactgataactacatggagttggtaatagatgcataagtatcaggatatgtgaaaatggttttggtagattgttcatgaaaaaaaaaacactttcatacaattatgtttttaatatttctataaatatatagtcagaaaataatgataaaacatgtgaattagatactgtgaattgcctaggttggtaccacagcctggatctcattttaagagtcgaaggttaacagaggttggagtcgatattcttatgatcttatccaagctttctgcttctaatttgatttattaccaccaatccaccattcctttttactcgatgttttggacattgacaaagtttacaacattacattaagccccaatcatttcagtaatgattaatggcaatagcataagcattaaactttaaatggttccactattatattacagttttatactactaccgtggctaagttataacttttatgagtttaaaattttgaagtgctttcctgtgaaagacagggtcaggtcaccaaaaacgtaactttcaatgaagtagcataaattagactcaaaaagaaagaacaagtgacagagttcacaccttcgaaatatggactccaagattcctgtgagccccagaacactctatacaaataagaattcctaaatttagagatgcccaatcaggatccggtgaacgacattctgcacaactgtcatttccaggaatattcctgagatgattgaatatatcatcatgtccctctggacttttgttctcctcaagagagagagaatcaacagaatttgcagaaccatgatgttccgcctctagatttccatacgacacctgggattaactgaatcagcatacgattatactaaattatcctgaacaatcgatagctcgaatatatgattaaaatgcactaaaatggagctaattttaaggggcagaacaagcactattactatattaaatgattattatgcaatggagatgcaacttgcaagcagtgtagcatatcaaagtttttcttcaaaaagcacgaaagactagaaatgaagtgttgccataggaagtatcgaaacctgtcttgggaatggtaaattaagcagtgatgcaataactccagtaactttctcaatccaatccttttggtcagcaccagattctgcctgcgattgacaaagtctatagtattaatatataaaacaatgcatgtatcatcaaagactagaaatttggtgtcacagaaaatgtgacatccgagtaacagactaaggctgtgttcgctagaacacgttcccaccccggaacagtgatcacggaaaacggaacggtccattagcgcgtgattaattaagtatttgctaattttttttcaaaaacggattaatttgatttttttaagcaactttcatatagaaattttttacaaaaaacacaccgtttagcagtttgaaaagcgtgcgcgcggaatacgatggagaagggttgggaacccttgggtccgaacacaccctaaaagtgttccaattacctgtaaagtgtatgctttcatgggagagattactctgaagcaaaatcttaggtcattttcttctgcatcaatcttaattgttgaagttcttagatcaattttgtggcacgaaagtgcattgtcaccctgagttggagccttttggttcaagaatctgaaacgactaaaaacaccagtcccttcaccagctgtttgctgtgatgccgctccttgcttcccacatgaacaaagagataaatataaaatacagaacaaacaacatgcaattgttcaatatttcaggtatattatgtaacacaattaaggtataaattcccaaataatacattttaaacaatccatgacagcccacaaatcgctaacttttattgcataccgattgtcctttattcccgtagtagaaaagagtcccgtgactgtcgagaacaaagaaccttctcttccattctcgtgaattttcagaacgcttaaagagataaccttgtttgattatttgaacctgccagaaaaataaattagtgaaagaaagcaacaaagcttaactaaaaaaaaggttgcatgttatatataattaaaatgtagtctggtgaattataaatgggaataacagggcattataatactagaatttgaaccaaagggataacaccatcgatctctttgcctagatacctaatttaggaatacatgaagaagcaatcaccatcttagaaataaaaggtgcttcgctcttaaacatcatcaatccctctgaagcagaacattgaacagtgatgcagcaagcttagccgtccaggtatcctagcctattatttatgattgtttactcaacagtggataatggaagtacctcgccattggcagttgactgcattagggcttcaatctttttataggattgaagaccaacaacatggataccatcaccactggtagatgtgtccacattactagccattctcaagttcgcaatttcctcttgagtcctatattcttgaattctctttgcaagtttatcttgttcattgatagccatttcttttgattgctgtgcatatgttagaacctgtatcaaaaccttacagttagcatattaatggttaacttatggtcaatggatccatgctgattgaaataaatgttcatcggtttaagaccaataggtcagataagagattactaaacctggtgaatgaatggttccatttgactcagtagttcatatccctagatcataaagaacaaaatcaagaagaacccaataaaccaaacaataataatcaatcgaattatagagtgaccatgcctgcttgaaatatctcaaatgggcatccatcactgcacttattgattccaagaactcatacttcttctttgcttcaatatttgaaagtgcgtgcacctgaattccttacagccaaggagaattattggcttggcaaaatcaataaaattagcaacactatataaaaaaatgttcatacatactaggttaaagcggcatcgttcgaaagctgacttggcattgtgtagatcctgcaaatttggaattagagatgttgtatagaaattaaataaatgatcacttacggaaaaaaaaacaagttgtccctgttcacctcctcaagtcctgtcactacttctgctctagtccctttccgtactgatacaaatttttcacgtgcctgacaagcaagatagcaacatatattcttatagggcaccacatgccaaaatgaagaaatatgcaaattgaaaactaggtaatcacatagctagagtgcaagatatcacctgatcataccccactgtagccctatccaaacgctgacgacaatcctatatacagtgcaggatgttagcctatagtattaactaattaatgtgttaaaaacttccacatgaacatcaagacagtagggcaggtgtattgtatttaagacagaaggacatccatatattgttcccattacccaaaatggaagtcagtgaaactcgaactacatttctaagatcacttcatgcaattttttcattgtcagaagcaaaaggcttgaaattcggatccaacaaaaagtcaagcacgcaagcaagtatccatgaagaagagcaaaacctgaggtactacctacataaatacagatctcagtagtgtgcttaattttttggggcaggaggttgtcaccctcaccttcacgccatgcaaatccacatcaatgaattgcatcaaacgttcactaagcatatgatcaacctggttgaggacacatactgattagaatgatagagattcaatctgttaagctagtaaaaataaaaagaacaaaaacggttcttctttgcaaataacccttttacagtgtcacagtgttatttgcatcaaaagggaactcctagtcccattcagcaatcttacttttcaatttcattaccgatgagtgacatggacgtatgaaacaacatatggagaaggagaatcctatgtacctataaagttcattcccactaactgcaattaaagctattttcctctactctcatcgtgccatgtcacctcaatttgtatatgccatgcaaaaaacctacatgttccaaaaattcctgattaagtcatcaacctgcaaatgatccggcccaactaccacgcttccttacatgctccattctctcatcctctcactaatcaatcatcatcacatcctcttctgtaaccgctgatgcaatggcaaggaatctgagtggaccgcactggtgcagacaaggtaggatgtgaggaatttaatctgcatcttcagcgtccatcccctactatatgccttcctccgttcctcagcgcacacctgccctcactctggtgctccatgtctggcataatgcgtagcccacaagtcctccacaccttgacacccaacaccatgggtctaccagagaagtaccgcacgtatgcttgagtttatcatcccatcaaatactacaataatcacaggtcataatacccacctcattcctctcccctatgcttcctcccgttgaatgctttggtgagtcagaatcaactgagtcttgtcacaaaactacagatttggaaacaaacaattgaatatatcttacttatttttttcttgtttccaagtgtttgcattaagcaattgaaggaggtacattcacttcgatttgtatttcatggaacatttatgttatgatgaaactggacaatctttatgtagagtcctatttattgcagttcaaatttggacaggaagcattttttatctaaaattaaatgcacattctttcaccaatgcaatcagaatgtatcaaaatgaaaaatgttactatgctatgctctttttttcgttccatcacccagctaatttttcatattaacaattgatcagcgtgttgcagcgcacagggtgccaattactccctccgtcccacaaaaaggatttctggaggagggtcccagaaaaaaaaacgatctgtacacaaaaaagtgaaacattcaatgactgactacttcacatcggtggtcgagaaggaccttatctcttcccaggcacacacccatctcgctcgagtctctctcattcaccatcgtctcgcccgttcatcaatgcggcgctccaacgatctccatctccatctccatccccatgcccactgcgccactgtctcgcgctcccctctcgctcctcccgacgaccttatgcgtccaccctgatgctgcaacctggatgtgacggctgcatcggtggcggatggatgcggtgcagaggagattcgcaagaggcaaatccgatgctggcaacgacgttagatggaatgcagctcgggtgccgccgcggagagggaggcgcccgtggatctcccagcactgaggtggtcaatgagttcgagaagcgtgccattagaatgaaccccatttgtattctttttccatctattcttcttttccaccgaggtttctttctgcccttcgaccttgttaactgtattgaattcttcttgcccttaggcgcaccgtggatgactgccaccttggtgaaggcggacaacctttctcttctctgttcttggttcttgttaatttttgcaggttaaataagagcatttcttgccagcatttatttttttcagatgggagatgttctcttttctttctgcaggtactagaaaatttcaaatttttggcgcttatttttgtgccagatgcctctttttttttcttatagtatgtgctgtgtgaattaatgggtggatgaatgaatgtagtaatgagggcactttggtctttctatgttattactaaatttgcattgggaatccaggattccatattttgtgggacagagggagtagtacataaagaattcaatggcatagaatagattttacctgagaacgaaggagttccttgtatgttccaagctccctaaaagcagtagtgaacttggacattacaggccctgcaacagaattcagaatttggatcttccacattgaaagctgaatgtgttcatgaacttcactttattaacaaatttgcattccataatttcagtgaaatggcattgcattaaaccattacagttaagaaacattgtgttatcatactacaagcctacaacatattaataagtaaaataaaagaagtacatagtatgtgcttgcttatgtctgcatttatatatattctaatgatctgttactgtgatctttccttaagagagggaacagacataaaattaaagatgtggtacataatcgataggagacaaaaggacaccaacgtggcaagatgtttagcaattggcaaggatggactcagttgtttagctatctatggatgggaaaccaggaaaaattaagcaacagatataacagagatttgatgaaattaacctccaatggcaacactaacaggatcatcttgaccagcaccaaatgcttctagagcatcggcaaatgttagatctcccgcgtatccttcatcaagtgatcccctgaaactaaggttatcagcaatactataacaaaacaatatatcgaacatatggttttttattatcgttgtctatcctaggaacaataggaactacaaattattacatgtaacatggtaacaaaaaaatattaatcctgaactagaaaagtaagaaagaagaatgcaaagtcatttattgacacaattttatccaataaacatttttgtcgatataaacttgcagacaattcatattggaccatagaaacagaaacaagttttgaaatcgtgtaattgtgtgcattgcagtaaaaggttgtatgctacagaaacttgatattgacttacatcggcataaacctagagtgatgtctttcttaaaccaaaaataataataataatcatgctacgcattctgcatcgagtgtacgcctgtgctgcaaagttagtagctcgcccaaaaaaaacagtagttgggagcttaatgtacatgaatcttttgcatcctttatgaagatttgaacaccgttgtttcagttcatcgcttagctgttccatagaattgacctgcaaatcaatggaaataagccgcaatcaatagcatatatgcatgtaaaggtctgtttaagatgaaaacaaaaggatttatcaggaaaaagagaagattcaacttgatagcacaagcaggaagcttgcagtccaaattatatattaaaactactaaaaccaatctacacacagccttcgagtctaaggcactgtttgattcagcttagaattattataatctggattattaggaataagctgaaacaaacagatagcttattatgatagattattacaatctataagccagattactataatctagtaatccactctaaaggtgtttttttagattattggatggctaacagctaacgaacagcttataatccagagaaacaaacagctcacagcttattctatgtcggcttattataattcagcttacagtaatctggctcaataatgtagattacaataaacttaagctgaaacaaacagggcctaaataataggtcactattttttctatggcttctaataacccaaaccagccatttgaactggaaaagaaaatcgtctagcttatttcgtccctaagtttttacaggattttatctcgagaaattagacgatgaattaaaaaattgttcaagtgtgtgatgcagcaataaaaataaaatggcaccattacaatcagaaatgcagcactgctcaaagatgaaaacgatcgggaaaggaacagagaacacacaataaatgtaaaataatattccttttgcaacctacaatgcactcatgccggcaaatcaaaaccaacctacggtattcgtcgaaaccaaagcggaatttgatatccattctactcaggaacaatcgcatttccgaaccaatcaacggccaataaagcatgcaatcaggtcgagatctcgccacacagaatgcgcccaacctcccaaatcccagcccaaagctaccacaatcaccccaacctccagctccaccccccctaaatcccccaccacgtacgatccaaataccaacgacgcggagccggaggcgagatctcgcccgaaagcaacgaaccctgagaggaccggatcaaaaggtgacacctcccgcgggcagggagagaagagagggttcggcggggcggcgcacctgcttgcggaacatgggggagtcctcgagcttggtgaaggccgccatgcctggcgtcgcgcgggggatgacgctgcttgctgcggcggcggtcgcggtggcggtcgaagctcgcggagatctggaggcgtgggcgggaggtgggaaggaggaggaagaggaggcgatcggtcgggtagttgctgcctgcctgtctgtcgcggtggcgctgttccgctttcgcgtaggcagcctgcacggttccggggtgcacgggctccgggctcggctgggccggctgcgtttctaacgaaggaataagttcagtttgactcctttaactagtgaccgaatctgatttgtatccctaaatagggatggcaacgggtcgggttggtcacgggtagagcaaaaccatgcctgaccccatgcccgtcgtcgcccgcccaaatcctacccactagggttagtgggtaaaactctatgcccgtacccatgcccgacgggcacgggtatgcccgtcgggtacccaatggatctcacatgaataataactcgaaagatatataatttaacaaagaaaaataaaatcaacaatttaccaaattatcaattatcaataataatttgaattacatcgcaacttattattagttagtatcacaaatgaaccaagagaagggggtataataattaagagataaatcgaaattagctaatacaaatgtatcgggtcaggcatgggttacccacaggtaaaaaatgaagcccggctgttgcccacgatgtctacgggtcttgggcggacaagcccacgggtaaaattttacacccatgcccgtgcccattgggtcgggtatccgcggatacccgaacccatgggcaaaactgccatccctatccctaaaccacaataccggatatctcaacccccgactattaaaaccggtgcaattgattccctcgatggttttgaaggacggtttcgctgacgtgatgcgtacgtggcggtgttgacttgggcttcgttccacgtggcgttgatgtggcacttatgtggcagtagaattaaaaaaaatatgtgggacccatttttcatccaaaaaaaatattgtaggacccacttatatgtgaagcccacatgtcatcctctctccttcccttcttcctcctccctttatctcccttccctccctttctatcctcctttctattcccctacggatgtacgcggggaacgggggccaaatcggtcgtggcggcggcgagcgggggccggaggggtggcggcaggtgctatagcagcgacggcgtgtgtgcgggcgtccggtatggggccatcaagtgagttgtgtgagagctcaaagacgacaaggttgtagctcctgctgaagccgaagcaggactgcaccgtagcaggtgaggagtgggtcggcggcgagctcgcggaggtgtacttgataaccgtgttggcatccgaggagcggtcgtcgagggggacggagtactgcacctggcgtctgagcttgacgcgcatgtcggccgcggcgcgggtcgccgcgagcaccgcggtgaggcctgcctcttgccctgaccctaaactagctccaccaccgcgattagaagggagaagcagggatgagaagaggagaagaggggagagaggagctgggctcctgtcgcccttacttgtcgccgagccaccaccaggattgagggagagagtcgcgccgccgccatcgtcctccttcttcgtcccctcccccctcagggccagggtgagaggaagagggagggagggagggagggagggagtcgcgccgccgctaccgtgccttcagggaggggcgccattgctgtcgacggcctcccttcgggcagatctaagatgaaaagggagagaggccggggaggaggctgcgccgaggagtggcgcgcctgccacaccaggggctcggagaaagcagcggctccggcaactccgccgctccgcctacttcccttcccttccgcccacgacaccgctccccgtttttcatccgctccgccgctccccatttttcatcggcatttcgttttccttccgcccacgatgctggcctccgtactcgaaaaagtgatgggaaggatggaaagagtgacgggaaggacgaaaaatgtgatggagtggcatggatctaatttctcaaaattccagtggcacctagccgttatcgcgaatagtagtgacatttttctaatttatcacatttccagtggcatagatccaattaaccatatatttttgtgtggatgacaaattggtcccacatataattttaattatactgccacatcaatgccacgtggaatgaagaccgagtcaacaccgccacgtaagcgccatgttagcgaaactacccttcaaaaccatcgtgggagtcaaattccaccggttttaatagttagggggttgagatatccggaattgtggtttagggatacgaatcagatttggcccctagttaagggagtcaaagtgtagttattgctctaacaaacccgaaactaattgggccatacttgtaggctgtgtatgaacgtgcaactactcattgtctacccctcattctccgtgcgtaccttgttcgagcggttaaacgatgtgtttttaaaatatatatatataaaagttgctttaaaaattatattttttttaaaaaaagctaaaacctaattaactatgtggtaataagttgctccattttacgtgcacgggaagagagttcccaaacctagctaccgaacatagcctaaagaatccgataacattttgatagttgggaacattgttttctagtttttcttttagaactcatgcactttatttgtttgaaagttttaaaaacacaaggcaagagtgattcttacatctccttttcttgatcggacatacactttgttggcaaatatgagtactattactacagtcaaaggccatctgattttgctctgaagtttgtctagttgctctcgcaggaccatcagcaaccttgttcatttctctaggaatccatttgatttgatttgcatatgttgaccctacagaatgttatttattttgtaaaatgcaggccttagggtccaatgtcctagctcattgatgaagtcatctattcgaattgcttcggccaccgtctgtcatcagatagaaatataggttgatgataatgatgaatatttggagcttcagacagaccttatatttctgtaacaagaggagctcctgctttggagctgtcttcttcgagggatgtgaataaaattccaagcggccttttttccttctcctttcttctgcgacaacctttttcggcttttcctctcagaaacaaagctcacaacttatgcggaaagcctctcaaatcccagtccaagtacttcctaggcctcattcggctcagccagacagccattatgcccctgtagccacgcccacgtggacgatggaggacgcgtgtccgccggcgacaagctctggggtgggacgtggatggtgggcccgctgccaccaaagcttcagcgtgaggcgtgacggtgaagaacctgctcaacatggaggacattgccaccagtgacgacgtctcgatgcccaactccttatacttaggtcctgtttgggggagcttctctcagctgcagcttttctcaaaaattgcttctgctagaaactgatccagacagtccacagcttctgagaatctgtagttacatattctgaaaaataaactacgaagccagaagctatagaagctgggtttcagagcttttccagattctcagaagctggctaccaaacagctgcttctcagaatttaaagctcccccaaacagggccttagtaagaatcacatgatatctggtaggtattgctctggtatcgacgagtattaggtgatatcgacgagtatgaacatatggtaccaactaagtatcatcaatacctataggtatcacctaatacttggtaggaatcgcctgatacctctcaagtatgatttgatacgtgataaaaatcgtttgatacctaataggtatcgtgtaataccggttagatatctggatagggaaggatatgataccttgtcaggacctcacttcgatgatctgttcactgtccaataacaaattgacacaagtagtggtgactttgtgggccataagcaggatcaatagtatagccagttgatagccccaaaaatttccatatcatttagagctatggttagagatacatggtacaatagtaagggtgtatgggtggtggatgagtccctttcacttagatatttatgggtggtctagcatcgcatcggattttttcagacgggcgtcataagcagcccttctgcccttctgtaataattcatatattttcgcaagtggatggcttaaggttccgtatgctaaaatatatcacagacggacaacttaagttgttcacatgcgaagttgcattttcgcagatggatatccattgtatccccgttcataactatacaggcaaacgtaacgtttgtggccgaaaatgtggcctgcctatataatgatatgggcctccttgggaaaaatcttttttctattagtgtatgcagcatcttctcagaggagttgggaacttgtcccattactcttttttttttctttcgttttcatttaaaaaacattggtgaggcggagatgtaaaccattttcattatctaaacaaaaaggtaagcaacaaataggggaactattctaaactcttaaggggttcttcgttgtttgcttgtcacccacatggttatgataaattagaaaaaaaaacaagataaattaataagtgataaattactccacaaacatgcaatgtcaaattttaatttatacaagttgcaataaaaataaatttaattgtgaatatatgttaagtagacattttttttcaacttgtaaaagttgaattttaacttacctgtttgtagagtgatctatcacatattaatctattttgttgattttttaaaaagaaattcataactatttggatataataggtaaacatggagagatgttcccgtacgtgagaatatataatccactctcgcagcagatattggcttatggatttgaaaattctggcacgataaatgtgatttgcaacaaacgaaggaactgtatgccgcggctcgcatgacccatcgacgagtaacgcggtaacgccgctccgtaccccggcgacctgcctcgacagcgccgcagcttcggagcacagcagttcccgttacccatcggcaagcaacaacgcctcatcccgtggaagtcaccgtgagcactacgatcctacgatccattcccatggcttgctcctagagtacagcaagatccgcaagatgtgctctgtggcttaattttctgggagttggatagagagaaaagaaaggcatgaagagggggataagacaggtataataagaagtttaaaccagcgatagcgcaaccaacctgacaaaactgatgagctgaatgaaaaaaaccagaaaagagagtgcaagccgacgataaaattatcgccaactaaacacaagctccaagactagagaaaccatagaaaatcttatccaacacaaacgtgggctccacacacgagatgatgtgcagtaatgagcgagtgatggtctggtggaaagttaaattagtaaaaagaaagagaaaatccatgaaataccattgacaagcactctaatcccagaaatgccattgacaagcgcaatttactcaaaatgccatcgtacaagcgtttttctcccagaaatgccatcacaaccatactgctgttaactcctctccgttaagttgtatgagaagacaatcttacccctgggcaaactttttgctcaaacaacatcattattttgtattgtttgctcacacaatatcattttgaattgatgcatatttaaattcacatatgtgtattattttgctatcaatcaaattatttcaaaattaaattcacaaatttttgcatcaaaattatttcagaaattttgctatcaattatttcagcctggggccgatgcgcgctgcctggagctgccgtgccgccacctgggagcaccacatcgcagttgagggccgctgcaccgccgcctgggagccccgcgccgtcgctgggggccgctgcaccgtcgcttggagccgccgcaccgccgcctgggggccgcgcgccgccgccgggggacccccgcgccgccgcccgggagcgccgcctcgccgcctgcaagcgccgccgtgtcgccgctggggaccctcgcgccgccgcccgagagcacctccacgccgccgccggggacccccgtgctgccgcccgggagcaccgcctcgccgcctgcgaccgtcaccgcgccgtcgcatggggacaccgcatcgccgccgtcgtcgccccccatcggttaggtttagggttgtcttttcttttccccaatttcttttcttttaccctctggatagtaaaatttggagcgagggtaatcttgtcattctggtaaaaaaaattctaacggtgtggactaaacggtaagttgactgtgatggcatttcagggagaaaaacgcttgtacgatggcattttgaggaagttgcgcttgtcaatggcatttctgggattagagttcttgtcaatggcatttcatagattttctcaaaaagaaaagataaattaattcattgaagcttgtatgtatagccatcttctgtacgtacaccatcttttggttatctgatgccgctgacatgttcttttttatcgccggtagctatctacacatgttaaacttgctctaagagtgagttcaatagagcatgttcagccggtgatagacgtacatgttaacatgattgatgagcttgagagaaaaatacatgaaagagagtgttagtcgatgatagattaagcgctcgcttttacacaggctctaacacagagcgctactttctacagttggctgagagagtggcaaaagggaatggtgggccctaataaaataaaatagtgcttctgttatcatcgtactgtagatttctgttctagtgatcgtttattcctccatctcaagatgacatggtaaaaattatagctcgctgttggttatattattgtattggctctaagaagcgatgaaatgagctaggagagagaagtagtgattgggtggtgctaccttaacgggtgtcatgatgtgatttggcatgtattttactatgtgcagtgcggtgcccttgcacctaagccgaacaacggtactaatacgtctatacattatcaccagtccaccacctcaattctcaaatgtcaccatacaagcacaatgataatatattgctctacagatacaacatggaagtagagaaaaccaagatacacatattcagggcctctttgaatcaaaggatttatgtaggaatttcataggatttaaatcctataggaaattttcctatttggccctttgattcaaaggattgaagctttccaaatcctatgaaattcctatggaatgacacattgtatgtagattttggaggaaatttagcaagagctccaacctcttggaaaatttcctttgagtctatctctctcatccgattcctgcgtttttcctgcgctccaatcaaacgaccattcctgtgtttttcctgtgttttgcaatcctctgttttacacttcaattcctgtcagaatcctatgtttttcctattcctccgttttttctaccctgcgattcaaaggggccctcagtatactttttttttacaacaccataaagacagatacataaattaaataaaaatagggtatgaaaatataggaaaaataatttagatgccttctaacaagcttcaaggagtcgaccatgctgttgcgcaaatttttatcgtggcaaaccaactgaggacgagagttcctgctccaacctgtaacttcttgtgctatattctgatgtaaaaccagcagtatggatgaaactgctttgagcatcagagctaatggtctttggacaaataaaaggctcaatctcttcatccattacagaaatgggttggcacttttttagtctggtagttctaagaaactgcaatctcatttctacttctttcatagtaggtctctctcctcctttagctttcaagcatgcttgtgcaattgaagcgatatcatcaatttcttcctgtccagcctcttccaaaacttgggaatccaagatttccatcagaactccctgctgaagtccttctaggaagcattgtgataagttttgttttgtacctacatcatttattaaaattggcttctttcttgtcagaagctcaacaagtatcactccaaaactatacacgtcacttttccccgttagttggctagtgttgtagtactctggatctaagtaaccaaatgtgccttgtaccattgttaccacatgagtttgatcgagtggtatggatctcgaagcaccaaagtcagaaacctttgcagtaaagttgtcatctaggagtatgttggaagatttaacatctctatgaaaaattggtattgcagcagccgagtggagataagcaagagctcctgcagtttcgattgcaatcctaatacgatcatcccatgatagaaggcatttagcacttacatcattgtgaagaagttcacatagtgtcccattagatatgaactcgtaaaccaataaaggtacctctgtttcaagacaacaaccaaaaagcttcaccacattacgatgaatgatttgcgacaagatggcaacctcattaacaaattgatctatctcagcttgctccactattttagacatcttaacagccaccacacgttgatcggataaaattcctttataaactgtgccatgtcctccatgaccaagaactcgagtagcatcaaagttatatgttgccttctctagttcctccaatgagaatatccttgttttgtctttagtattttcatctataattagttgttccaagagtaggccttggtttttcttgaaatatgcccttcgaattctcctctgtatacctctcttccacttggtgataagtatagttgcaccaagtgcaagcattacaaagccaagaccacaactaattccaagtgccatacctacaacaattatatatcgacaatagtcagaacatcacctataaattgcctcaggtagattttttagagtaattaagtattaaccactgagggcaattcaatagtatatataacttactaatgagcttagctgatgtcacacattcccttcttgttgggtcgaactctttcccgcgagggcaacttgtgcaattatagcctccaataaaattttgacatctcccattgcagtagttcggtagcaagcactcattgacatcttcaaacaaaagaaaaagtcagcatgcacttctcgaaacctttaaagtccttcgaattaattgctatgttactgtggtgacatatcacgtctacatgcaaactactccacgccaataatgcattattttatttttctcaaataaggcttaagagagataaaagtaacataacatggtataaaatggacagctagcccacaaatttggatgatccgtaagaaataatcatcttaaaacgatggtaagagagagagtttccgcacccgtgcaaccatcttcgatgtatggatttcctccgaagccaggagagcacttacaacggtagccaagctgtgtcccatgtgttacattgacatcgatgcattcgctatggacactacggcatgcataggaattgttattgatgtcttgcgtagcttcctggcaagtaaaactcacgacagcccaccacatcttcatatcattttcttgagttaaatcaaaaagatctaactgagggtcatcttccgaggagccatgcatagtacgagcaactaccatgatctctgtgccgttagaagttgaattgttctgctcgttggttacgctcatatatccattgtccactgaaatgttcctcacgagatagtctacatctcctcgatccagaaatagttttcctgctctgcagttaagtcgaaacttttctagcgcgtagcaaccttcttcaagcccaaatgggaagggcacatttgtatttccacaaaatctgttacatattcctttcggaaagggattgtaacctgctcaatgatacaggaaattaaactattatattatgagcaatgttcttttcacaaaaggagcatatatatatatatatatatatatatatatatatatatgggtttggttatctaaatttagtggatgccttaggctccgttcggtagtttgtttagttttcacaactctctcgtttactttgagcatattttttaaaatgctaaaattgtatttttcttaaaactatatataacttaaaaaaaagatttgctccagtccaacaaaaagtacctcgaggtccgtgaggtaccggtacctcgaggtactttttgttggactgagaaaatctcttaaaaataatatcatcttttaagttataataattaatactcaatttattatgtgctaatggttacctctgcgtgctgaaaaaaaaaactactactacttatattcaaacagagccttagactgaagatgcaacatgcatgtgtaaagttttcttcacttaagaattaaaaataaacaaatttggtaaaaccactgatattttgatcttgcaaaactacaacttttatacatcgtattagaaaactacggatttagcactaatttatcatgaaaatatataatttaaaatagggtatcgcaaaagtataaatagatttactaatgaagttatcataaaactacatatgcgcttcagagtttagacccttagcactaatgttctactggagttataaacattatatattttttagttaaatgagcactaactctgaaaacttttattacaaaatatatagttttaacatactacatcttaatatttttttgataaatttgatgttaaatttgtggttttgtaatggatcattttaaatttgtaactttgtgatagtttagtcaaattatctatagttttgtgaaatttatgcttttaaatttgtatggaactgatagaatatcaatactacctaaaatgttactcctccatttcatattataagaccttctagcattgcccatattcatatatatatgttaatgaatctaaacatttatatgtgactagattcattaacatctatatgaatatgggcaatgttagaaagtcttataacctgaaacggagggagcagtagtgatgattgttatgccgcaccacccctatcagcgatatttggacctcacaatggacaatctatactattacaccatcaccaccgacctggcaaataggctccattagttagcccgcaccccgagtcctctgtcgtttcactgttagatctccccaaaatttttaaccaatatttttttttcgaaatcattatgacagacaagagatccaaatagtgcaatttgatgatcatgtaactaatcaattcaatgtatgcacaacaaaaaatcataaaagtactaattatacttaattgacttaataaggtagaagctctacataaaaaaaacttctgcagcctttggtttggttagaagtctcaccagtacagccttcttgagtgtaaggaatcccattgggattaccatcggggcaatagcagtaatagccacccctgtccgcattgaagcattgagagtttctactgcaagcataggttgctttgttcttggatgcgctgtgacagtttggctggtccatgatggcaccgtagatcgtagtatagagaaagttgcttccgttgatccaaggggaggaaagatcttccgtgcgaaactaataagagtcatacgtcaagcaagccttgacactggattgttcttgcggcaccacctggccgatgccatcttgacggacaatccttagccgaaagccctgcacttccctcatcgtctcgatcgtgcagcaacctatgccgtcacaggtcccatttgcttgcatcatgtccaccgggtctttgaagcatagagtcgtgcaagaacccatggtatcgttcgaacagtgtcttcgtaatagatgaagaataaatatgataggtagagaagagagatgatgtatttattaatggcccactttaagaaatcatgggttgtagagtgtagtttctattatgatgtcctattgacatggcaccatagacactacttatggacactatgggttgggactacccttaggcaaaagaactactttaaataattgaagtggtcaaggtgatagttttgcacccacccctttcacataattaattaattacccaatttcccatgcaattatttggagtcaaattaaacttaagaaaatcattagaattgtattttgttatgcggctcttgtttctaattttgtaaatacaaagaatcgataaaaaaaaagacatatcagaatcttttttgaagggaaaacaatagagattgtgcttttcattaaatatagcgggagaaaaatacagccccttagggcaagaaaagggaaaaagctatatgcactatacagtgtgaggcaaaagtaagcgctttgctcctgccgttgcccatgtccacgcctcttccttgattttggcaaaaatgaaagacaacgtagcctcattatgctcaaagattcgttggtacctctccttccagatctcccaaacgacaaggaggatgagagtgcacagtcccttttttggaactcgcattgtgtttgctagagcttcccaccagtcttttatggtatgggtcgcctcccattgtccaagggtcaagctattggtaacactactacaaaaaccatctttcgtggcggccattttagattttcgctagcggaatttggagccgccacaaagtaaaggccagtgaagatctaatattttcgctgacggtttcgttccgcttgcgaaaatctattttcaaaagcggacacacgattttcgctagcggttgcggtccgcttgcgaaagtaaattttcgcaagcggacaaacgatttttgctagcggttgagtgtcacttgcgaaaacccattttctctggcggttgtttaaagagaaccgccaatgaaaatcaacccaccccgccaaaaattccctaccccaaattcaaaattccccacccggccaaattcaaaacaatccatatttagaaatgggcataaacatcatttaaacacaatccaaatccagagcatcacaaatacgtacataatattggcatcaatccaaatacaacattgacataatcaacagaacaaacacagattaacctaacaaacatccttacaaaccaaaacacacaaaaaaaacacagagaaccctagtcgccgaagccatcgggatgagccaccgccgctgccatctgccggtcgcggaaccaaaacacacaaaaacacgcttgccggcagcatcgcggtcatcgtcgtcaccacggtcacggtcgtcgtcgtcagctccgctgccggggacgagccgctgttgtcgccgccatccgctgccggggacgagccgccgccgccgacggggacgagccgccgccgccgacggggacgagccgccgcctcccgcgccatgtgctccccgcgccaccgccggggcagatttgcacgtcctccccgtcgccgcctctgttgtgccaccggcggcggcctcctcccctcagacagataggagaggaggggatgggagggcaggggcgacgcagggagccgccgccgctggtcgtcgttgccagagccgtcaccagtcatcgccgccagagccgccgccactgccgtcgctggtcgtcgcctccagagccgccgccgccgcagtcgccggtcgtcgccgccagagccatcgcctccatcgcaggtggagaggctgggagggaggagagggaggagagagaagaggagtggatgtgttgtgttttaatgtggagaagaggatgaggatgggtaggtgggtgttttaatgtgacagatatttttggttggattttcactggcggttctatttattggccgccatgaaaaattgcaccgccagcaaaaattatctattttcgctggcggcgcacctaattgaccgccagcaaaaatagacatactttcgctggcggctgcattagatgggccgccagcgaaaatgcattttcgttggcggccggtgcccctcaccccctcgttacaagtttgctggcggttttcacatttttccgccagcgaaatagaccaacgtcatgaaaaatcgtttttctagtagtgtaagccacccggattgctaccatgctacatattctttttgtgtatctgcaactgacaacaagatgtaaagccgtttcgccttctctatgttagaggggccaaaacccattattttgccattctctaatcgcgagccggtcgaaggtccaaaccctgttttggatgactagccatgcgtggaatttgcatttccccggtatccaaactttccaaatgagagagatgaaaatcttgtttggtgccccaaggtgcctgataagctgacgacgccgagtattggccatggcttgtgaacttataggtaatttgatcaggatcctcgtttaattggatgtcccgcacaacagtccataaggtgactaactgacctataaggtccaccgagattggtgggttggcttcaaggtctaagtcattgatccaagcattatttttcattccctgatgtaaggactttcttcgagattgcgttgaccaatggcatgaggtcttttggcctacgcccttctatccaaacggagtcccaaaaacgcatagtgtttccgtcgccgatggttacttttgttgacgcaaatcaacacatgaacatgataacttcttttagctttaatttgataacaatatgttagacagccgatacaacatccattgttttttcgcttgatgcgttttgaacatcgtcacggtcttcaatttaattcatatgtttttatccttacctcttatgctatgcgtgttttcataaaaaattaaaataaaatacaactatatgaaagactttttcataaaaaaaatcctataatatatttttttgcattttaatccgtaatatgttccatctattaatgatttaagagttattgattaaactctaatcattatgtcgttctattgagaacaaatttaataacatgcgggtcctctctcctctcccagctaatatatcttatttcccatggacgaacttaaagcataatattacgtttgtttgttcttacttataatgtaggatactgccatggtctccattatacttgtttgattgttttgcctatcctataatcatatatcataaaaatattgaaaatataacaacattaaagtattttatcacaaaactatagatacgttaaccaaactatcacaaaactacatatttaaggtgttgtatcagaaaactatagatttaacaccgaatttatcactaaaatatatatttaatgataagtaacacaaaactacatatttaaatactaaagttatcataaaactacatatttcgaagtttaaatccctagtactaccgttatgttagagctataaacattgtagttttgtgattaaattggcactaaacttatagctttgtgataaatttgttatctaatctatagttttatggtgttccatcctaaatatgtagttttgtcataaattagacgctaaatctgtagttttatgaaaatttggttaaagtatctgtagttttgtgaaatttctaatgatgttattttcatgtgccaaatattaacattttttatatattcgtaataaaaaaacttcaagattcgactatgcacatttaaatatatcatttgtttgagaatgaagttggtagagagaaattcggttatgcttaagaacagtgatgacgtaggctagattttaacttggtgatttgaaaagtaactgcaaaaatattgaacttgaacgatctatgaaaactcttaggatgcgtagacctttttcctcctcacatttttctagtgaacatccttatgttaccttgatgtgatttcatatgcaaaacaaatgttttctccggcccgtgagtcaaataacagatcgatgtaaaagccggtatatatgtcgagtgtaagaaatttaccctcactccatgatagaaagcaaaattttgtaaagagaaatatgtaatttcatactgtccaatgagttcaacataaagtttttacagattttgaaagcctagaaacaagttttgaagttctaaaattctggaccagccggcactaaacaatttctagaggaggctatgctcattcattccccttggtaatttttctggaggtcactaactataccaggaagccccacaaaaatacgaaaaatttcatctcctctgtggcccctctaaaatttatgaaatggttgatgtcctattgttctaaaaatcccaaattctagtcttctgaaatataaagtgtgcatcaaattgaacggaaatataagatgttataatttcttcaaatactagtttattttccatgaattaatatgctttagttttttatgttggtttttcaagatgttttttttcattttttgagtttttttagaaggggagcagttttttaagaagagaaaggaggacaactgtgtttctaaagcagttaagaataagaagataccgcgttcacgcttaatgtcgcctagtagctagttctgacgtcgggcctcatgtaattttcaaatacgacacttagtactatcatttgtactaggcgagttggcatattgcaaggaggacgacgttgatttgtgcagtttgtcgtactaaacagggttatgtaaatgaaaaaaaattcaatgacagcattgccaccatacgatgttaactatagccgtttggccaggtcatatcgactcgatcaaaccggcgtggtcagtacgtacggtgcacttctgttaacacagctatctctaggtgaaagcctatataaaccatgttttaggacggatggtttatcatttaaaccagctattcgtattgaagttatagattttaccggatgtgctaggcaacagggaagcataattaatgtagatcagcccttgcctctcccaaataaatcgagtccctacttcccaagaaaaattttacaaggttgggaaaaaggaaattgtcccttgttaatagaataaaagtagtagtattagtgagcgggtagatatggagaattgaagtactaaaacttctcgatttatagactaatgatagttataagttaaaaaaatcaacttatcttggaacatattttaaaccgtagaaattaacttaggctctgtttgattcagcttagaattattataatctggattattatgagtaaactgaaacaacgagatagcttattatgatagattattacagtctataagtcaaattactataatacgataatccactctaaaggtgtttcttttagattattactccctccgtcccataaaaaacgaatctagaaccggatgtaacatattctagtattacgaagctggacatatattcagattcataattctaagattctagtattatgtatgtccagattcataatactaagatgtatcatatcaggtactaggttggttttttatgggacggagggagtaggtggctaacagctaataaagagaaacaaacaactaacagcttattctatgtcggcttattataatccagcttatagtaatctagctcagtaatctagattacaataatcttgggacatatggagtacttcctaaactgacgattcgttcgcatactgattacttcatttctaaatgtaagtattgctaggttttcttacaaagatttagacagaaatattcatcttattggtcaaattacaaaaatttaattgtttaaattccccttctaagcacccaaatgctttgattcacttgcattaaaattggtgtcgaagaaatagttgtattgtgtacaaatttgaattataggaatgtttttaatggactgatataaggtgtggaaatttcattgaatataggagtgcaaagggagctttacaagtatggtgtggaactgtacaaaaggggaaagggagaaactagggaataatatctgtcgttttactgctattagagccgattaatttttacggccaaagatggcaccaatagctcttgtgatgaaccactctatgtttcctcttcttccatattttccatacaattagtaggacgagtgtacgaacatgcctttggcggggcttgtcattgtcggttgctagtgttacccaccatttgtgcgctatgttggttttgctccaccatctccatgtttttgggtttaattgtgcaagaggccggtagtgtgctgtgtgcggaggatcatcttccacttccttggtgttctcctcctcttcgctacttgggcctttctctttttttttcgaggaagagtagaaatatattactcaaccaaagtgccagtacaaactaactgagagataaaattacaggtttctcctaaccaaaaatcagaaacaaactctgaacaagccttattggctagcgcatggcttgcatatatggttctgggagcggtgtatcttctgaatgatgatttccctttccccagcgcggaggcgtttaacttcttgaatggtgtgagctagtgctgatagatacttctctttagactgaatgagctaagaggccaccaaacaatcagtctctactacaatagacagcaaagtccattggatcgccaaagcaatttcctccgcgcaggataggagttctacttgggcctttcttgaccccgtagtcatcaagagtgatcttgcccctaccgaaaagggaagagctctcctctgccaacgtcaagtcaaccccccccccccccccccaacacacacacacaccgtagagttcagccaactcaacgtgacaaacaaaatggtagatcctggcaccactagaaaaacagttttctacagcagaacacataatttttgtatgtgaacttatttttgactatgattgtccgcctccctagttgtatggagagatgtctaatagccacccgcctaggaaataaatctattttcgcaggcggatggcttaagaggtgcgtatgcaaaaatacctttattttttcaggcggacctcttaagtcgtccgcttgtgaaaattggttgtggcatttaaatagatgctagaggaaactgaaacatcagatatttctaagtcccaaccccctctcttctccttagttcggcgatgagggtggcgagggcggcggtggtggggaagggagcagcggtggctctccaaggccgtggcgcgcgggataatagacggcaacgcacctgggaggcggggatccagcgacgatggcatgcgtgggcagcaaatatggtaaaggcgacgcgcggcgaggaggattcggcgacggcgacacacgtgagttgtggatccagcgacagcgacacgcatgggtggcgggggcgcaccctcctcgcattgctcatggttgtcttcctcgtcatcatggtggaggaagccggcttccggatcggctcctcggcagcgacggtggcatccttcctacgacgatgaccaccaccacaacgtccaacttgatgttttttttcttttttgttgagaacttccaacttgctatgaaaaatacgggtgtggatttgaatgtgattttgaacgtgaacttccacatattttttgagaacttccaccacggatgtgtctttcaatgtgaatttgcatgccatgaataatatattgctttttatttttctttttgcacacaattcttttggcaagagttcctcttaatgggtccttctgcaaaaattgacttttgcaggcagacccatgaccgtctgcaaaaatcgacgattttcacatcttgctataggcagagtatttggccacatgcgaaaatgtgttttggccgcctgcaaaaatagcttttctagtagtgcggacaaaccttggatagggcaatggctcatccatggtaacggcaaagcttccttccacgtagccaggccgaatataatatcgaggcatgaaaatgggaagcgactcatttgtgcttcatgcgacccactaacagactgggggtctgtttggggagcatctagcagttatagcttctcacagaatctttaggaccccaaacagtccagattttacccagattctaggaatctgtagttgtagaatccggaaaatgaactagaacccagaagctagaaaacccggcttctctagattctcagaagttggctaccaaccagcggattctcaaagtcttaagctccctcaaacatggcctagaaacgttgtggcaagtatcccgattcgcgccatttcgcactaaatcgacgaatttgatacatgttgtgtgattatattattggattttgatgcacgtaatataatcggacatgcaacatcacattgggggacaatgtctattcgcacaaggaatccccctacgcatatagacttggactcgaaaaaagtcctccgccccctcaccgaagggggaagggaggttcggagtactgtttacaattccgataccacttttcatgccggacgctagtggcacatcgattttcgtgaagtccgatcgaaaaccgatagattctgaacaatatttgtaggcaaaaaaatgaattcgaatgccctattttggtcggtctgaaaatcaatgggctttaccgaaatttcgaagaggaaacaaggcgttgttcagctccctttgttgcagatttgtgggctatagcatcaatccaacacatcagtttttttttttggtgcctatcgctagcgagatgcaattgatagtgtagtggtaaaaggtgtgcggtttcaatcttaaggtcccgtattcaatccccatcctatcagataggatgactcctgaactattaaaaccaatgcaatttgactctcttagctgttgacctggtcttcatcccacgtggtgcttgtgtggtattagaattaaaaaaatatatatgtgggacttatttatcattcacacaaaaatatataaggaaattttgctacaaggcactgctattgtgtggttttagccctaggacaccgcaaaaactaacttttggaggaaaacaatccataattgtggtattttgccagtggacaccgtgcctggttttagccctaggacaccgcaaaaactaacttttggaggaaaacaatccataattgtggtattttgccagtggacaccgtgccgactaaaataataacttccaattgaagaggagagagaaatcgtgtgaaatgtcaaaaatgccaaataatatattatgggacccactgtcatcctctctctatctccaacccttcttccttcctctctctcttccttatctctctctctcttcttttggcaaaatttgctacaggacactcaaagattatggtctttgctgtgagacactcgaagatcgtgtatttgctcgtggacactgtaaaaatatggtaattagctgctggacacccctcccattattttattattttttggctgaactggagagagaaaggacgttgaaagtaccaaaatgcccccgtgccgttttgcttgtaaacgctggttgaaccagacccaatcccctctcattggaaacggaggcaatgagccggctgtcaggggagaagacgaggtcgaagacaccctcgccgtcatcgtcgtcgcacggtaagccgcgaccactgcatcccggtcgccgtgccgcatctggccaccgcgccatgccgcaccacactgcccgctggatggccggaatcgtgcatgccccgccaccacccagccgccgcacggccggtccgcgctgctccaccgcccctcggccggccactacaccgctgggctgcgtcattaccatcctcgtcgggtcgcttccatatccgcgttaccgtgccagcctgcacctgcgccacgcctggccacgaccgccgtatcccggtcgtcacgccgtgccacgcctgcaaagccgcaccgccaccgcacgacgctcacctagccgcgccacctagccgccgcgcacgcggtcctggcgatagcatcctatggcgtgtcggcggtgaaggcaacgtacaagcagctccagcagacgcaacatccctatgacgccgaggcgattcagtccgcggatgccgcgttgtcctccattgccattgccgcgacaatcggagacgaagacgggaggggcacgagcggcggcacacatagcagcacaaggaagaagaggaagagagagaggatacgtgagaatgacaagtgggcccatgggcaaacttgtctttaaccaaagtttatctctccgttttcatcaaaaataataaaataatggaaggagtgtccagcagccaattaccacttttttacagtgtccacgagcaaatacacgatcttcgggtatctcacagcaaagaccacaatctttgagtgttctgtagcaaattttgccttttcttttctcggctgtggcggcagcgggtgggacgacaggtgctggagcagcggcggcgaggaacagggcatcgcagatgggcgcgacggaggaggggcaatgaaacgaatttgggacgccgagatgaccaggccccaatcgaggggagaagaggcgaggcaaggcgaggctggcgtggtggtcgacggggaggagacgatatcgattcagcgtactggtgggaccacgtggtgctgctggtgaggagggcgtggctcggcgtcgctgcctgattcgaggttcgccaaacatgtaaggcgacgagagggggttctggtggggtggaggcggcgtacgtgggtataactctgacgatgtttttggtttttatggtcttaagtctctggaggttgcggcagaggtgagcacgtgatgtgggagatgctgagccgcaccagcacggctagggcagcgaggcgggccgcgggcgctaccactggccaggaagcacagccggttccggcagccgcgactgtggaccgagagtatctggctctgcgggggcttatagaaggtctctgccacggcctagtcgtcttggccctggggatgtggaaacagagctggcgagggcgcccttcctcgcgtgtacaaactcgtctcgccgcccctcctacatcacgctcatcggcgacggcccgctccaacatcccgttccgcttgctgccaccacggcccaaggggaaaagaaaagagagagatatataagggagagagggatgaggaagaagggttggagagagtggatgataatgggtcccacaatatatttttgtatgtgaataacaaatgggtcccacatatatactccctccgtttcaggttataagatgttttgactttggtcaaaatcaaactgttttaaatttgactaagtttatagacaaatatagcaatatttgtaaaaccaaattagtttcattaaatcaataatttaatatattttcataataaatttgtctttggttgaaaatattattttttttctacaaacttagttaaactttaagcagattgactttaaccaaagttaaaatatcttataacctgaaacggaggaaatatttttttttaattctaataccacataagccccatgtgggacaaagaggtcaacactaccgcgtgagtgccacgttagcaaaactgctctccaaaacctcttggagtcgttgtatccggttttctgatttgagaaggggtgaactagatttcggcctattaaagggagtcaaagtgcactttttccatctacaaaaatacgccagtgggctttcatcctaggagtggtccgtgaaaactggatccaacagcccaactgtgcttacgtttcggcctttccccgccatttgcgctactggccgtgctccccgcccccacgccggcgagcgcgttgcagccttgcaggcgaggcaagaaccaacctatcgccatctatcttcaagaaaaaagaagcatatcgccatcgccaccgtcgccgccggggccgagcgcgcgcagctccttcacggtggagccgacggtagctagcttacgctcgccgccgctcatgagcaaaagaagcaatgtgcgtgcgtcgtcggtgcgcggacctgcatcctggcgtccaaggtgtcgccgcgaacagctgcagctgcaaatctgcaggtgccgcatcacgtgtacggtgtacccggtactgggctatactactggctaacaggccggtgagctgaaacaactacttcctctatcaaaaaaaaaaaaaaaggataaaccttgagtttccgtgtctaattttgactgtccgtcttatataatttttttttataattcgtattttcattattgttagatgataaaacatgattaatattttatgcgtgacttgtttttttaattttttttataatttttttaaataagacggatgatccaatgttacaaacggaaatcagggtttgtcttttttttagagacggagagagtataaaatccaaactggccagtgcatcaagaatcaaacgtactacggggcaccggatgcctgagacacggcaatgccggagtagatataccgtcggcgtcgaccattgtctcagggagtcacagatgtgtagatttgttgcgtgttgtcaggcggtcaagatcctcgcttatccctgcctctgctgctgctacagtgctctgcacccatccaatgtctgcatccataagatttgctccccaggccggcaccaatctctgacgatctacgagcttcaacagcaagcagggctagcattcatcaattcaacccctcactcatagagtcctaggactactacactaccactgttcctgtcctgaaccgtaaggattttcttttgtttgcaagtcgattctactacggtcgcctattgaatttcggaagatcgaaattacatttcgtcaaggcagacacgttgctcactgtacatagatttgactctttaattcgcccccagcgaaggcttcctgtgcgttccattatgcgtgtacttgttcggtggatcctgcatttctgctatgctgttggacatgagagaaaaatggcgcgagccgaaaatttttagctgcggctccaccaccatgtggaggttaatcctggacgctagtagcaatccagttcttccccatggcgcgccaaaaatgcacaaccaagagtagtagtagtagtattctgcgccattacgccgatacggttggtagcttttctgtcaatgcatgcacgagattgcacttggcaacacagcaaaaggcagctatttctctctctccctctctctcacactaggaatcgagcaaaacgtttatggcacatgtaaacatgaatcatatactcctagctgatgaatcactggtggggttcacgcatttaggctttgttcgctagctgtgggaattaatcccagggaaaagcctcccacgtggggtttgggttgtcccctcaccccacacccaatccctccccgcgaatccccccctctcatccctctgtttggacagaggtgggattagaagggatcactaccattcactacacttcaaattcagaatgagtacaacatttttgaaaattcggataaaataaaaaaaactggaagaaaggtcacgaacgtcaaaataatctagaaatgataagaaaaaaattgatcatgaaaacaaaacaaaaattaaacgtggaaaataattctaaaaatccccaaaaaaataaaattgtagaattacaacatatgcactctaaacatagtccagaatttttaaacaatcataattttggatagattaaattctacaagcagtaaaacatccaaaataatcacaagttttccaatagatatgctaggaaccaacttaacattgatactacaaaaatctctcttcgttttcaaagaatctaactttcaaaatcagtctaaaactgaccactcttaacatcgtactcgcatacaatttctattgaaggggcactgcactattgcaacaatcaaaattcagtgaaaacagctttgttcaaatcagatctctctcattgagctaactggaagaataaaagttccaattgccattgtgcaaagcaagacaaaaattggttcttggaacttaataaatctctgtccaatcaaactcaataatatatctctgtctgatcaaacaagtgataattctgtagaaaaaattggttcctgcaaccataatagctacatgaattaagcagttaaggaaaaattatctttcatccatcgcatttcacaattcaaggagtctctaagaatcttgcaaaacaatccttccaatgggcacagctagcaaatgggccatggaaccctgtaactacacatccaaaaagaaacaagtgttagacactagacaatggtgattgctaatatgtaaactaattaagcaacaggtaaaataaacttgagcacaggcaataatacaattacacatcaaacacactgacacacacggagagaattactatactttaaactatgtgtgagaacataataatatgcatatgttttacaagattattaaacatgaaattagaggcattcaaggtggctacatgcataaatacttttaatctttcagcaaataaacagtctgcaatgggaggagggggatcaataatatgttcagattttgactagttccagaagtactttgtgtacttagttttgtttaaacctcaggtttgaagacataatttcctactcgatcattccacagaaaaataatatttttatcttttgaaggcatgcttttttgatgtaaagcttgtatctctattgctagaagctggacatgttatgtcagatcaaactgtatagcatgtttacttaaaaaggttgcatcctgaaagggtgatagttgtcacgcccagaaattcccgaatagaattccaagcagaatgtgcattaaaatccccgtccaggaccagccggggtacacaaacgacaatgttgacatacagatccacgtcttacaaacattgtaaaatcttacagaaatgcagcggaaaacaaaagataactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcatggatttaacaagggatagctaagcaggttcatttgcataaatactggcatttataaacaggaatttaatgcgaaaacagttgtaaaaattaaacagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaagtcctagtccaaagtctaatcatgttataacccaagctaacaaaggagcatgatatccaaaagcatggctgtaacaataggtatccatcccatagtgatattataaaacagtgcaatatttgaaagaaaacaatggagcatttgcaatataggatcaacatgttcaagtgacaagcatgacttgccttgctctgctgctggaggtacctcggcgactatttcgaagtacaccggagcgtcgaaagaaccggaatctagcgacatacaaagcaaacattgcaaacaggctataagactactgaaacagagaacaaaaccatttttaatggattctacacatttttcttgatttactgagacttgaatgggcttaaacggagctcggatgatttagttatgaattttagaagattcactgtgtttattactataaaagaaatccttaaataatttattgcgcaatattaaccagggctgacgtcagcgagggggcgcggcgccgacaggcggggcccaccggtcagcgaccgggagagagagaaagagggtggcggcttgcgggcccaccggtcagcggcacgggaaaaggatggggcggcggcgccacgtggcgaccggaccgacggccccgatctacccaagggtagatcggacggcggcgcgggacctcgcggccggggcgcgcgggcgcggcgcgagacggcggcgaccatggcgccggcggcgcggcgctcacacggcggcggcgcacatgcggcagcggcgcaaagcgacgaccgacggcggcggagagcgcggctagaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagatagggattagagagagagagatggaccatggcgatcgggatccatggccgaaggcggcggtagaggtggcgctcacccgtgcgcgtggagatgagggttccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttgcacggcgcgggagcgatggggagctcgggagaggtcggcgaaatggggaaaaagcgagagggggtgccgcgatgcttaaatagggggagagggaaccggacgtgccgggagcggcgggaatcgccggccgacgcgggggagtggggaggagagagaggcgggattcggttttcgaatcccggccatctcgggcgcgggcgcgagcgggacaggtaggggaacgggcgcggggaatgcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaagggagaagtgggccgacggcccacttgacaaaaaggagggaaaagagaggaaaaagaaaaagaaaaggaaaaaggattttccctggaattaacaattgcactttagtgatttttaattggttaaaattatttctagagctctgaaaattccactaaaaatcctgttaatgaatttcgacatgtagaattcaagaaaaattccacatgtcagatccgattattatttgcattactttcttagggttttctcctgatttcaccagcattttcttagggtcaattataaattacaattttgacttgggaggaaaacttcggggtgtgacaaacctaccccccttaaacggaatctcggccccgagattcggtggagctggtgaagaggtacggatgggcggccttcaactcatcttccctttcccaggttgcttcctcttctgaatgatgactccactgaacacggcaaaacctggtgaccttgtttctggttctcctttcgctagtgtcaagtatgcgaaccggcttctccacatatgttaggtcctcttggatatcaatgtgttccgaattagcctgttcttcaggtacccttaaacacttctttaattgggacacatggaacacgtcatggatgccgatcatagtggatggaagttctagctgataggcaacttctccccttcgttccaaaattttgtacggtcccacgaagcgtggtgccaacttgccttttgtctgaaagcggtgtactccccggagcggggtgacacgaagatacacgtaatctccggcctcaaaagttagctcccttcgacggttatccgcgtagctcttctgtcgagactgagcaatcctcaatctctccctgatgattctgactttctcttctgcttccgctaatacttctgttccgaacagctgacgttcgcctgtctgatcccagaagagaggtgtgcggcacttccggccgtatagagcttcaaacggtgccatctgtagactggcctggtagctgttgttatacgagaattccgcatatggtaagcttttgtcccaagctccaccaaaatcaagagcgcaagctctcaacatatcttccaagatttgattgactcgctctgtctgaccatcagtttgcgggtgataggccgtgctgaaatttaaacgggtcccatttcttcctgcagcttctgccagaactttgaggtgaactgactacctcggtcggagactatcttcttgggtaccccatgcaaacacatgatccttgcgaggtacaattctgccaatctctttcccgtataggtggtatgtactggtataaagtgagccaccttggtgagtcgatccacgactacccagattgaatcatgtcccgatgatgtccggggcagtcctgtgataaagtccattccaatctcctcccatttccattccgggatttggagaggttggagtaaacctgctggtctttggtgctctgctttcactcgttggcaaacatcgcagagtgcgacgaattcagctatttctctcctcatgctgacccaccaaaacttttctttgaggtcttgatacattttagtgctgcctggatgaatggagtactgggtctgatgagcttcggtgagtatcagatccttcaattccttgtcgtccggtacgcacaatctttctcccatccagattgtgccatgctcatcctcaaggaaatcccgagcctttccgactctcatgttctttttcaattctgctatttccggatcatttacttgagcggctctgacttgatccacgagcgtaggccgtgcctccaaagcggctacaaacccgtgttcaacaattcccatgttgagatgttcaaattcctgccgcagttcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggtttccaatcagataatgcctccagatcttcaaagcatgaaccactgctgccaattccaagtcatgagttggataatttccttcgtgtggacgcaactgccgcgaggcatacgcaaccactctgccctcttgcattaggacacatccaagtccgtgacgggatgcattacaatagacttggaagtctttcgtcgggtcgggcagaatcaatactggtgcggatactaatttctttttgagctcctcaaagctcttatcgcactcagctgtccatttaaacttctcatccttcttaagcaactgagtcatgggtcgggcgattctggagaagttttcgatgaatcggcggtaataacctgccagtcctagaaaactccgaatctgcgacacggtctttggtggggtccattttgtaactgactccacgttcgatggatcaactgctacaccctgggctgtaatgacatggcccagaaatttgacttccgtcaaccagaagtcacacttgctgaacttggcgtatagctggtgctccttcaacttctcgagtaccagacggagatgttgttcatgttcttcctcggactttgaatagataagaatgtcgtcgatgaataccacaacaaacttgtccagaaatttcatgaacactttgttcatcagattcatgaagaatgcgggtgcgttggtaagtccgaaagacataaccgtgcactcatatagcccgtaccgagtggtgaaggccgtcttcggaatatcctcttcccggattctcagctggtggtagcctgatcgcaggtctatcttagagaacactttagctcctttcagttgatcaaataaatcgtcgattcgcggtaagggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccatcctgtatggtctcttgtaaattggagcggttcccggtgccaagtcaatccggaattcaatctccctcttgggtggcatggtagtgaggttttcggggaacacttccggatactcgcagactatgggtatatcttccaattttctcaagttcttccccacggtgtccactgggatttccgtttcaatctgattcaacgaggctcctttctttggcgagactagggatttgtacaccacggtttctcctttctcattggtcagggtgactgtgcgattcgcacaatcgatgactcccttaaacttggtcagccaatccatcccaagaatgacatctaggtctttggattcgagaaggatgaggttggctagaaatggtgatctttggatttctattagcactgaagggctaaaactgactgaggttgaactatttcccggggtacgaaccctcattggtgtgctaagctcttctttccttagcccatacattcccacgaatttctttgaaatgaaagaatgcgttgcaccagaatcaaaaagtactgttgcagggattgagttaacagggaacgtacccagtacgacctctggtgctgcttgtgcctcctccgcagacgcgtggttgacacgagcctggataaaccttggcccggcacgcctgggcttcgggcatttgtcagcgaagtggccaagctcgccacagttgaagcaggaccctggttttgctcccgtctccttcttggcttgcgcgggctgggctgactgtgccggtgccattggtgggcgtggagctgcaccgcggttgggctggcctccctggtggttctgactgccactagtgccctggtggaagttgctggagttgaacgggcggtgctggcggacgatcatggtggtaggtccaccctgctgtccgggagtgaagcgcggtcggtgctgactgccttggttggaccggaactgcgccgcctttcttttcctgtccattttgttgcgctgatcctcctggcggattgccttgtcaaccagcctctcaaagtcggcgtagtccccagatatcagttggttggtcagctcatcatccagacccgccatgaacttctcctgcttctcggcgtcggtgcggacatcctctggtgcatatcgcgcgaggcgattgaactcatggaggtactctgtcacagtcctgttgccctgatggagcgcacggaattccctcttcttttgtgccacgaccccatctggcacctgtgccttcctgaagctacggcagaactctgcccatgtgacttcagtacccggtgggcgggtggccatgtggttgtcccaccaagctgacgcaggaccctgaagctggtgtgtggcgaaagcgaccttctcctggtcattgcactgcaggagattcagcttcttctctatcgcatggagccagtcatttgcctccatagggttggtggtgctggagaaggtgggtggcctgacacgtagaaactcaggcaacttggactgggggggagggggaccaactgctggtgctgctgttcggcgtgctgcatcatcctctgatgcatctgctgcatcatggctgccatcatctgagtctgatgtgccataacttgggcaagcgtcggattctcgggaagtggtggcggaccattgccagaatcaccgttggggtgcacaccatcagcgcgttcttcgccgttgctgccctcgcctgttgcgcggctaccagtcctggtgtagaccatctggagggaagagcagacggggaaaagaagaaaaacagatgctcaagaactaagctttattacaaaggaattaaaactgtaattgttctgatctgaattaaaacacttaaaaaggcaagcaaaaatccttattaagacagccatatcataggcacatgatatcgaccgtcgtctgaccccaaacaagcaacctacacacacaaactaacaaacaaaaactagacagtcgatgaactagtggaaaaacgagcctaatgctcggaacggctcctgcggtcggtggagtcgaaggcgtcctcctgctcgtcacccggtccctctaagcgactcctggagcctgacggatcggtctcgccgctgccgctgggagtagcagacagccaacctccggtaccactggctgaacctctggcggctgatgctggagcgaaggagagagtgaacgcgggagctggagctggagctgcaggaactgcgggcggaactggagctgctgcgggagctgctggtggaggtgggttcctgggcgcaagctggatgcgcacaggtgcagtcgtcctcttacggggcgtagtgcggatccggactcctcctggcgctggaaggcccttcaactgagcattctccttcttcaggcgcgctacctcgtccttcagagcgacgatcctcatgagcttcccatcgttcaaggccttggtcgccttgtgcaggtccgagtgcatcctatccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagcctggccatcatcaagtaggctgcctcctgacaggcgtgatctgctgtgcctcctgacgcctccaccgccatgttagcgaggcaagtccccacgtagccatggacctccaagcggacacggtaaggaagctcgccactgagcggtgggatggtcgtgtactccggcgcgtcggggtagcccactaccagtgtcatgcgtgccagctctgccacaaagtcgatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgggaaattagatacataataataataacgaacaaagcataaataccttgcaacccatgataccgagctaggaccgaatgcatttcacccatcaaatcccaactgactgacgaataaatcccaataattttactaaaaccctagactgactcgttttgaaaaactcactttaaacgagcgaccaagatttttcccttgaaccacaagaacagatccccattttcccggaacaaatccaattgcgaagaacatatgcaatgaaaaaggattcagagggctcttaggtttttccatttggcttgccctacggtcaaggtcggttctgataccaacttgtcacgcccagaaattcccgaatagaattccaagcagaatgtgcattaaaatccccgtccaggaccagccggggtacacaaacgacaatgttgacatacagatccacgtcttacaaacattgtaaaatcttacagaaatgcagcggaaaacaaaagataactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcatggatttaacaagggatagctaagcaggttcatttgcataaatactggcatttataaacaggaatttaatgcgaaaacagttgtaaaaattaaacagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacatcagagtggtggtattaaaccaacattatcatataaacctatagtctaggttttaaatgagatccccaatgtgtgctagttgaactaagcatggctaagcaagtcctagtccaaagtctaatcatgttataacccaagctaacaaaggagcatgatatccaaaagcatggctgtaacaataggtatccatcccatagtgatattataaaacagtgcaatatttgaaagaaaacaatggagcatttgcaatataggatcaacatgttcaagtgacaagcatgacttgccttgctctgctgctggaggtacctcggcgactatttcgaagtacaccggagcgtcgaaagaaccggaatctagcgacatacaaagcaaacattgcaaacaggctataagactactgaaacagagaacaaaaccatttttaatggattctacacatttttcttgatttactgagacttgaatgggcttaaacggagctcggatgatttagttatgaattttagaagattcactgtgtttattactataaaagaaatccttaaataatttattgcgcaatattaaccagggctgacgtcagcgagggggcgcggcgccgacaggcggggcccaccggtcagcgaccgggagagagagaaagagggtggcggcttgcgggcccaccggtcagcggcacgggaaaaggatggggcggcggcgccacgtggcgaccggaccgacggccccgatctacccaagggtagatcggacggcggcgcgggacctcgcggccggggcgcgcgggcgcggcgcgagacggcggcgaccatggcgccggcggcgcggcgctcacacggcggcggcgcacatgcggcagcggcgcaaagcgacgaccgacggcggcggagagcggcggctagaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagatagggattagagagagagagatggaccatggcgatcgggatccatggccgaaggcggcggtagaggtggcgctcacccgtgcgcgtggagatgagggttccggcgacgaacctcgacggaggaggggtggacgaggtggacctcggccgcgcgaagctaatggcggcgacggcgtgagacggcggcgagcctagcggcggctagcggcggccggagtagcaaaagcggcggcggcgggtggttgcacggcgcgggagcgatggggagctcgggagaggtcggcgaaatggggaaaaagcgagagggggtgccggcgatgcttaaatagggggagagggaaccggacgtggccgggagcggcgggaatcgccggccgacgcgggggagtggggaggagagagaggcgggattcggttttcgaatcccggccatcttgggcgcgggcgcgagcgggagagggaggggaacgggcgcggggaatgcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaagggagaagtgggccgacggcccacttgacaaaaaggagggaaaagagaggaaaaagaaaaagaaaaggaaaaaggattttccctggaattaacaattgcactttagtgatttttaattggttaaaattatttctagagctctgaaaattccactaaaaatcctgttaatgaatttcgacatgtagaattcaagaaaaattccacatgtcagatccgattattatttgcattactttcttagggttttctcctgatttcaccagcattttcttagggtcaattataaattacaattttgacttgggaggaaaacttcggggtgtgacaatagtgtaatgataaactgtgggagccttatataccttgttatggacagctacatttctcaagttttaacaaattttgctaaacaaaaagccatggagaaagattacctaaaaaaaatatcaataacagggtatgatctactgaagaagtgaagctaaatttttgcagagaattaactttgtcctcagcattcttataaagtgaaagtttgcaaaattgcagggtatgtttgcattcatgaaaaatgtacgggtagtgaaatcattgagaagcttgactgcctcatgtagaaagctacacaaaccactacaatataatttggaaaagagaaacacagtggaaattattgtgctctattatacctcactgtaaatcctgctgcagaaagataattcttcttctcaactgcctcaagccctaacgacttaaactctgcaattttccttcgattcacagctttgtcctgataaagtgagccataaaaaatatcaaataaatgaaatccttgcagaatacatgggaaagatatatactaactgtaaagaaaatattgtgaatattccaggaaagatacatttgattactcaaacgtgacattttaagcactcatggtattctacaagtattcatcttcagcattgtcaattgactttgtcctctgagcattcttgtaaactgaaagtttgcaaaattatatactaaggatcactaaatcggctgaacatttctatagagagcacaatatatatcatcagctgcctactatttctcttgctgcattccctatcaaccttaattctcaacataattccttaatccatacaaccactccatacatcaactagcaacaaatccatccactagataagtcacaaatcttttcagagtgggaaaaaaggagatcaagaatcagacctgcttcttgatgtccaggctattgtcctcgaccttgccatctcccgcaatcggtgaatccgaagcgagaaggagagatggcaagcagcggtgactgagggcgggatggagagcgggaaggagagcggcggcggctgaagcgggatggagaccggcggcgaccgagggcgggatggacacagtcggcggccgaggacgggatggagaccggcggcgactgaagcgggatgaagaccggcggcgaccgagggcgggatggggggcggcggctgctggagatatgctactcctagatctctgccctagagccgcctcccggacctcgcgccgcctccaaaccctagcgccatgggagtcgaggaagacgagcgctgtctctgctcggggaaaaaaaaatcgtctcggagatgatttttctttacccgggggtttggcgtggatcgggcggagaattgcccccaccccggcccaggcgaacgcgtatatggcccacggaagaaaattacacccggccgggatggcacacggggatttcaggccattcccccccaaacccagcctaaaagaacaaggccttaagggacaagatctcggtccttggctgtgacaggcacgcagggggggagggatgaggaggaggagtaaatacctgaccccctttggctcctccgtttgcagcaacaaaagatcgccgattcgccgcgcgtacagcgcgatcgcggcacgtgtgcgccgttccgtatccaaatcccgtggattcgatcaatcgatcgatctctgcactgcacagctgcgcctgcagaatctcgcgacaccttgtacttccatttttttttcctctcctaaactgcatggtgacctcaccggcaactacagccacctgtgtatatatatagacgccccaccgtggtggtgatggatgtgaggttttgtgcggcgcgcttgctcagcgtatcgatcgatcccacgagagtctgcgagagagagagagagagagcacgtaggagaggttgagaagttgagatgtcgtcgatcggcgccggcgcaggaggagccgtggtgggggcggccgtggcggcggtggcggtgggcggcggggcgccgccgcacgtcctcgccgtggacgacagctcggtcgaccgcgccgtcatcgccggcatcctccggagctcccggtttcgtggtacatgtgtggttgatgcatatcagttttgttttttgttctgtttgtggttgctgctgttgaaaatgttgttttggacgtttttctggtgcagtgacggctgtggatagcgggaagagggccctggaactgctaggctcggtacgcctttgtttttttcctgaacttttggccttgttttgcatgtcaggttgcggtgatatgcagccgcaattttctcatgttcctttggctcgctcatcatcttgcaggaaccaaatgtgagcatgataatcacggactactggatgccggagatgacgggatacgagctcctgaagaaagtcaaggtatacatgcatgatcttagattgtcctgcagaaagcttaattactttgattaacaggagaatcaatctgacgacgcaaaatcatgaatcgtatatgcatgcaggagtcatccaagctgaagaagatccccgtggtgatcatgtcctcggagaatgtgccaacaagaatcagcaggtatttttatccgtttataatatctctattgattagagcattcttatgtcttatccatacagattaccgagcacttaaccattgttcttccatctttgctctgttcgattggtttattaaccagatgccttgaggaaggcgcggaggatttcttggtgaagcccgtccggccatccgacgtgtcgcggctcttcagccgcgtgctaccatgagcctcgccgccgccgctgccgactcaccggccagccggcggcgcagtcacgcacggcggcggacgcattgtttgtttcggagacttttgaaagagcaggagaaacggtgcaaccctgccttgatcacttgacgaatgaattctccattttttttctcgttggggtcgtcttcttgtctttgtgtaacttgttgcaagctagtattaagacagagggaactactgaactattgaacagagcatatggtctctgtttctctctttttttttctcctttttgttgctttcagtttcttgaagttaatttaaaggcggtgacaatggagttcctaacttgagcctaaatattttcctgtcagtcaagtcccgtttgtgatgtgtgtgtacgtgtatcgatgagcgtatgcaatacgtcgcgcgtacggtgggagccctggggggatcttgtccccgtcacaggccgttggtgttcttgtgcaaagcgtatccggcgatatcgttctcgttccagtacagactcggggcttgcagagccatgtgcgatgtgcccatgtcgtcgcagtaatgtacagtagatagtagcaacaagttctggtaattctggctggctcatccgctgtggtgatacggtccattaattcctgccatttcaagttcataaaaccatcggccagctggggattgggattcggcagcgtacttgccaaatgcaacctggattttgttcttcaggacatttaatactccctccgttctaaaaaaaactcaattcctgggtttctgttaggtccgtatctaacgtgttcgtcttatttgaaaaagttatgaaaaaaattaaaaagataagttatgcataaagtattattaatgttttatcatctaacaataatgaaaatactaatcataaaaaaagcattattaagtctttttaggacagagggagtaagtttgatgatgtcgattggcgaatccgctactgtttatttgccgctacacttcgtagtggcaggttcatttatactcggaataagatcactttgactccctcaactgaccaccgaatctaaatcgtatccctcaatcgcaatactagaaatctcgaccccctgaacttgcaaaaccggtgcaatttgactccctcaccggttttgggaggtggtttcgccgatgtagcgccatgtggcgcctatgtggtga

SEQ ID NO: 60528 - DNA, 2884 bp, Oryza sativa
tacaagctgagttgctgctgggaagaacaggaagacccatcatgtggctgttctgtttctgtggtggtgtattgattgtcaaagggaagctcaatcaccatttgttttttttttttttgccacctgaaaactgaatgacagatatatcctgtcccacagcaaatgaattcagtttgttgtctgtaaaagggaaagtgaagcaagttttgcatgagacagattctgaattcttcttcatgatcacggatactcaaaattatgttcagcctactcatttggtagaattcagaacatttgcatccccaaaccatagaaggttgtttataagagggaaccgcaaccagttagcgcattatttcctcaccctttttttctttggaaattcagcttataattgattcggtgtgaacttctatgaaaacaagcaaaactatggtctccagtaacaaattgaattgtgttgcataaattacacaacagtacacctgaagtactcgtttctaacattctgaatgttgaactgcaggaggctcctgatggaagagctcaagaacattgttgtctgctaattatggaaaacaggcaagtagttaaagtagacaaacacgcaccttacttatcagcagttccaattcagcaacaacatcatatataggttccttgagacacagaagtgaaggaagaggggcatgggccatgttcatttcagattatatagagatcatgttgtccccatgaaatgaaggtggttttccaatttcggtagctaatgtttggtagtgagaccagtgtcgatgtaaactaaaatctttgtatgtatctttctttcagggttcagattgctccaccgttttttggggggatattcttgatgcaatataaaaaaaggcgaatattagggatggcttgatgatctaaggctcccgtacatgttttttgcgagaaagtagctagcgagcccagctagaaacaatccttcttcttaagataatgagctaggaacatccttttatttgtccatctgtagttaactacaatgccttggcatcaagaatctccaatcaagaacacgttcacactataatgtgtctagcagcagctagcatcattatcctaaaaaaatttagctacatacataaacatttaaaagagtaaagtgtattgctggcacttaaatttgttcgtcttatctaggtccttgatattgttaaagtgtattattttgttctcaaattaccatgacatctttgagatcctatatggcactcacgtgtcaaattaccacgacacctttgagatcctatatggcactcacgtgtcatgtcacacgggtgttaactcattttctttatatttttctctttccttttcttctcttcttcgttcctactcgtgtgggaaaaaaatgagaaaaagaaaaagaaaatttaggaccggaatatccgtgtggcatgtcactttagtgtccatgtggcataccttgtaggatcccgaagaggtcttggctagttaggaccggaataacacacttaacaagctgggggatttaaaaatacattttaagagtttggagatctgggatgtcattgataaacaagtttagagatcgacaatgcacgttcgtcttgtttaaacaagacaattctatttttaagataatagaagcttaattgagctcatccaattacatcaaagtgatataactgtattgagaacactctcggactttgcataactaagttatgcataaccaaaatacacacaatgtggttttaaagtgaaagcaaatacaaaacacggggagaattaagggccatcaatcttaaaactaataaatcgctacccacgtttctgggtaaaaaaaaaattccatgctccaatctctaacatgccgcagtagtaaaatcaatctcggtttaccatatgctagcgacagagaaagcatggttagtgtagctgtctacccattttacacttagcttcactcaattggacagtctactggtgacatcgatgaacttacatccaacaacatactccatccgtccttaaaaaacaaatctagaattagatgtgacatatcgtagtactatgaacctatatatatctaggtttatagtactatgatgtatcctaaccggtactaggttgatcttttataggacggagggagtatatactatttcgcagagcacacactgggaaaaaaaaaactaaaacattaaattttggaccgaaagactaaagcatttacggcccaaataagcagacgtgtgtatccggcccacttaaaggttggttggtctcttcttcttcctcctccatcccctttgccctcctgctgcgccgccccaactccggcgccgcaacaaagccatggccaagaagctcggcaagtcgccggtggcgaaggaggaggacaaggaggggctcttcgcgtcatgctccttcaccgacctcggcctccaccccaccctctgcgctcacctccaaggtagtttttccccttcgacaagccatggctggttggttcttggatcgaatttagagcagaccattaccgagttgatgtcaaaattttactattctccgacgcctctgactgattttattttgttatctcgtccaacttccgtgacaagtttcacagcatgctagcatagggtttatgaacggaaatgaagatatatatattctttttattatagcttggtaatcaaacactttggtcgtctctttgatttagataagatgggcttccaagcgccaacaagaatccaagctcaggcaattccagtcgccatgtctggacaacacatgtatatgctcctttttcacaataccataactcctttgattcagagacttcttttttttatttaca

SEQ ID NO: 60529 - DNA, 13638 bp, Oryza sativa
ttgtaatggtttttttctgaataggcaaatttgcaatggcatggatccaattaaccccaggttcaataggggaagagaacccatgtagtttgagccatagaaggattatcttgatacagtttggatgaagggcagacatcacttattcactttcaaactactgtaagggatggaactgtttggtaattgggttgtgtttaatgataaagcaaagacacagagagaaacttgatctgaaatgctctgcatcatgtactagtaaaatttaagccctatctgtttgctcttagcctctgggaagccacagctctcagaaatggactatcaacaatgcatcaatttaaacactgcatgactagggtttcaagtttcacttttcaatgtatgaaatttcagccaagcattatttcaaaatgagtagaaaaactagctcatcagacaatcaccagcatagtagaacactcagagcagccagaaatgtagtatcaaatcaaatcaattgcttaaagatggacatcagcaaactattccaagagcaacatacagtacaacagcaaagtgtgctatacataaatgtacatatttttcattccaacactgcagtacttccaatgtgtggtgattacccagtgcttaataggctacatattatacactagattagtatcatggaacaaaatttctcagagaacaataatatttaaaatcacacaactgttgtaccctaaaccaggttacctagatatagtatattgcaataggtgctattgcgctagagctggaaactaccagatgcagttggagaacaacatgcataaatctgttgctccccaactgttactcctgttatcgatcaatcctggggttatagtagcagaacttacataatagaaatcagtaataaaagatgaaattttgttgcttaataggaattagaacaaaattaatatgacgattgaaatgtcctacctttccctcacgcagacttggatgcgatcattccggtcttccgggcataggcaaagatcccgcctgcctcaataaccggcccggcatcgccgataggcttcagcttgtactgcttgccggatgtgtggttgatcatgacgcaattatcaagttccaccgtgaccacatccccggtcttgcactccttccaggctccagtgtccgctagctccaacgggtagacctcaccggtggccacggagttgcggaagaagatgcgcgcgtagccctcggccacgacggcgcgggcgccggcggcgcccagggcgacgggcgcgtgctcgcgggaggagccgcagccgaagttggcgccgccgatgatgacggcgtagcgggtggtctcctcgccgggggcgacgaacggcgtcgggtaggccccggtggggaggccgacgaaggcgaacgagccgagcttgcggtactcgtcgggcttggacgggaccagggtcaggtgctcggccgggatgatctggtcggtgtcgatgttatcccccacgacgaagcactcgccgtggaatacgccggccgacgtcgagtcccccgccgcagcggcagccgcagccgcggcgaccacgggggtcaggggacgactgtggtggcatttcagggcgggccggcagatagccgcgacccagctgcggcggcggaacgtcctcgagggcgtgggacacggtgccagaactgctgtcaccggcgccgcctcggccaaggatagagccggagccgccgccgccgccgccatggtgttcagtgtgtgagggagaacccgaaccgtgagaggcttagggccggggaccgtgaagcaaaagaccattatgccccttctccccaccggccttgggccgtaacgagatcgtgggctgcgtgaagccccattattattaggccggagcgggatagttgggccagaatgggagagtgtggcccatggctgtcgtcagcacagcacacgattgttgtgctgctcagactttacgatttgaattctgctccgattttatttttttcccgactagaagaaatgtccatgcgttacaacagataaatgctattttaattttattactgttatacggtttatttaaagtaaaattcactgtgggaattcgtttggatatatattttcttagaaaataatgagctgcagttaggaatctgatcgtctaaagttagcatgcgagtttttttaagggatttctatacgactcctttgcatttctaaaagcaaacgaacttaaaaatcgactcaaatacggatatatattttcaaaagcgaacgaacttaaaattcagactcatatacgaattacgtaacaaaataccagaaaaacatcttcaattttataatagtacagataaaagttgtgctccgattgtgcatgcatgtgctgatttggagggagtgatattgctgcagttttttagctgcatttgaagactcactttttttttcgattttaaactttgatgaataatggataatcgagtttaaggttgtgttctctaaagttttgatggataatgattataaataaagtctataacatttcacataaataagagatttaaatattagaaagttgatttaaaagttcttttttttaagacatgttggtaaagaaagtttttgtaaagattatgccatgtaaacacttagcaagctcaagtttttgataaaatataaggagagaactccgcgttgggcacccgatccgggaggaaaatatcgggcactagctacaccatcttatctgggcaaatttgcatgcgtccgttggattgaagaggctctctccatgcggatgaggtagatttacgctcaggcacgcagcccaagaacaaaatattttaaactttaaaatgttttttcttgtaaaatatttatctcatttatgatccgagtacaccgttaaattcgttatgattaaatctttacaacaagaccacacatggttatattccattgaaaacaatatttatcttcttagtgatttttaaatattgcaccacgttttataaagtttcaactactagtattttacgatgcttcacctgtttaatttataagcgttgcagttggttttcttttagtgtttcactaagtattttataatgtttaaacagttagtacaacttaatattttacacatgatatagaaaatgtttcaataacatcaagcttcagacggttaaatatttcagttgactaccggtgaaacattgagatatacatggtaaaataaaaaatcagtcactgaaacattattttttttaaacacacagtgaagagacacattgaaacatattgttatcgcgtatgaaacattgagtgttaacaaaccgaaacatatggggtttttcatcatagtataatcatatgatatcttgttgtaaagatttaattgcaacaaatacaacgatatgatcggatcatagattagataaatagtttaggagaaaaatcattttgaaggtcactagatgcatgcaatctagaggagagagagaaagtatgtgtagttaattgtgtgaattttatgaaacatggtaaatgcgtacattgaaccatgtccatatcacgcatgaaccattgagttttaatagtttgaaatatatgtttttcttttatcagaatataactatacgatatattgttggaaagatttaattacaatgaatacaacggtgtgatcggatcgtaaatcggacaattagtttaggaaacaaatatttaaacaaaggatgtgggaagctataaactagctagcttctagctatagcttcgtgcatgagcccgatttttgttggctcaatcaatgtaccgattcaaggcattttctaaaatataatcatgtaatatactgttgtaaaaagatttaatgtaacgaatacaattatataataaaactatagattagataatagtaaattagaagaaaaaaatttaaaattttgttatggaaattattatagagagaggtcagagagacaacgggtatagtatcaagccaaggacacgagctgcgaacaaaaggggaggaagggcacaagatgttttgcgttttatcaggcgcatgatgcgtagtctcctaaaaaaaagtgaattggggaaaaagtggccgccctcgtccgctgcatggatccacgccctagccttgcccgttgatggtgggcgggcttcgccggcggcggggtggagatggacaccgggaacaaaggcacggcgacaccggtgctgctcaacgtctacgacctgacgcccgccaacgattacctctactggctcggcttcggcgtcttccactcgggaatcgaaggttcgattacatgcattcttctccgttccccttttatctcttgattgggccaaatcttcatcgtgttatattggtcgccactctgttgcaaaaaaagattgatgttctatttctcgaacaaattatcgatcatgatgatgctttgttaaaataaaaaatcattttattattctgctgtaggatcaaattagatgtttcagtacctattgcaattaattgtagggcaactcagttttgctcttgctgatggacgtacagtaataatggggaaaggggaaaacagagacaatgtaagtcttggtagcaaatggtagcaaaattggaaggataattatgcatgtagttagtttttaatgctatttttcaaaggaaaatgatcacttatgtcagaatctcacgaagggaaaaaaaaacactaaaccgtggcctgccaagcagtttgcaatgcataggaacctcaaaatgaatcatagccctatttggatatatgatttctactatccggctaaagcaagcacggcgcgtttaaaattttttttcttatcgattatatttccctttttactatctgactgtcatgtcgtgatctaggtagttcacagaattatgaactcaagttgttatttatttttcttgtctcaaatgagcagttcatggcatggaatatggatttggagcccatgatttcccatcaagtggtgtttttgaggtggaatcgaaaagctgccctggctttatatatagaaagacggtgtggctaggcacaactgacatgtcccatggagagtatcgctcgttcatcgaaaagcttgcagggaaataccatggcaactcatatcatttggtttcaaagaattgcaatcacttcacggatgatgtgtgtaagaacttgactggaaaacccatacctagctgggtgaatcggctagcaagagtaggttggtattgctagcatgtgttttacttcctgaattggtgaacatcgtaagcaattgaatttttttttttgattgaatctgtaggttcattttttgattgtcttctaccagaaagtgtccaggtttctcctgttgggcgtgtcccaactcttcgtccagtagctggtcagtatcttcctaatttttccctctattgtttccttccagaaaaaagaaatcctctgttattattatatgtgatgtacaattggtttttgttagaaatttattaaccaccagttgcagtcgattgattggtttcttttcatgatccagatgatgatttggattcaatatccacagttagtgacaacaatgaggaggacaaacacttgctgccagcaccgtcgaatgacctacattccgtagatgtaccattaaagttagccaaagatgttctttgaattgtttcatattttcacaaaacatgccatattatcatcgcaagtgctgcagtcggggtgctgaattgtttctcgaggtgacttcataggacaacaccgttgagcagaggttcccgttcgtgatactgatttcttttttcagagtttcctgtccaagtaggtacactgtatacaaataggaattgcccatctttccagctatttgttgtttcactatcgtacagtgagattgttgtatcgtccttgctacttttttatggaatatcatccatgctactttggtagcaatggtatgacattagtccatatgtcatggcagagctggaatagacatcgtactatggctatatacttatatttttctattagccttgtgtaaaaattgcttgtatgagctcggaaatgagaatacacactataacttactatcattttgcatcattgcatggtcaatgatttgtgtaatcatgattggttttgttgtagtgcagatgaggacaagaggctgccaaacctcgattgatttcaataagctacacatgaaattataaataggttgtctacataataataccagtgagttccttgcaaaaaaatattatcaatgaattacaatagattagagattatgattagaaattacaataaaattggtccatcagttggcgcgcttgtttattccttgcccttagcccatatatgtaatttgcatctcctttacaatctaggatatttatatgattattacaaaaattagttaaatgaccataaaactctttcgtacaatatattaatggttttgaaatttctaatttaatatgcaacggatctatcccgaagttccaatcatagtagagaattccattatattttaaaatattaaaagccctttaaatttcctcttttcatttgtcatgcttactagtaaaggtactattcacgtccatgtttctcatatcactaaccaatatttagataaaataatattaatattagtgtaaatattgtagtcatccattgtctagttgtatagtaaccgcacggcctatttaatccaaataatatagaatgagatatttcatccaaataatatagaatgagaatcgagtcactttatctaggttcctcttctcgatagttctgcactattcacgtccatgtttctcatatcactaaccaatatttggataaaataatattaatattagtgtaaatattgtagtcatcaattgtctagttgtatagtaaccgcacgacctatttaatccaaataatatagaatgagatatttgatcgaaataatatagaatgaaaattgaaaataatattaatattagtgtaaatattgtagtcctcaattgtctagttgtatatagtaaccgcacggcctatttaatccaaataatatagaatgagatatttgatccaaataatatagaataagaatcgagtcactttatataggttcctcttctcgatagttctgcttgaagttatttctttgtttttttccacaaagcacacaatggatctttaaaagctagatgtgctcaggttcaccaaactgttttggatggggttaccgccaccccatggtaagaccccacggtaagacggttatcgtggtaaccgcggttacagtgaggtataatgtcacaatatatttgtaacatattttaaaaacatgataggatttgaccaaataattatagttttgtgacatttgtactaaatataattattgtattatgtatatacaaatacaactattatttttttcattaatcaatgtaaaatttttaggcgaccaaagcaaacacagtatcattgctaagctatctttatcatataatagatagattattttcacccattgcaacgcacggacattattgcaacgggcattttgctagtaatttttataatagtagaagaagagatagggatagatagagaagagattggctgaggttcttgccgtttcttatctatttgaattggaattcgcctttgctctgttacttgtaatcaaaccctcctttcaccggttctggactctagtggtaaatcctttttgtacttgttctggactctagcggcttatgccatctatgagagttcgagttcatcccaaattataaatgcaatgtcgggtttaactatacccaaattataaacgcactgtcgggtttaactagacaattgcaatgtcgggtttaactagaaaattatttgagccattttccgatctcgagcagttctcttcagctaaactcgatcgagaaatcttagggcagcttggcagcttgaatagtacatatacacaacccaacaaatgtttgtatggaactaatctaggaattgctattgcgtatgtctgtctattaatctacctttttaatttatattatatgctactcacatgattttttttatttatgtttaatttgttctatgatgtgcatcaattgtctgacaattatttttgggcaacaatggtgaataaataaatcattttaagtgtaacgatggtaaaacatttgacattttactttcataagcaaaaatctggaatcgtgcacctgacattttttagtatgatcttattttctttgatcatattagcaatgtatagattacaagtattttaaatgaaatatgttacgtgatatatactcctaataatatgcatttgcacatacttctaaatataagatagaataacatctcttattacacgacttatgcatttgcaaatacttctaaaaaagtgttgcctaacacaaaatatatacaattgtagataatgtaagtgggttgaacaatatatatagtgtattatgaccattaaattcataacaaatgtcacatttatattctttatataaaaactatagatagttataggactatctatatataaataataatgcatacaaatcttattaccatacaacatcctaaatactttttggaaaaaaaaaatctctcctgatttcaaaaaacgagttaagcaacatagatatataaagtattatttgtatgtacaatatttgcaaataaaataacacaatcttatatgtgaaaataaattatatacggtgactacagagcttgggcgcgggtctacttacactagctcagggtgcaagcataagtggtcggagctagtggcattgttattgaagatggaaaagagcaagcaaacaaaatagaaaaagaaatgaagggacaaatccttaatttcacactgcattatggcaaaaagaatgaattggtattacaattatgaaatcccacttatattagtaattagtcttaatttaatcatccaaaacaaagtgactattaaatttactagctgacgtttgatatgcttttttttcttatttagccggttacgaatacgcgttgccgttgtattcccaacaagtgccaacaatactcgcatatccggaccaaattttctgaaacaaatgcaggcggcgtcaacactcaagatttaaataaatcaatgatgaacatttacaatgacataccggttatattccagttacaacgaacaacgaacatgatcataatacataatgaatgacgaggcatctgcagcgagttttctatttctcctgtatatatgtacttgcctatcagtttctcctttttagtgccatttatcacacaaccgaaacctggattttgcgataaacttgctcaccaggctcggcaaatcagcagttagcaactgacgttcctcgctcaagcttgcttctagatatcggagctgttttactataggacgaaatggtcgatcatatggtttatgacatcggcaccttcgctatgcataacgggatctttgacctgtccaaatttcatttataagcatgcgttaatctcagcgctatgtcaacaaacagaaactggttgctaagttaaaagaaaactacgagtaaataatatcgactctgtttgtacacagcatataaaagaacaaggcttagacgggcaaagagatacctgaatcacactatgtgctgcagatcttactttgctgttgtggaagctgacatccaccttttcccacgacacaagcttcagacctcttaaaagccgttctggaaatttcagaagaagttatgctcatatggacataacacatggcataggaaataagagcaggtcaggtcataatatggcttatatgatcacttggacagaacacttctgtagtgcatattattgttccaattcgcagaaaatattaaaagcctatcggaaaacgaggacagtccaacgacatcatttgatttttggaacaccacacgcatgttctaatatattgacgggaaaagtttttgcacattcacgaaaaaaaaacatagtaaacagacagatacaatcagagtactgtcgttgagcatggtctcatttgcaaccatacatatggagttatggacattgttaagtcacaagaatacaagcaacgtgcattctgtatagtcggggggggggggggggggcatgtatgggagatcgcacgctagacccactcagcaatgcagccatgtcctggttatcccaagagccttagcaaacttagaagaaatagcttatttccattttcccaaagaaagaactataactaaagaaagaggtcaccatatgtcatataaacatgcataataagtagcatcccaaaaactcttttctttcactaggtaaaaacaacaatctaattaggaaaatataaaacatggaattacataaaccatggaaaaatagttatatctatagcactgaatatttatcagaaatactgttattgataatatgggattacaaatattaccaaattttgaatataatcatgttgatccattatcaatcaaaacaataatacaaaccttctaacatgcagctgtccacatcggcaacatcagtacattgattcattgtttctgctttggatagttcttcatatacaatatgtgggtaaatcttgcttcctgaatcagtccactgaaatagcaagaaacgcgtatgtgggaaaaattcaaggttcagtatacaggccaaactaacaaagtcacaaaaaagtagccatgggggtaaaccttcggtagctcagaatttcgcctgatggatgatgttctccacccaacaatatcttagtcaacatcaagttatggaatgatattttaaacaatacttagtactaaatgtatatttagtcttttagtagtaaaagaaaaggatacgatcatgaccaacattggagtatgcaactcttcgtttgaatactttcagagcagacctaaaacaagaagttaataaacttaacagtcaaatgattcatgatccaagcatatagatccaaatgatgggggaaaacatacatgaactgtacgcccccccaatcatccaccatgcgtagcaacaatggaggcttcccatcatcattgtccataagaaatagatgcttgccagtttttccgaatatcaaatgaatgatgtagctggcaaaagtttctattgcagtaaatccaaaaaggaaaggaacctgcggattgaatttcagaacaaattaataatgatatttcaacctgaatataaccaaagccatatgtatctctacaaaagaagagttctctgctgattgcatggttgatcttggcatcacaatattgattaaagaaaccttagcaacagtactgagtacagactagcatgtgcttaacttgaagaaaatgtacatgtcctggagcctggagcatgaatgttcgtgcaagtatagcaattcagagtaaggtaatatactatattcatatcactaaaagcaagtgattgttcaacctcgaaagttttaaataacttatcaattcttgaattaagtacagtaaaacaaggtttaagtagtacctgtttgtttcctctagaaccaagatgcggtgacgcaacagttatgaagttcactgcctcaagcccatgtatagtacccttattagtgttgttcagattctgagaactttgggatgtttgtttaggtggcctatagagtcttccaatagcatatcttgcaaccaatcctccaacagaatgtgcaacaaaagagatctttctgatctgtggtcttttgttggtttcttcaacaatctgcctttctaaattttgtcatgaatttgggaaacaaagacatacatactcagcaaataagcaatatgcacaatgaaatcactgacctcttgtgccaaccgctcacccatcacatcaacgccatctaaagttagcttgtacatgttgcgattgctacctacaaaattaaaatatcactgaagtaaggtaaccataatgaaatggttcaaagcaagaaaacatccatcttaattatggaacatatgctgtatgactccagcctccaatgctgtagtgcaaatacaaagacacatatgattgtgcattgactgggataacaaagttatctactatatttgaatttgtgtttcacatatggaaagcaaaataattatttgcaacaatccccttaatgaatcataactttgtaactgttgctcacaggtagggacatattctacaagcgcaacacaccttggtgatcttgttgcaatgaatgatttggaaagagtgcaaagttaggatattcaatggttgtttgaattggacaatagaggatattgtttgggtgatccgtgaggaattatgggtgtgcaaggcagccgagagtctgttgtaaccgcgtagaggggcatgctccctcttgcagtcttacaagtagcctctgagcaaggagatcccaaaaaacatggaagatgaggtaaaattcttttcttttttcattatgatcaccaaaattgcaaaacaaaaaagatggcaccaatgagaggtgtccattgggcacattcccatcgtatcacactttgtaagttgtaacaggtattgctattagataagatgccataatggtcttactgaagtatatatagaaaagtggcagtacaattgctcaccaaacaccattcagaaaaatgatatacacactcgcgaatagggagaagcttacgatgaactataactttgtctgacagcaacttttcaaattgctcagctccaaacttccaatcagctgcactgcacagatgaagaaagaaagatcaatgcatggaacagacaaccaaaacgatatacagaagggtaaaaaaaaccagttagcaacggggctcagtgatgcactaatatatggctgaaatgtgcataagcatcgtgctatactgcaaccaggtagttaagcactctcgattctcaagcgattggtatggatctaattttgcgtgccttgattggaaacgccgacctgcccaatatgaaagaatgccatagcatctaagggatatctcaaattcagtttgttaactaagtgcccaaatctccatattttctgtccactgtccagcaaaaaaacgcgcgagcccgctgctcacgcttgctatagcgatacctcgctgaagagaattcagagaacactgaattcagagagcgcaactgaacccatcagagaataaaccatacaaaaaataattacttgaattcagagagcgcccccgagccgaaggccgaagcaattaagcagccaaaaattacggcatcaaaccaaaagcggatcagcacacgagccccccacgagcttagtatccattacctcccgacgatcccgtggaccatgaccaccaggtggtcgggctcgggcccgacgccgccgcccggtgcctgtgcctcctcctcctccgccgcggccgcctcatgccaggctcctcccaggtcacccatacctgccaagccagccacgcaagcgcgcgccgcgaagggggaagcgaggaaggggggagagggaaaagggagaggagtggtgggggggaa

SEQ ID NO: 60530 - DNA, 9720 bp, Oryza sativa
cttggttttagtttattaggacaaccaatgggtttttttgatcgttttattagttataaaccggtgtgagtaatactcgttggtttcatgccgatcgccctattggtgacatatactgacgtttcatgaagatctatctattcaaaatctacttgcacatgttgataaactttttatttcttattgcaatagaaaaattacttaatattggcagcaatactttgaacttctttagatatatgaactaatagtatcggtttgatgtggagttcacaaaatcattagctgatcgaaaactgctctggagttgttttcaattttcatgaaaaccagttgaaaacagaagtagttcagataaaaaactgaaactaggttttactttaatttgactgttttattgagtggtttgtcaactagagccaactcaaatctcgtaattttacaaaaaccaaatggttttcatcggttttttcaatccgggtgtgatatttgtctaacttaggtctcatttgaactagtagcggataaagattaattggatttaaattattttaatttaaaaataaatttatctaatatttgaaagtaatttctatataaaaagttttcacacaaaatatattatttaccagagtgaaatcagtatcttaattaaaaaaaaggagcagaggagaaaatgtatcctattaattaggatggacgaagcagaggagaaaatgtatcctatatatctaatattacgatccaaggagggtggaaattggtgacatcaacaggctgtgtgtaccatggcaatgtacagcatgtgctcacgacgcctaagaaaagggcgaatttgtctttaatcggtagcgtgtagaagcactaagcactaacagcaacaaaatgacccgttattatgcggtgtctaggtcgtagaaggcacgcgtcgatcataaataaattagataaagcgacaaccgaggaagaattgcatgctttgtggagtactgacaagtgacatttgatgactaacgtcgcttctctctatatctcaattcgggccgtgtttatagatttattttatttcttctaacttccaactttttcgtaacatcaaatgtttatacacatgcatagagcattaaatgtggacgaaaaaaaccaattacacagtttacatataaatcgtgaaatgaatattttgagcctaattacgctatgatttgacaatgtggtgatatagtaaacatttagtaatgacagattaattaggtttaatagattcgtctcgcagtttacaggtggaatctataatttattttgttattagtctacatttactacttcaaatatgtatccgtatacttaaaaaaaattggagcatttgcaaatttgccactgttttttctaatattgcaaggttgccacttaaatgatagttctagtggcatttttataatttttttagtggcagttttgcaataacgattcaaagtagtggtaaatttacaattgcctaaaaaaaaattttggcacacgaaataaacacagcctcgatcgcttcctctgttcttttttctaggataacttaacatcgttctgaaaacgtaggatatatattcgttgtgttaaactatacttgtcgcgaaaggaaaatggaattaacagcataagagctcaatgtcccgtaaatgacaaatgaataaaagctagtgattgtgtagaaggcatgacaaatgagttgatggttgacagccagagctgatatgatttcgcccgattaatatcgcaaccaagcttgttcagtgcacgcaaaaatagtgtgctagccaggaccacgtaattgcgtgcactaatcctcgaatgcgaccatggaatagaatgaactagctaatcattagaatcctcaacgacctagaatttcaattccatttcgttcgtgtggatgcttaagcctacaaaataatattacgtccgtattttaatatatagtattattaactttttgaaatatgcattcatcctataaaaatataagtcatgctaaaaacctttagtaataaatcaagtaaataataataataattttaaaaataaaatgaatcatcaaacttattttaaaaagtaaagtaaattatatataaaaaaattaatggagtactttgaaatgccgtttaatgaccgagtaatgcttatgaaattcctctgaaaaaaatgagtaatgcagatgaaatgaccatttcaagtagccggaccgtttctttttgggtcagcgttcagattacccatagacacagccacacaagcatcttaattaacacaatacaaatattctctccgtttttaatacatatgttatcgttggcttttcaacgtgcgtttaaccattcgtttcaatcaaaaaatttatatgattattattaattttattgtgatttaatttatcatcaaatgatttttaatataacttaaatagtgttatatttttttaaaaaaatttgaacaagataaatgatcaaacgattttcagaaaatcaactgcatcgtgtataaaaacgaatggtcaaacttttttcaaaaaatcaacgacatcgtgtattaaaaaactacagtgtgtgtaaccatgtgtttgagactttgagctttgaggcgatgcgataaaggcagaggcttcaaagtggacagcgaccgagaacgacgataagatttgcgacgccgcggcgccacgtcaagagatagtaggtgtccccattcggtaggctgtttgggacctttcgaccacaactcccacacactatccagcgctggcatcctcatcacggcctgatcaatgatcccctccagctgatcgagatactaactaactgaaattagctctaactactccggattacttaagttgatatgatcaccatggctagattatcagagcatcaatatgtatctttgcagagccttgcaggccagggctggaaatggcaataatgtttttgcttaatcctcgttgattgggtccgtttcgtcgcatgctgggtcatggatcatcttatatcgtcgcttataagattctttttagcattctcttagcctacctagtaatagttagctctttactatgactataggacctacttatctttctcatatagttttttttggttccggtgtccgaaccgaaagtttacagcccgtttttcctctcttttttttttctctcctacacctcggcatttagccggtttatagcgtaccattatacttgctcttatggcttatccgcttctcatagcttccacgtcaactgcaagacaggcaggtacggcgagaggcaaatcattggcggtttttgtagtggattggcatccaaacaccagcgccaaacataaaacatagctgtcgttcgccctgtccacgatttcacgaatccgtatgcactccgctgcttgagagcggtttgccaacagccaaccaactgctgctgctcggtgggtgcttaattaattttcgtcggcgtcggtgtcagcggcggcagaaagcgttgaaacacctgaaccgaccatcggctctaatgccaaacgatggtcgtcgtgccgtttgctgagtagcttttggcgctggtagtgcgctactactcggtccatttgttggaagaggtcgcatattgcatattgtttttttacttgtgtggcttgatttctgcaacttccaagctagaaataataataataataataataataataataataataataataataataataataataataatatactaaagtagatatcccgttcgacgaaatgatacttggtaggtaccagctgatgatacctcttagatatcgtcttatgtctaataggaattagtcgatagcatatgatacctgtaaagtaccatcccatccaaacgggttaacatcttatagcatttttttaaaaggaaattaggcggcagtttttttttcttcttttaaatgtaatcttcaaaggaaaaaaaagaaacatttctaaagatcttgcacgaagcaaggtttgagtcagtggtgggtcttgtggtatgttcttttgggcccaactggttccagtaagaaataagttcacttaaggtcctttaacttttcaacgaatccaattttcatccttcaaccggaaaaccagatacaatgggtccctcgactattaaaaccggtacaaaggaagtccctcaacggtttctatggtggttttgattgacgtggcgtctacgtggctgctttgacttggtccttgtcctacgtgacgatgatgtgacactataagcaaaatataaaaactaaaattaaaaacaaaaatgtggagcccacgtcagacagacaaaagaaaaaatagtgagactcacaagtcaatgggtcccaccctcctatctacacacagaagacgggagacgagagaggagggaccgacgcctcctcctctgtccctcctggccatccttcctcgtcggccgacgagcacgcgcagagagggagaagggcggcagccagtgagaagaggtggagattgacgcggaagacgatcgctggccgtcgccccctgcgcgcctctctttccgcccgtcgccgtcgagccctacccacgacgccccgccatcaccggcctctctgcctcctccctccccacccgcctcaccggacgccgtgcgccgctccctcctctcccgtctcccgccggccaccgcacgcccatcctctccagttggccgtcacacgctgctctctcctctcccatctcttgctggccgccacgcgctgcttctttcccaccggcaaccacgcaccactgcctgcctccctgtggccggacgatgttgttcatcggggatccctgctccagattcgactgtgatgcgagaggaagtcgagcgcctcgctggcgagcgacacatgcttgccgagcccgccctcgcctccactaccacgaccgccctcgccacctcccacgcctcccctgggttcggtcttgggcgggctcgacaaagcctggagagaggagaggggagagagatgaagagaggggagtgggagagaagaggaagaaagaggggtgagaatgacatgtagggcccatgtgagccccatcacggtttttattattttccaaatcaaagtgccacttaagcgtcacgtcaataccacgtcagattaagacagagtcaaattagccacgtaggcgccacatcagctgaaaccgccgttcaaatcatcatagggcttatattgcactagttttgacaaataagggacctgttgtatctggttttgagagataagtgaccgtttatctggtttttggttgaagggcaaaaatcggattcgttgacaagttaagggacgtcaggtgaacttattccttccagtaaaactgtagctaataaatgggccttacaacttctcaaaaattgggccatgcaaagagatctagtaaatgggcctcccttaagaaaagctagtaataatgagcccaataatgacttgtaccagtccgaaggggactctgcgcaacccggtcccgaccgaaccacaccggatgacgcaagagccgacgtcactcctccccgtctgggcgcgggcgccaacgcggaggcccaagaccacacggcgccacccgctccacctccacgaagcagccatggaggaagaaggcgcagaccaccggcccccctcctcctcctccggcggccgcggcttcctctccggcctttgcgccgccgcgctacgccgcaagcccatctccgcccacgcggcccacgccgcctccggcgagggcctcgtgcggcagctcggcgtcttcgagctcgtgctcctcgggatcggcgcgtccatcggcgccgggatcttcgtcgtcaccggaacggttgcccgcgacgccggcccaggtcaggcccaaacgccccctctttttttcctcgttcgcttcggtttagagtccgcggttgcagcactctaatttagcgttggagcaactctggtcaacttgttggcgccactgggctacagtacaatcggctgcctgcatatgacattgacatatctattgcaagaattcagcagtgtagcagccaggcaggcattagggaattgctaggcagtttgatcatactgctcgtagtcgtaggcagtagttggttaaacatatctattgcaagaattcagcagtgtagcagccaggcaggcattagggaattgctaggcagtttgatcatgctgctcgtagtcgtaggcagtagttagttaaacatatctattgcaagaattcaacagtgtagcagccaggcaggcattagagaattgctaggcagttgatcatgctgctcgtagtcgtaggcagtagttagctaatcgctgctcttttatataagcagatttgtgtagtggccatttacggactgccttattgttgttgatcacggtgcaaatgattggtagttgatggccacatcaaatcaattgcctctttgcactttgcccatttcatcatttccgctaaaacttacatgggtgctctaagcaggtgttacaatcagttttgttcttgctggagccgcatgtgtgctcaatgccttgtgctatgccgaactcgcatctcgatttcctgctgtggttgggggagcatacttgtacacgtatgcggcgtttaacgagctcaccgcgttcctggttttcactcagttgatgcttgattatcatattggggcggcaagcatagctcgtagcttggcaagctattttgtccaattccttgagctaattccattcttgaagggccatattccaacttggataggtcatggagaagagttctttggtggtgttgtatcagttaatatattagctccaattcttctcatcatcttaactacaattctctgctatggggtcaaagaatcatcagcagtaaatacctttatgactacattgaaggtaaggctgcgtttatggggttttccctgcactaggatgcataactttgcagctttcatgtgtttaagtgagcttatcttatagcattaccattaggcgttctatgactatgaattatgatatataaatttctgcatgcacatgaaggtttattttactttgttgatcaatgaagtggtgttcttgtttccctgatgcagatagtgattgttatagttgttgtatttgctggtgtctttgaggtggatgtatcaaattggtcaccgtttatgccaaatggtttcaaatctgttgtaaccggagctacagtggtctttttcgcatatgttggatttgatgcagttgctaattctgctgaagaggccaaaaaaccacaggtgatttcagtaactacccatatttgttgtgttcatttgactctctggggttggaaataacatttcatttttcccattttatttccagactatgatagtatgatttttgctttaacttctctttctgctcatgcattcaaaattcttcagagggacttgccgataggtatcctagggagccttctagcatgcgtcttattatatgttgctgtatgcttggtgattactggaatggtgccatatactttacttggtgaagatgctcctttggctgaggcttttgctgctaaggggctgaaatttgttactgtattgatcagcatcggagctgttgctggtcttactacaacacttcttgttggtttgtatgttcaggtataccttccaacttatctataagtgatccgtctttgctttaatcaaattgatcaactttctgaacattgccttctttgaaatcacagtcacgtttgtatcttggacttggaagggatggattgctaccttcaatatttgccaaagtacacccaacgcgtcatactcctctgcattctcagatctgggttggttgtgttgcagcagttttggctggtctctttaatgtgcatgaactctctcatattctctcagttggcacgctggtatgtaaacttcagttaatattcgctattacaagtttacaacacataactgtttgcttcttttttttttccttttttatgtgtgatgcagaccggttattcagttgtatcagcttgtgtaatcacacttcgatggaatgacaagaccaccagttgtcgctcccttggaaatatgtcaatctggcaggagggtgttctatgtcttgtcataattgctctttgtggtttcgtagcaggaatgtgctatcggtttagctatgccattgccttcatgataatagctcttctcatagctgttgctgctggttttgctctccagtttcgacaggtaagtaccttttatattagccagtagtactaattagtagatcctcgcatacctacctcgtgtcatctcagatgtgctccatagtctgtaccaagtgatccttattggagtgattacatggatcaccctcttttgtttttctgcttgcaaattgcaaccgtgcatgaatgtgttaataaactaaactgtacatatcgaatctactgttccaaggtattgtacagttgtttattcaaaatcttgcatggcatgcattttcaggtatatgtggatccacctggcttttcttgtcctggagttcctattgttccaatggtctctgttttcttcaatatgcttctctttgctcaggtttgcatgactcaacttcttggatatatctgcattttctttctttgaatttaaatatgaaaactttgtttgtaccctctgtcttggtgtcttggcttctgttgactgatgaatcttcctaagtcataactgatggcaatcattctacatctcgcagctgcatgaagaagcttggtatagatttgtcatccttagtctccttgctgtgggtgtctatgccggctatggtcagtaccacgcagttcctttaagttcagaccacccacacccggccgttgcttatcatggaattccttctgaagctccatgagctactgcaatttgcaagcctccggcttcatcccaaagttcatgtgcaatacatctgggtagcctggggcctattattttccccagctggaatattaaacctcgccttgtcaccatgcatactccatagttccacaccgtacactgtaaatcgccagtcttaaacgaagatattttagctggcatcataccaatataccattcaccatagatgccaaaaggacagacaagttgccctcctgtatctagaaagaaggaatctagcaaagtagtagcaattttttgtcacttctatgtgctgaaatgaaccttttgatatcacttcttatgggtgaaggatagatgattgcgttgctcatttttaaatatatgaatctcaccatatttttgtaggaactttacaatagtcagatcatttctgctacgaatatcgaactatgagaagttaaacttaggggttgtccagatcgatgtcatttcaaactatacccttttatggtaaaattgttaaagatgtacatacatttagttttctttttttaccaaactttggtaaatacataagcaatcatgccaaaacattaatattgaactatgagaatatataagggctgttcaggtttattttggcttcaatttgaaccgccactttacacggcattgtgtgcatagtatatcagatgctggattgctgggccgctgttgttctttgccaattttaagcttaccaaaaatttggattgccgaaaaaaaattgtcactcattt

SEQ ID NO: 60531 - DNA, 5165 bp, Oryza sativa
cgcgtcgagggctacaaatttgatataaagtttgtcttcattagaattcacatgaaaaagttatgaattatttttaaatataaagtctttataccatcctatttgactcaaatgatattcaaatccaagtttagggacggattaacacagtcgaacaaatttgaagatctgaacggtcgatttgcgagttttagaatcgggatgacacagcggtacaccggtgatggactttactctatacttttttccttgatatataattggttgggtatgtgtgcggtggtggtgggtagtgggtacctataaatagagaccaggaggtagttcaattatccatacatcaggtcgatccgcaactcctgtaactaacacagaacgtgcagcggtgcagcatgtctgggagcaaggtaataagtgttctcgatacggagatgctcgctgttaacggtggcactggcacaccgcaagagactgcctctgccacggccgctgcccaaacttttgccccgtccgtgtggggcgacttcttcgccacctacactcctcccaactccaaggcatgctgattaattaaatatatgcttgattaaagaagtttgacaacatattaattacttcagctacatagcttttatatttatgtatacgcgaaattctcatgcatacagaggtcagaggagtggacgagaggaagagcggaagggctgaaggtgcaagttcgcagcaagctgttgaaggccaagagcagcagcagtgcggcagacatggtgatgctagtcgacacgctcgaacgccttggcatagacaaccacttccgtcacgagatcgcggcgatgttacaccgcgtacaccgcgagcagcaggggtgcactgccggctccgacgacgacgatgacctccacattacttcccttcagttccgtctacttcgcaagcacggcttcagggtatctgcaggtacaataacatactctccactttttttaatatataacaccattcatttgatcatttatcttatctaaaaaaattcatataattatcatttattttattgtaacttgatttatcatcaaatgttttttaagcctgatttaatttttttatttgcacaataattttaaataaaatgaatagttaaacgtttataaaaaggttaaccgtgttatatattaaaaaacggaggtagtatcaactctccggaatatgaaggttcctagctaaacacctgaacaaatatatgcagatctgaaaaggtatatcgtctaagtacatagctgggtcgatttttaaatctgtacatatatagatgcaagatatatcccatacatatatgtatacatatacatacacacatatgtgtgtgtatgtatgtatgtatgtatgtatgtatgtatgtatgtatgtatgtatatatgtatgtatgtatgtatgtagtaattgagaattttgaggaagcatctatgttaacaaaataatctagatcatgtcctaatacatatgtagattaattagattttgcaaaatatattaacctagaaatccagaatcaataaatatggggccgtaacagctccatcgtttgctggctgtgttcgtttcactatgttcccaactcctctccctctccctcgtgtttcatacgtacgcttttcaaactgctaaacggtgcggtttttgcataaaaaatttatatataaaagttgcttaaaaaaatattattgatcctttttttaaaaaaaatagttaatacttaattaatcacgcgctaatagaccactccgtttttcgtgtggagggaatgagttcccatcccaaaggaacaaacgcagcaatattctcttagcaaccgcggccaaaatttaaaataggaaacctaattttatatttgattttgataattttttattatagtttattttccaaaattgtttttaaatcattaaaatacaaatataaatgttttatctataaattcgtttcagctgcatcgttcatttttttcacggcttatcagtatttccgcaaacatgactgtaattttaaaagtcaaaattaagagttagagacttgggaaatatcatgcatggactcttctttcaatctaatccactccaattaagaaataaattcgaaattaataattataaagaagtgcccattccagagtgtcaatttagcattttattaatttaattctgaaattaataattagccagttgaaactgattttgaactcttttttaatctaatataaatgcaaggccgaacaataaattattccattatagaagaaatacttagttacaatttgcatgatgttgcaattcattaaaaataaaattacatgtagaaatattcaaacttggattaaaagaaaatataatataaaattgtggttaagaaaagaaaaattgcatatagcacatgccactgcaattttcggctccggaacgtgcagtcttaactactaggtgaccggaaattttcaggcacctgaaatatagcaatcctatagtaatatacatgagttcttcactaatacaaaatatttactgctgtaatagctgtattcgacaagtttatagatagcaagggcagtttcagagcaagcctaagcagtgacacgaggggcctgttaagcctgtacaacgcggctcacatggccatgcctggcgaggaggggctggacgacgcgatcgcgttcgcgaggcaccaccttcggtccatacaaggtaagctgaggttgccgatggccgagcaggtctcccgtgcccttgacatccctctaccgcgggcgcccaggcggctagagacggtgcgctacatcgccgagtacgagcacgagccagcttttgacggcgtggcgctggagctcgccaaactggactttgagctcgtcaggtctcttcacctcagggagctcaaggccctcaccctgtaagtctcttcacttctttgcctcttgactcttcagcccacatgctccctacttaatgtttcctctcattatacagaaataatttttctatacaagacactcacggatcgtaactggtcgagtctgcaaaaatcaacctctattttcgcatacaactcgttaagaggaccacatgcaaaaatcaattttcacagatgggccttttaagaatccgcacgcaaaaataagcctattttttaggtgaacctttcaaggggccacacacaaatatacattttcacaggcgggcctattaaggatccgcctaaagtctaagttacatcctcgtatccctcttaaacacttcaaaatatttcattcttatccactcatctctctcactccttctctccgcattactttctctccactctcacacctcctatcagacacgcggccagcggcaggtggcgggcagatccacctccgtcgggcccacgatggcccaatctgtcgccgccagacccgtgacgaccggatccataggcggcgggtaaaacggccaatggcgggaggtagcacccggacaaattctgaacgcctccttttctcaaagatttctgttgactcggaaggaattttgacgtgggatagatccattggaaggtggtctcgttagctttccatacatatgtggaacgtcgaagttagagtctgaatacaacctgggcgacaaatttagtgtgtggactgcttctggagcccgaagaagacttgaacttgatatgagttggacctccatcttatcttgaacgtccatgataacattgtccattctcctagtatctctccaagtgttccatggttctctccacagttactaatcataattaaatcattaggtagcaatctatcattaagagtacataaaaaaagtacttagaaacgaactcacctgtaaatttaattatcgggtacaagctccagtgaccttgcaaaaaaacaacttgaggatagcctatgcatccaaaggagtgatgtcctcattaatatagataaactataatggaggctccaaattaagtacaactttgtatttattaataattataaattttgcaattgttttctcaagactaaactgaaactaagaatcgaatccatgaataccattctgtatcaattatcaaaattattatagactaaatttcacattgggtcacatattttgaccacggcttcataatagactaatgttaaacccatgtattcacttaacaccacacgtctttacaaagttttcactttgtactggattgagcatatcaaaaaaagaacttcatataatttacacagggttataaaaatgaaatacattgtacgttttcttcattaatccttttagtgtgaactagttgtatatttaatttattcatgtgcccctcggtatagattaatttctgccggttctaaatatgttcacattactattttagtgtgatttgttaaaaaaccaatttgattgtattttctaaaataatggtttgaactgctgatatcttccttatgcttaaccctagtccaaagtgccagagatatgtggtgttaagtgaaaaaagtaattctaaaaaagtgaaaaaagttattttggctcctgtaaattatgaaactttagtcaaaatagattgtccattgtgaaattaactcattattatattattaggagtacactagcaagtagctcaaattaaagatcatgaaagtggattatatataatgatgttaatgctaattttaaaatgtaaaagcatgcatacaatttaagctctgttcttaaagaaacaaataaacaaaccgtgaaaattcgcacgggttactgactagttcatgtacagtacaagcaattgtccagatactacctgcatgaagctcagtggttaagcgacaagtacgtgccaagcttcgcggagcacctgaatgtggctaccatgtcaacgggccgggccggcgctggccccggcggtgcggatgggcgtgaaccaccgcgacggcgcggcgaccgtggaggcatattcggctgggtgtccgcgcgccgtccccgacctgctccgcgcaagcgcccaggtgggccggccgtctcctaacgacatcgcctgctacaagacggggaagaagaacaagaaggacgtggagagcctggtgtgtacgtcgcggagcacggcggtggcggggcaaggttggaaat

SEQ ID NO: 60532 - DNA, 9896 bp, Oryza sativa
tctattcctagcttaggtccagaaaattcttgatatgtgatgaaccagacaggcagacggacagtatatatatactgctttgatgttgggtgagaaatgttagagagtaaaagaagtgggtgaaacagacacgatcagtttgcagatggtcacaacaacttgccatctccctccttgcacgattcacttggtacggacgcattgctcttgcttcagccttgttaccttgtactgcatctgtactatctcaatgtgaatcatgtgagattgatttcccaattcccatgcggatgacagatcacacacatcttcaagacccacacggccggccatgcatgttgagccgatcgaccacgttgattcttcttcaccgtgctgccattccatcgaacaggctgtgggtgggggtcggagttttattctccgaacccccctcgggccgtgttggattgggaaaatgagaagccgacggcggaggcggcggtggcgtgctacagcggcaggggaggaagcggcggaggccatggccggagatgaaggtgggcttggacttacgtgcggcccatatattaactaattgggccaaaaactaaacccttaagtttaggggtgtcagtgctgactgtgactggactgtgggacccggtcatcttatccgcatcgcatggaggagaggaatcgcctcccttatcctctcgccatgcatttcctgccttgagtgtgaggatcatattcatattgcagctagcgtactgcactgatcgatttgctctagctagctcgtcgttagccacccatggctgcttctcctgcttccactgccgccgccgtcgtgaatgcgccggcggccaccggcgggctgctgctgccgcgggggaggagtagttggagttggagttgctgcaacaataacaattcttcgatggggaggaggtggcgggcggcggcggtgggggaggtggcggcggaggggaacacgtacctgatcgcgggggcggtggcggtggcgctggtggggacggcgttcccgatactgttctcgcggaaggacacgtgcccggagtgcgacggcgccgggttcgtgcgcaagggcggcgccacgctgcgcgccaacgccgcccggaaggacctcccccagatcgtctgccccaactgcaacggcctcggcaagctcggccagatcgacaagtaatcatccatctctacctacctgcttcatcgacgatccatccatccatccatcatcatccagctgccagcttctgatcatctgatcactatatacatgtgtgtatctcaccatctgtgtgcgtcgtctatataactatatactataatcgttagtttggaacgctggaataattccatatatatggtctaattccagtgttccaagccggctatatatcaatcgctacttaaattcaatgtacttgtgttgctgagctactttgtctctgatatacatattcattgtctctcgctgctcttccgtttaatggaacaatattaacatgttcttactactcaccacttttgtttatatttcttcttttttggatggactggaacgcgtcgttggcacatgtacgcttatcgctttattaaattgagacggttagtataagcgaatgattttgatatatatagctccgagttaaatactgtcctttttggagtatagagagagctagctggctctcaggcttttcctaagttttgcattgtgaatataaaatggacctatatatcagagagtaagttcgatatggaattacggagtatattgcaattatcttttccctctctttgtttggtatgaaactaattagcacacttgaatagctgtgtcatcttcaacttataaactgtacaataacacaaggcaagcaccaactaagtaattaattattaatcttcctgcggatgatgcacgataatcggcaaattgaaggccaagcctgaatagagggcttggtcactttaatgacattttcaatcttaccaaagttgacaaaaaagtggcaacatttagtttcctgccaaattttggtaactatataagaaatcctaccaaaatttggtaaggtttttttttggcatcaaagtaaacaggcctagagatagcatcactacaataaagtttttttgatgaaatccagcgcgttgctgcgagagttttatgtgatattagtaaaaataacatgtaagatagtatattttgtataattttcatctctggttgactattgaaacaaaaatctataaacaatttagattaatctctggctcaatgagagaaggaaaagaaagaaggtaatatatatataaattaatcatccaaatgtaaaactaaagtgctatgacattgcaagagaagaaaaggacgaagataatttaacaatgcatcataagtgccttatgatgaattctctgcattttataaaatgtatctatgtcttgtggcagtttcatatagacatttttttatgtctataagagagtagaagcattttctagagattaaattgtaccacaaccatatccaaccaatgcaaaagaaaaggagaaaaaaaatgctttcccttgttattgacaatccttgagatcatgacttgggtaaatcaatttcatcttccatgcactaatcaacttaatataatgtcatacctgtatatttgtgccttgtgttatttatatgtagttcctaagtatgaattaacattgaaaggtgtgcctctatatagcttaaaatgtcttttacataacatgcaatttttacagtacatgaagaatttctctacaagataaaatagaatcaaacatactaaaaatgtctctaaagtgtctctctatagtaaaagttttctatgcaattttcaaagtgcctctaaaaagtctctaccctataaaactcctaattttagagccaattaaaaaagtgtctctaccaaaagtgcctctatatggggttttttttgttgtagtgatggtactcatgtcaagccgttgtccaccttactaattatatccctcacctccgcaaacatatatacttcctccattcaaaaatgtaagttgtattttgttttcttagaacaagacttggactaacaattgctagatatatcatttatgtgacacaaaagctagcacaatcataaggaagtacttttgaatatgaatctcataacatcaattttgcgtcataaaaaacatattataataaagtaactgctagtcaaaggcttgtccaaaaaaatatgccatatattttcaaatggagggagtaccatatatatgcaggtttaatctagctctagtgtcatcactgtccactatgtatgctcccgccatcgccttaactcgaagtctacttgttaattttgtggtccactatggcactatccataacaataaataaaccataataccagggtgtcctagacatggctctagctgacgtgcgtatatatagtaagctccaaaacattgctctgaccaaccgttctttttatcgctaactatgacttctagttgaaactaaaatccacttgtctgagaggaaaaaacaaaccacgatcgcatccaccagatatatgtgagagtttgatctatcactagcgcgtcatcgctatttctagtacatatgcttctgtcatcaccttaattgtagtctatctaatcttcctccttttccacttgccaaccctaaacgaaatcgaattcactcgttgatcttgtggtcgactatgcatagtaaaattgtatgtagtacatagtaagctacaacaccttggtatagagtaagtggttttttcccatcactagacaacatttggcttcaaaagccacaaccatatccaaccaatgtaaaaaaaagagataaaaagtatgtccccttgctattgacaatcctcatccatcagatatacgtgagtgtttgatctaccactagcgcatcatcgctatctcagctacaaaaccttggtatagagtaagtggttttctcccatcaccggacaacatttggcttcaaaagccacgaccatatccaaccaatgtaaaaaaaaggagataaaaagtattttcccttgctatttacaatccttgagctcataacctgttgggtaaatcaaatttatcttcaatgcactaaccaacacaatctcatgtcatacttgtacatttgtgccttatagtatttatatctagttcgttagtatattaacattatagagcttaaaattcctcaaaaaatgcctttacataacacgcatatttttaagtaccaaaagaatgcatctacaagagaaaattaaataaaatatactaaaaatgtctctaaagtgcctctaaaagtgtctctacactataaaactccttgttttagagataattcaaaaagtgtctctacaaaagtgcctctacatgtttttttttgttctagtgatggtactcatgtcaagccattgtccaccttactaattatatccctggcctctgcaaacatatatactccctccatttaaaaatgtaaggcacattttgttatgttagaacaagaattgactaataattttgcgtcacaaaaatcatactagtcaaagccttattctaacaaaacacaatacagcttatattatattttgaaatggagggattaccctatatatgtgggtcactatccactatgtatgcttccgccatcgtcttaacttaaagtctatgtgaactccctccctttttactcgccaccctaaacgaatgttgattttgtaacccactatccataacaataaaaccatgctaccaggcatgttgtcctaggcgcggctctaactaacgtgcatttgtatagtaagctccaaaccattgctctgaccaaccttttttttttcactaactatgaacccgggttgaaactaaaagtcacttgtccgagagcgaaaaaaatgcaccgtcgcatccaccatatatatatgagtttgatctatcactagtgcgtcgttgctatctctagtttagatgcttctgtcatcaccttacttatggtttatctaaacttccttcttttccacttccaccctaaacgaaattgagctttctcattgatcttgtggtccaccacgcatagtaaaattgtatgtatagtacatagtaagctacaaaaacttggtgtagagtaagtgcttttttcccttcactagacggcatttggcttcgaaagccacaagagtatagattaacattatgagaagtgcctctttagagcttaaaatgcctcaagaaaatgtctttacataacacgcagcttttaaagtaccaaaagaatgcatctacaagataaaattaagtaaaaatatactaaaagtgtctctaaagtgtccatagagtaaaagttttctaggcaacttttagagtgccactaaaagtgtctccactctataaaactcctgattttagaggcaactcgaaaagtgtctctataccaaaagtgcatgtatatagggtttttgttgcagtggtggtactcatgtcaagccattctccaccttactaattatatccctcacctctacaaacatatatacttcctccatttaaaaatgcaaggcgtattttgtttttttaaacaagagtttgactaacaattgctatatatatcatttatgtgacacaaaagtacgatcataagaaagtactttcgaatacgaatctcataacatcaattttgcgtcacaaaagccatattgtaaaagagtgattaatagtcaaaaccttattatagtagagtaatacaccttatattatattttgaaatggtgggagtaccctatatatgcgggtttaatctagctctagtatcgtcactatccactatgtatgttttcgccatcatgttaacttgaagtctatgtgaactccctccctttttgatcaccacccccaaacacatgttgattttgtggcccactatccataacaataaaaccatgctaccaggtaagttgtcctaggtgcggctctaattgacatgcgtatgcatagtaagctccaaagtatcgctctgaccaacctttttttttgtcactaactatgaccccgggttgaaaccaaaagtcacttgtctgggtttaaactaatgcgtcatcgctatctctagtttagatgcttctgtcatcaccttgattgtagtctatctaaacttcctcctttttcacttgccatctccaaacgaaatcgaactcggtcgttgatcttgtggtctccactatccatatggtaaagctggtacatagtaagttacaaaacactggtatagggtaagtgaattttccccttcattagatggcatttggcttcgaaagtcactctttcgttcgaaagcgcaaaaactaaggtaaagataaaccataccaaagcatatatagtatcaaacacgcgtcaaatatttaccgtgcgcacgtgtgttctacatgtacgcgaattattcggaccaatcaatcaataaattcctaaaaaccaagctattgatcctaaaaaatgtctatggtaatccttttcctagtgaatttacccatccatgtatacccatgcccctagctagatcaaaagcaatgcatagatctcaaaccaactaccataagtctgagatcgaagagagaacactgtaattaatactcaagcaagttaccaaaaagaaattaagaaagatgtaaggagaacaccatgagaagggaaattaaagatgtatgaggagcgatctaaagggcttattaatcatactccatgtatcggccggccgggaataaactgagtagaggtgatacattgatgagaaattaaaggaaatcgattaagaaaggcgactaatcaataaagagaaacctccaatataatccgacgcaggcaaaggatcgtcgtcgacgatgatcatggatggggtggcgagctagctagtactcgtcgcgccagcagatgagcatttggatgcagcggcgtatgatgtagaagcgcgcccggtgctccttcaccgtcttggtcagccgatgctttatgttctccgcggagtagctccggcacggcatcttcacttgctccggcgacgacgatggcggcggcggcgacttcttcaggcccttcgtcgtcttcatcacctgctccttccgcacggcgacgttgccgcctgcagcatcctccttcgtcttcaggttcttgcaggtcttcttcatcacatgcacttcccttgcgccgcctgctgcagcctccatagtcgtggtggtggtgatggtcgtggtcttcgatggagaaagagatttgaggatcgcgacgacggtgatgaggtaagctatagctatagctagagagagcggtcactcacacctggctgggtgtgccgcgcctggggtctaaaccacgcgcagccactgctgacgtgtggggcccacatcggccgtccgaggatgacgtccggccgagccgaccacacgcacgcacgagcccggtgcgggtcgtagcttgcttgctgcttcagttactctctcatctctcatctcttgctcgcggccacggccacagccactgccagcatatgatcatgtcatgctgtgcgtgcctagctttccagttgattccaagagagagaaagagaggagaaaaattatttttacaagcagtatatgtaatgtaaagtatatataacggatggatggaaattgcaatataatatatatggcaaataatattgttgctagctccatcttttccagctagcacacttttatttctttctgccacaatgaaccttgtgcaccacaggatattagctatggagaaaaaaacgaaacgatttatagttttacactacttgctgtctttattacgacgctctgattaatcattcttacctgatcaatgtcgtatgtacacaaactcaaacgtgcataaatatattcgcttctggccctggttttgatttttgaaatgttgatgtatcggatcatatcggagatcaaaacagaaaatggaataatggtcgatgcaaactaacttctatatattccactcaatcgccaatagccaagacttaattaattacttaaccaacactaccagaaactgaaatacccctgacggccgcaatttttactgacgtgtgtgcatacatgtcaggaaattgaaccctgacggacatatgtcaggcaaatttatttttccccgacaagctagttctgacggtgacatgtccggaactattttcctgacgggattttctttatttctgacgggatttagccgtcagaagtaatacaatttctggtaagatactcaaattcccacgtagatacgcatatatatgcttgcacagtaaacaaagatgagtatttatttaattttacatctctttcaaccgtatatatatatatactccatcttgtatagttcactgtcagaacatacgcatggttacactatagttacattacatttgaaagttaatttctttttagaaaaaaaacttatattacggtagctttttagataatttcaaattaacctagcaccggcagttcccgtgcaaaacagggggctagctagcttgcatgctagccatgcatatatagctttgatttttgttttcttgtgcttttcagggcttccagaagatgcagatgattgtggagtagaatactctatatcctagcttgctgcttttgttcgtttgttataagctttgtatggatgaaaaaaaagttgtttttaattaattacagaatgttaagaatctctcaagactctcagtagtggtatacccaatataatagtgcacctgacatgcatgtgaaagttaacggatggatgatatggatggatggatatgatgctcatgattccttactatttggagaattatctttcataatattcatatataatttacatgttgttaaattatacgatttttaaaaaaaagaattgatggtaaaagattaaaaaatatttgacttataacaaagctataatggcatctaatttaaaacagagagaatatcgggaatgcgtgggccttttttagggagataaatgcatagacttatagaaatagatgacttcattcatcaagatttaaattttagtgttcacgtatattacgcattggtgtgcactttcaatacgatttttggcgaggtcgagagatacccatgtcgtccatctatttaaccatgtgttatatatggacacacacatatgtatgtgggtatgggtgtgatgtgtgtgcacgtattcggtgttatgaaagaaagaatgcatataagttttacttgtcagtttcaagtttctaagtaattaactttgcgtcaacattatttgttgttgcgatttttttaaaaaaagaagcactatatgaatttgtatagaaatagagaacaaaatgaaaggaaagaagtagcgtgagcttatagtgtttcttcttgtagaacctgttgactcgggatttaagttacgactacttatttgttactaggggtgaaaagaaagctcgggttcgtgagcttagctcggccttggctcgagcttggttggcttggctcggctcgtaagccaaacaagccaagcccaagcctcctttttagctcgttgctgaaatgagccgagccgagctagctcgcgagccgcttgttttggctcgcgagcctaggccatcgtgtgtttatattgattattttactttatatagtgttattatttgtcaacttgaaatttatcactaagattttgaagaattgaatataaaaacttatttaaattttacatgttgatgatttgtttttactttttttcaataattacaaaatatatatgaataggtgtttcaacaggaaagcttgcaa

SEQ ID NO: 60533 - DNA, 6335 bp, Oryza sativa
tataccattcaccatagatgccaaaaggacagacaagttgccctcctgtatctagaaagaaggaatctagcaaagtagtagcaattttttgtcacttctatgtgctgaaatgaaccttttgatatcacttcttatgggtgaaggatagatgattgcgttgctcatttttaaatatatgaatctcaccatatttttgtaggaactttacaatagtcagatcatttctgctacgaatatcgaactatgagaagttaaacttaggggttgtccagatcgatgtcatttcaaactatacccttttatggtaaaattgttaaagatgtacatacatttagttttctttttttaccaaactttggtaaatacataagcaatcatgccaaaacattaatattgaactatgagaatatataagggctgttcaggtttattttggcttcaatttgaaccgccactttacacggcattgtgtgcatagtatatcagatgctggattgctgggccgctgttgttctttgccaattttaagcttaccaaaaatttggattgccgaaaaaaaattgtcactcatttggtttgctaccacaaatttggcaatgccattttttatttcaacactagcctagcaggtcttaaaaaaaaattggtagtaatccaaacaaacatcttgccaaaattttggcaattgctaacctgccaaaagaatcaactaggcccgagtcatactgcaataagcgctactactactatactcccttttagttattcctaaatgatctacatatttgtgttcattcattaggtctattcgttatttgtacattagagtaaatggacattgatacatgcatccatgcacacaaacatttgtaacatatatgcaatatcttgatttgctattggctaggaaatagtggggatggtgcatgcattaagtttgttgctagagtaaatatagtatgagagttattagcttttcttgttattagtgtacctatgaaatatacagataaatttggaatggatggagtagttttttcttccgtctccacacgcttcacttaactactcatcaataattctgggacagcgataattgcagaattgcagtacgtactagactagttcgtgcagtgcaggtacacaattaagtcacttaactccggtacttgcttcccgatccaacttaacaccagtacatgagtactatctcgcggtgcagcaacaccggccaagagacagccacagcgcagcgaatcgtgaaggatggtagagtaggaggagcagcgcgtagcaatcaattcattccactgcacctttacctttccgttcccgtcccgtccagcgcaacaagccgctcctaccacatgccccgctcacatgcgattgcacgaacgcatcatcatcgcactcgcgccacgtccggtggcgactggccgtggccacgcctgcacgcactgctgcaagtggttaaacctgccactctagcactccttccgcccccattttcacttaagctgtgtttaattcacactaaaattaaaaaattagttaaaattaaaacgatgtgatgaaaaagttgaaacctgaaagtttgtatgtaggaaaattttgatgtgataaaaaagttgaaagtttgaagaattattttggaactaagcacggcgctagtactcattgtgttccattttaagtattttaagtatatagttgtgatttctatgtccaacctttaatcgtctattttgtttatttttttatggtttatatttttattattattagatgataaagcatgaataatattttatacatgacttattttttttttaaaaaataagctttttaaataagtcaaacggtcaaacgttgatccacaactacacttaggggctgtttggttcttaactaacattgccataactcattttagaaaatgttagacaagtgtggcttgccacactttttgtggcctataaattgtaagccacacttgtggcaaagttaggcaaatgattgagtctatgacatgtggggtaggacggcaagaaagtgtggcttgccataactatggcaatgaaccaaacacaaggctaaggatgtgtggcagtctaaagtgtggtgtggcaagttaaagcattgaaccaaacagcctctaaaaattggacgtagggagtacaaattatactacaatgcagtagtacatactcctactagctactccattgagtagtagtagtactaacaagtttttttttttgcggggaagtagtactaacaagttgaagagattttgtggtagtgtgatacagatcgatcgtggctggctactcaagcaagcaaggagacaggcgtgtttcatggcaatcgttacagcacggagcccccggtgctcgacgacaagatctacgcattagagacgccggagaggacgggcggcccgtgcgtcggcccatgggttggaagctagtatagctctggtggtggagtttggaggctgcgttgcctccgttttgcaccgggacaggtctccttcacgtgcactgccgcttttgcgccatgatggggtctcgtcccccctggcccgccgtgagtgagacgcaggggctacccggtaaaaaaggggaaaaaattgtaaccttcacaccaacccgactctttttctatttaacacacactcacctcaccaacctgattctgacacaaagtaaaggctatgttcgtcggtgaagaagatgtcgatcgaatctgtagtaggagcactagtagatgggagtagatcgtagtagagcaatacgccaatattaatacggaagttatactgcagcctgtacgcttgtacggctgtacccatcaccagtgcatcagaaaatgggagttgttggggattttcagaagctgtggatgtctgtattctggtatgctagctccgaaaaggaaaagtaatgatagcacatgtatcctttgtgtcggcgaaaggaacgggattgatttttgaggccactggggtggtgtggtgagcaattagaatcgctcatagttaaaccatggagtaagagcacccgcaatagtaaaataagatattctctataaaatatgtacatctcagcaatagactagattaatagtaaaccacctcaataatatgtctacatgggatctatagctctctaattcattgtctcatttttctctatagactatctccaggttagtaaatagctttgctttctcttttcatttaatctcttctaaatataaaaatatgctgacatggatcttttctaaagagcctatagatatccattgcggctgccctgagtgtgtatgactagacgccactaagccacaggctatcagaaacaacgaaccgtcgtgggttagttacaattgggagcagagagtgaattatttgtttactgataatgacaaatctccaaccttgcaaggaccagcattggggaaggagccaatggcaccactgaaaggaatcaccattcgtggttgtcagtatgtatagcacaaacgcacatgcaatgagaggtgtgggagcatcgtaatctctacagtaactttagtttcatggcgtctggatgaggaacattccagttcacatggagtgtttcgatgcattaaaagtacaacatatacatttcactaacagtgtgttatacagttcttcaggggcactggcctatgaacagcagttctacattttttttttcggttccaggtaatgcacaagaaaaacacagtgatcctgcatctgaagcacccctccagcatgtatgttactctgagttcatgtcaaggctattcagttccctggccagcacaaattcagcaggtttctagccttggccaggctgaaatgcctcagtactcgtcattgctgtatatgctgctataatgcaatgccgattaaatagcaagccggtaaactacccagtttaatttattttgcaatctcttcgagctttttgagtataaactttgtgttaggtctcaatgatggtgaagggctacagcaagctgttgccaactcgaagaaagcattcaaattcttttccttccctgacttcttgctctgcctgacaagatcggagctgaatgcatcagaaatcttcctctcaagaaccaaatttttgaacgagacaggcaataggatgtcgcgagggtttggcgtgttatcctttgctgattccttctgggcaagcatctcaagcagaactactcccaagctgtagatatcagtctctctagtggcatctctcatcttgatcagctcaggtgccttgtaaccctgtgctgctgaagtttcaagcatctcctgggcaccagcaggattcagcagaaggtagaggccaaagtctgatatcttgcactcgtaattagcatcgagcagaatgttgttcgtcttgatgttcccgtgaattatcggtttctccaaccctgtatgcaggtaatccagtcccttgacaatactgatagagagcttgcaaattatattccatctttgtgaatcaacaattccctctgttttcggtagcaacagaaaaacattgcatggttagcaactatcacaatgaatgccagaagatgcctaataacaactttattgacaaataatgttatccaaaattcagccatcaattaatatggtgaattttcatccacaagcccaacactacataataaactgacagtttaacttaatttattgaagatctaggttcaatgatcgaaaaagaaaaggaagatgaaatgcagtggtttgaaagtaagacattgctagtacaaaattctgggagttaacttgaaatatcaaatatgtaaatgtgtgctcttctcttcaatcaagaggcaacaatacttgtatctaaaggacctttctacaaaagcctgactgattaattgaacacgggaaacttgttatatcctaatgattatggtagttaagggttaattaatgacttcaacaaacataaggagtcaggaccatgtcaccagtacacagtgctatgtcatgtttcaagctaaacaagagttgacaaaatactttttgcaatcagcaattatagcaaggcatagattagaattaacaccataggtccatagctatgaggttccgagcatgactatcttctccattccacttggactcaaatcactcaaaattgagagtttgagaccaattgccctactggttttcttatgtcttcaaactctcttagaaacttcactatgccttttgcattacaacaaattcttgacagatctgttgcaggcttgcagcttacaggtataattcatatccagctatattctccatgctcatgtgagtttttaacattttaaaaacgctgttactaatttaaaacggaattcccctaaaaaattaaaatggagttgaactacctcttttacaacaaaaagttacattttttttaaaaaaaatcacgttgctaatttacactgcactttcacaatggtggataactagatacagaagatgagatacgtgcattgcagcctgcgtgcttttgatgctactctgcagtgcagagatgactactctaatatcgcagcattgccatcattgcctaacatttcggggtgtaagatctcttctcctaaaactctgaccttgatccccatactcgaatagtataatcagtcacagtaaattatacttcgaacattgaaaattttggaacgtaacaagattactacgcaaagaagagctaaaaactgcaaaaggatacgagagaacagataaaatgctccacatttgttaccaagaaactaacaacaaggcaagtaaaataagcagagatgcagaccaaccttgcaagaatcgccggagcgagccggcggcgtagaaggggtgcacgagcagcttctcccccctcggcccgacgtagaacgcgcggagcggcacgaggttcgggtggctgaccgcgccgatccggcgcgcggcggcggaggcctcgtcggaggtgagcgcgcacgcgggccgcacgaaccggagcagcacggcggcctccccggagcgcatcgcggcgcggtacagggtgctgtgcgacgacttggccaccacctcccccggcgccttgaggatggcggcaacggagagcgcctcccccccggggaacttgacgagcgcgtccgccctgccgtacgcccctgcgccgacgcccgcctgcgcgcccaccccgagacggtcggcgatgggggccaggtacggctgcagcgcgccgaggcggtcggcgatcggcgcgaagtaggggagcatggtgttggccgtcctgctccggcggaggcacgccgggagg

SEQ ID NO: 60534 - DNA, 1957 bp, Oryza sativa
accaaaataattttggcacgtgatatataaccttgggtattatgattctatagttttacaaaatcacacctttaaccattttgatttacttttatataaaaatttttaaaaaacggatgtaacatttatatgatgggataaaatccttataatttgagatatgattgtaaaactcaaaaatggtattgcgaaacttaagaaccataatacctgaggttatataacacatgccaaaatacttgtagttttgtgtaacttagactataatattatcggcggagttttatgaaatttagtgaaatgaaaggatggtaaaatggaacgcagggaggtccggcccacagggacatgcggcccagtaatagaagaagtcgattaggagcagcgggaaagcgataaggaaagcgacagccatagccactcgctgcgcctcctcctcatcgcctcgccgtcgccggagaagacaaccatgaccaccatcgccgcgcggatgccgtttgcgggcccacgcctcaggcctccctgcaacctcaccgcctcgaggccgggtcccaggagggccgggctggccgtcgtctccgccgccgccggtggcccgcttcccaccgtgctcgtcaccggcgcaggcggccgaacaggtgcaatgtactccttgcggaaacccctctcatgcccctcctcgccatcttgcccatttggttcctcgtgttcatcgaatcgaatcgaattttcttttttagataatggaatcgattttccttgcaagaagaaagaaatctagtttcgtgcacatctactcttgcaagaatttgactcggttttcccttttgcacgctgcaattggcctctctgtgatgatgatgatctttcaggccagattgtgtacaagaagctcaaggagagggcagaccaatttgtggggagagggctagtcaggactgaagagagcaaagccaagattgggggcgctgccgacgtgttcgtcggggacataagagatcccgcgagcattgctcctgccattgacggcatcgacgcgcttatcatcctcaccagtgcggttccgaaaatgaagcctgggtttgatcccagcaaggggggacgcccagagttctactttgaggatggctcttatcctgagcaggtgattaaatgtattttgtgtcactcacattttctgtatcaacttgtgccttcatttgaaattgatgttttctgctatttgctactctttgaaggtggattggattggccagaggaatcaaatagatgctggtaaaacatctttgtcttgcagatggattctttgaacttgtttcttttcagctatgctgttctttaaaccagtattatcaatgacttgttggtctagctagcatagctcctttttttttcagttaattcattccttgttcatgattcgtttatgttttttcgtcatcttcatgtagccaagagcattggtgtaaaacaggtggttttggttggatccatgggcggcacagatgtcaatcacccactaaataagttaggaaatgcaaatatactggtatataacatgtgcaaagtctttctttcttctaatttattcatctttatgtgtgcgtgttcatatgtatgcatgcatgagcacatcatatgcactgtttacaagctcagaatactttaatgttctttgaattcgcaggtttggaagaggaaggcggagcagtacctagcagactcaggtctaccatatacaattataaggttgtaaagcaagacatctcttgaaaatatagttgtgatttgtgaaatgcacgttgtcttgcagtctacataattttactagcacattagctttctagaacatggtttcacctttcttccctatagctataggtgcctgcagcctgatcataaactcaaaccttatgtatgtctgtcaggaataaagaacaaaccctcagtgcagttg

SEQ ID NO: 60535 - DNA, 2018 bp, Oryza sativa
gaggatgtcaagtctcaaatgagtttgaaaaaaagattcatgtgattaagaatactaacaagccgtcttacattcattattgcctcggcctgcttttctctgaacctgatgcagccatgcagtacaacgcgtgaatgctgtcaccgtgtacacttcaaaatacagtgcatcgcgtcatgtggtcctgtcatacagtcatactcctatgcaaaatgaacaaagtcaccaattatcaaatcttggaaatcctagcagaatactagtactagtacagtacattgaataatccctccgtgaaaaatgagaaatgtaacagtaggtcagcctgaagtactgtataatttattttcgttttgcaagctgcagtccgtattccgtaagaagtaacaaagctcttgggcagcaattgctagccaagattcttgggaagatataactgcagaatgcaagtccacttgtgaagtcatgaggttgcagcaaaaccgaatgcgttagctgacggcagttcgattagctgctggatgacggtttactgaacatcaggtttcaagcattctgttatacagttacctgttatcaaaagaaggagaacatccgagttacagtttacctgcatagcatcattagcatatatcagatgcataccagatagaactagttaacagatagcagaaaactgacctccctgctcgggttcgaagttgttcttggtaacaatgaagttgttcttgtaacaatgaaggcaatgtacacgagtgggcctgaataataccaaaggctcagctaatcagctttccttctccgagcacactgcgttcaaagcctcaaatggcccaacaactagtgggctggtagtgcaggccgcatgtgcaggatgacgtttcccactgctcatgacggcccaatgactgagcaatttcaacgttggaataagttcacttgagttccctttatttgtcgccagtctaattttcatccttgaaccgcaaaaccgtatacgacccatccccaacttacaaaaatcagtcaaacgagatccctcggcggttttaatagcggttttggctgacgcgacccctacttggccatttttggccattttgactcggtctccatcccacgtggcgctggtgtggcgctgacgtggcaattatatctcggtaaaataataaaaatcatgggcccacatgtcagccccaaaaaatattttaaaaatggtgggtcccacatgtcagctacacaaaataaatatggtgggcccacgtgggccccacatgtcgttgaccgaatccaatatcttcttcctcctctctccggctctccccatctctctgctccctcctctcgtcgggcggcgtccagcacggcggcagcaggcggcgcgacaatggacagcgcatggccggcggcgggcgacggcgcgcgcgaggcacgtggggacgatgtaggcgtcgatggcgacgttgggccgcgcgaggaggcgacggagcaagtggaacttcttgtcctcaccaccaccaccaccaccaccagaagcagcagagccgccatggcgcttgcggagctcagacgaggggagggcatcggcgcggccgtccccggccgcggcggcgaggaagtagaggcggcggcgccggggggggggaacgggagggcgcggtggagggggaggacgacgggaggagggccgcggcggccgagggacggggagaggcacgtggcttcgatccctcttctcccgccggcgcccatcggggagaagggcggcggactgctaggcgagcgtgcgcaagagagagatggccgccgccgccccaggcgcctcgcgcgccgtcggccgtgcgttgtccatcgccgcgagggaggaggcgagctcgtcggggcggccggcgggagaggaggcagcgcaagccggccgacgggagggagggagaggagcggtggtgcgcgggcgtcggcggccggcgggagaggagcggcagcgcactgggactagcgcggggggggggggggagcgg

SEQ ID NO: 60536 - DNA, 23126 bp, Oryza sativa
ttgggaaggattaatatttaaacatttaactgtctgactgtctgttttggataatctccataataaaatctaagaacgagacttctgcagacacaaaagaagaatctaagcacgccttatctgtagttaagcatgaaatttccaagcgatctggttaattgtcttcccaaatggttaattgatccttaatttacttcgtccgaaatcaacgaagtctcctgttcagctcggacgtcgtccgttgttgccgcgatcgctaattagcgcatacgcgctagttatttttggcacacatgtacacgtggagcgaactatcttactggcagtgtcgtcagaaacggaaaaaaaacgtgattagcacctaattagacccagatcagtaacatcattcattccgataattttccttctccgggtaattaaccgtatcacgttcacttgctctttttttttacttttcaaatatatttaagactttcaattaaaatttttaaaaactctatccaaaatttaaaactttggacacaaattcaaaaacattcaactcaaaatttaaaaacattcaactcaaatttcaaaaagtttcaactcaaattacgaaaactttcaaatcaaatttcaaaattttcaactcaattttgagatggaagttttaaaatctaggttgaaagtttcaaaatctttagtagaattattttcaagtctggatttgaaagtttcaaaatctgagttgaattttttaaaaaaatttaagttgaaagtattcaaatcttgacttgaatttcaaatctgagttaaaaatttaaaacaaattttcagttaatagttttcaaatccaagcaaagagtttttaaatctaacttgaaagttttcaaatataaatttaaactttaaaatatgtacttaaaaaaatgtcgaacctaggttgaaaagatttcaaatctcgatttagaaattttcaactatgtttgttttagtaaaaaaaaagaagaagagaagaaaaaacacgcgtagaaggaattgtttctggaaaaaaatgaaaagaaaaaacgaaagaggcacggaggttttttttttctgatacggaacgaaaaacggggaaaaaaatccatagctttcttccttccccccgtgctcgcgacttccgtaatcggtgtgtatgcgctaattagccagccgccagagatctcaactattaatgccgcccgagttgtagggataacagagggtgcaggctgcacagtcgatatttcaggtagtaaacgtcccaaaataactcaacctacgatttttatgatgggtttccagatttgttgttgatgggtcatatctcataggtaaatccatcctaaaaataaaatcgaaggttgagttattttgggacgaagagagtaatttagaagcggggtcggctagagttgggatgaagataagcttatttatgtcgtggaggagaggtgatgtcatcgcggcgccattctttctctgtggaagttgtgcatgcgtttactgacagcctgactgataatagttgttcaaattaatcaggattgttggatcttgaaccatcacggataaaatttatgaagaatgagaaggttttttgaaaaaaaaaaatatatatgtaatgtaacatcccggcctagggcttaataagattaatagaatacttatatcaacaagttgcaacttcttttcgggaagccaatctccaaagaactctagggttaagcgtgcttggcctggagcaatttgggatgggtggccgaccgagaaattctttccgggtgcacacgagtgaggacaaagtgttgcagaaaagacatgtgttggtctgtgagggcagtttatgacctatgaaagtctcctatcctacgacttatagaatatacgagtatggtatacctttacgtacacaggttgtttccgtatgcgttgtaggaatctgttacgaattatagaaaatatctctacgggccgggtgatttacaaagtcctacacggaggggatacagcttctattgtgttgtacgggatccgatgtctccaagtcttacttggagatcaagatgatccacggtataaaagggacccccgtggagggggtgcaaggcatcgaatctcatcgccaacacacctaccatagtttacgaagccgaagtatgcggagccaagtcgccgggagatctcgtcgaatatatcgactacgatctcgtcggtatcatcgaattcgtctacttccattgtattatgtggttttccataatcaatcccatgtaaactagattagggctattacccgataaggggcctgaaccagtataatccttgtcttttgtttgcttgatgtcgtattatgtagatcctcattccaactaccccaatacccaactcatccggtctacgagtatcactcgtcgacagtggcgagccaggtagggggccttggtgcccaaggttatgctagtatgacttcaagccatgccgacaacaatgtcaacactggtgtcaatcaagaagcttctatctcgacatcgctggtgtggactcaagtcggatctattgtctttctagtctacaccgttatgccaatctcaactggcccaaaattactatcgggaacgagaacggtgcggttacgacttcgagaaatgacatcttgccgacaattccttccacacaagtggagaacggaatatcgacgaccccaacacctagaaaaaatcctcaagcggccgaattctgtgccccgcatagaaactaagagccgacaaggatatccatcaagaagccgagatcttcgtgtcctatccataaggcatccaagcatactctagaggactacccagtgatactacacgtgaaggctgagttctacgcttgtagagaacatagaattcagcgcacttcaccaaccaatatcacctattgtccaatccataagtctagatctcacaatttcacgagctgaatcttccttaggacgatcaagtgccatgctcttagatccaacaaccacgagttcaacctcagtgtgttgccgaggaacgggacgcagcgacaacctcagatcggttcgtgggatttgtcgatgttgaccccgacgagtcacccgtgttgcatattttggaagaccaagagtcctctccgtcgatttcaccgcgagacgtcaacgtgatcaatacagctgagaccagcacgtccgcggcagctaggacgcctgctcaatagctacaagccctcaactcgatattgagagagccctttcgatcctgccctgaaccctgatgttgattagtaggcagtacgactataagagaccatggccaacctcaatagcgcatttgtagaggcagcaactgagcccccgctgcgagatccaccacgaggaaatagagaactagctaatgggaacgcagaagtataaatccctactggtgaacgttccccctatgctcaatcgccacgagcaacctgagatcccactccaccacctcgcgaaaatcacgatcttcgtgagcatctggacgaccgacggagagaacgtcgggatcagaacaacactgatcgccatcgacatcgttctccctcacgacgaagagagaacaccaattgacaccaacatcagcgtcattctccttcgcgacgaggagagaacaacgatcgaggaggacgctcgaacgaagatcgagactagcaagcccgcaacgaccatcatgacaatggcaataacgttcgtcgtgacggtggcgacaacaatcagttagatcagggagccgacggtcgagctcagggtggcaatggttgagatcaggggcgaggcagtgatgatagacgaggacgtaatcctcgattcccaggatcggaacgggaccgacgatgcgagcatcgttctagaagtcgagctcctgacccaagcaacccctgctcatcatcctcgccatcctcttcatcaggcagacctccttgatgacaccacgggcgcgaacaacccttcgctctaggtggcgggtgtagagcgtccacccctacattgcgagacgtgcggcggcccaaggagttccgaccaggagcaatcgagaagtacggtggaagcacggaccccgaagaatttcttcaggtctaccccacgatcctgtacactgctggtgcagatgacaacgcgttggcaaattacttaccagccacgttgaaaggatctgctcgttcatggctggttcatcttccgccccactcaatctcctcatgggaagacttgttgatgagagatgttttgtcccgatcttccgataggtactgataaatagtcgatataggcggagtcgcgacacaactcgatccggcttctgaatgtacacgctactaagccccgcaattgcagcaccatgtctcctctagttatcaaccgtgccgaaacccggttgacctcaccaagaaggctaatccctgcatgtgaatcgaagaacacaagtaataacaagatagattgcaacacaattgcatatgaatgattaagcactcgaacttagggttccacaaaccgatctagcggtgaaactgttcttgacagattaatctaagcaacacccaaatctaaacgatgacggatgctgaataaatatgattaaggatgtcctagggttgccgtagggcgcacacccccttgggctaaggccacgacacaattacaaggcccaaaacacaaatcagattcggactggatgagatacgttgcttgttttgcagattcccggcagctcggttggaattttgacgtgggaccaaaaccatctgaaagtagactccatatgctttccaacaagtctaatgggccccaaaattccttctcgatcagtggctaggtccgtttgaagttggtgctgtcaaaaggcccgaatccgaatccaaaacgtgtagaactttatctcttatcttctatatatggaccaaaagtgacatggtgagatgtaagtggacttggagaagatcttggtttggtccccaatcaacttttttaatcatccatatattccttacgcttggtcccttttctttcgcccaagcaagtacctctgcaaacgaaaacacacgaaactcattgtgtagcaatgttgttcaaatatataacaaataaatctaatagagaatatatgcacctttggttgattaatacataaggtagtcatggttatatctgagctagttgtgtcctcatcacttgtggcagcaattcatcaccaatttccaagggacatacaagcgtcacgcaatcgaggacgacctgcacgctctaactcagaacccaggtgaatcattgagggactatatccggtgtttcaatgagtacaggaatacgatccccgaaatcaccgatgcttctgttatccacgcattcaagtcgagcgtctgagatcgttacatcacctaggaactggcgacacgatggattatgtctgctcgcaagctgtttgaaattatcgacagatgcgctcatgcagacgatgcctttagacgaaaagaatgaaagagcaagacaggcgaaaagaagaagccagccaataaagacgcactggaatcaagcaagaggagaagtcataagagtgggaagcgcaaatcttcgggagaggttctcgctactgatcaaacagacccacccaagcgtccaaacccccaaaacgatgactcacgaaaacaatgttgccctatacacaaaatgaacgaccactccttggaggattgtcacgtcttcaagaaggagcttgcgcgacatataggaatcgagaaggggaagcgagtatgcggttgtcgaagcgaataccgaagcagccactcctgacttcgactccacattcccggactatgacctcgacgtcacacacatcttcggcggttcttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcggaagactagggcgacgaccacaggcacttgacggcaggcacgagctagacaccaaagccttcatcatccaggggctcctcttctgtgttgggaaaaaattgagcaagactgagtacaaccaccgtactcaacaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccgtgaacccacacaaacctgccttaacccaaggcctacgatgattcagaccgaaccggcaacccgaccctgggtcccagctcgtcctaagccaacccaggccaaccattccacattttagttgttaagcaggttttaagaattaaaacactaacttgggtacattgctcggcttgcccataaccgagggcgcggctattcgaatagattatactctgatcagaggtgtacatctttacctacaagacacatcttcctcacgtgcaaccacgtgccacataccaccacggtatacagacggaagacgtgacatagtttccaacctatcctagccatagacaagagtaccgacccaattccacctacggccggaacccccgggacaggcaggcaggactgagcccctagcagcaggacaccggccctgtgccacgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaattaaatagcgaagcatccacctaacatcatactagaggtaccatgagtagagtgtccactagttggggttttgtttaatctagggtgaacaaggaaataataacaataacaataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatttggatttattgcgtcagccgaggggaggggcgcgcggaccgggtccacgggagtggggcccacgcggcagcctcacggtccacggtggaccgggtgcacccggctcacaccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatggtcgccgccggcgaccaccggcgcggcggagcggcgcccgagagaggggagggaagggggaaacgaatcggcggtccacagctcaccccgggtcgacggcgacgacgggaacggcgaccggagcggaggaaggcggcggcgcggctcgggtagacggggacggcggcgttccggcggtcggcgggcgaaacggaggggtggacgaggtcggcaaggttgcggcgaaaccaaaggaggcggcgccgaagcgggagaaggtccggggcgacgacggcggcggactggagctcggcggtgacggcggagagagagagcgacggcgcgagctcgattccggcggagagagagagcggcgagtggcggaaacggtggagggaggcacggggagtgtttatatagggttgggagtgagagagggcggccggatgagggggaaacgggcgcggaagatccggccgccattgatgcgccggcgaggtttagggggaaagattccgaacgaatccgagggagagagggagggaaaaaatggggggaaagagggagggaatcacggggaatatttcccccctcttgattgcacgcggggcggacgggagcggcgggatttgcggcggcggcggcgctagggcacgggcgaggcggcgggagcggcgggaggaaggggatgacgggtgggccccacccgtcagcgagggtggcgggcgggcccgcccgtcagcggcgcgcgcgcgggaaggaggccgaatgggccgcggggaggaggagagagagggaaggagatgggccgagccggctcaagagggggagggggggaaagactttttaggatttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgtgggaggctttcacaaggattttaattattctaggcataatttcgaggatgtattttagagtcattttgggacgcgacaaacctaccccccttaaacggaatctcgaccccgagattcggaagaactgatgaagagatcgggatgggctgccttcagctcgtcttcacgctcccaagtagcttcttcctcggcgtggttgctccattggaccttgcaaaaacggattacccggttcctggtccttcgctccatggtgtccaggattttcactggcctctccacgtaggtcaagtcttcgcgaacttcaatttgctctgagtcggcctgctgggatggcactcgaagacatttcttgagttgcgacacatggaacacatcatgcacgttgcccaaggaggcgggcagctccaactggtaagcgacttctccgcgccgagcaatcatacggaaaggacccacaaaccgaggtgcgagcttcccctttgtctgaaacctgtgtacacctcgcaagggcgtgacccgaagatacacaaagtcatccactgcgaattccaggtcacggcgtcggttgtctgcataactcttctgccgagactgggccacctttagattatcccgaatggttctgactttagcttcagcttctctcaggatatcggtcccgaacacttggctttccccaacttggtcccacaatagcggtgtccggcatttacgcccatacaacgcttcataaggtgccatttgtatgctggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattagcttcccctatcggatacaattttcttaggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttccgttccatagggttccgtgttcatcctctgtgaaaccagcggctttaccttgtttcatattcttgaggagtccatgcatgtccggatcgttcttctgagcctcgcggatttgatcgagcaaggtgggcttggcttccaacgcagccaagaatccgcgacccactatgcttagattcagggcttccatctgttgattaagttcgggtggaatgccacggacgttaagagtgttgcaatggctttttcgactttgagcatcggcgaccacgttggccttaccaggatgatagtgaattcccacatcataatccttgatgagttctaaccatctcctctgccgaagattcagatccgactgggtgaagatgtatttcaaactcttatgatcagtatatatttcacagcgattcccaatgagatagtgccgccagatttttagagcatgaaccaccgcggctaactccaaatcatgggtagggtagttgccttcatgaggctgtagctggcgtgaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagttttgaacgccttctcgcattgcggactccacacaaatttctcctctttcttcaacaactgtgtcatgggtcgagcgattttggagaagttctcgatgaacctccggtagtatcctgccaaacctaagaaactgcgaatttgagtgactgtcttgggttgcttccaatcggtgacggcggtcactgtttcgggatccacagcaactcctttagcggatatcacgtgccctaagaatttgacttcggacaaccagaactcatacttgctaagtttggcatacaattgatgtttccgcaactttcccaacaccagacggagatggtgctgatggtcttcctctgattgtgagtataccagaatgtcatcaatgaaaaccacaacaaacttatccaagtatttcatgaacactttgttcattaagttcatgaagaaggcaggagcattggttaaaccgaacgacatcaccgtgaattcatacagtccgtatcgcgtggtgaatgcggtcttcggaatatcttcttcacggatgcgcaactggtgatatccagaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccgggtagttcttccggaaacacgtctccgaactctctgacaatggggatttctgacagtcctatctgatgaagttctgaactactgacagaggttgggggtgcaaagaaaacaaccggttgtttcggccctcggtacagagtgacagtgcgtcttgcacaatccactactccttggaattgagccaaccaattcatcccaaggatcacatccaagttcttggtgtctagaagaatcagatccgagggaaaaggaatcccctgaatttctatagggacggcaggactataatactttgctgtcataacccctccaggggtggtgatgagtagagggttcctaagcctttctacccccaactgatttctccccacgaatggcacagatataaacgagtgggaagctccagagtcgaacaaaatggtagcagggatggaatggatgaggaacgtaccaacgatgacgtctggaggcgcttggccttgctggcgcctcgacttcgggcatttatccgcaaagtgcccgggctcgaagcagttgaagcacagacgctgcggaccttgaacgtccctgcggccttgaccagactgcgcggctggcgtaggaggacggggcgcatgggtcccttgctggctctgctgttgctgcggctgtgggacgcgcaccacgaattgaggtcgaggcgcggagcgaggttgctgctgctgcgaggaagatccccctggatagggattggtgtagcggatcctttggttagcaccctgttggttgcggaaattcgccaagcgacgcttgtgcgactcaagttccttgtgcttggcttccaagcggatgctcttgtccaccagacgttggaaatccggatagtcaccggagactagacggacagacagctccgggtccattcctgccaagaacttctcttgcttctcctcatcttcccgcacatcctccggggcgtaccgggccaagttgttaaactcatgcaaatactccatcacggagcggttgccttgcttcaactctcggaactcccttttcttaagggccatgactccggcgggcacatgggtcctccggaaggcggcggtgaagcgggcccaagtaataggctgcccctctggctgcgtagcctggaaatgatcccaccatagagatgcgggtccctgcagttggtgggcggcgaagacgactttctcctcatcgctgcactgcacagtgtctagctttttccccacggcatgcaaccaatccaacacatccacggggttgttggagctagagaaggtaggtggacggatgcgtaggaactcggcgagtttagagtgttgtgggggtggtggtggagcattatgttgtggcggattttggatgtggtggaggaaagcagccatcatgttggcctgctaggcgaggatttgggtgagaatggcgttggtgtctggtggtggtggtggaggcggtggaggaggtggaggtaggctgccatggttgttgtggttgctgccttcaggttggttgccatcactggtggcagcatttctcctggtcgtcaccatctgaaaaccccacatagaaccagcaaacagagagagctgacaattaaagctaaccatccacgactaccataactcttgaatttattactgctattaaattggttcattaaagttcaagttgcttaagcaaataaaataaagacaggctccgacacagttatgccacacaccggcataaccatgccccacaagatcccaacaagaagacaaacgagaaagaacacacgcgcaagcctactaactgctcgtctaccgctgcgacgggccaggacggaaggtgagcaacagcgcatcctccgtgctaccgacgccggaggcttccccctcctgaggaaccacgggcgcgggctcggcacgaggggtctccacgaagcaagtccacgccagggactgacgaacaagctcgggcctggaggtgctctttcgggcggtgatcttctggctgcggcagacgcggcgacgcttggggtgacagacctctccctgggcgatcttgagctgatgcagctgtgcctccactgcgtctaggtccttcttcagctgcagattctcctgacgcagctctaggatcttcaggttgttctcgaccatcccacggcgcaccatctgatggaagtcgatacgagccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcagctcgtccgggtagcgctggtgaagagtgctgatggcgaggagagcggcgctctggcaagcggcggagaaagaatctccacccgcggtgactgccaacgaagtccgctcgggtgagccagtgaggatcactgcagtaacctcccaagcagcgtgggctctgcatcgtcaccctcctgctccgggagcggcctgccctggtagtccagtccatgcggataccccaggacaacgcacataccccgcagctccaagacgaaaccagtcatgtccagaccacgacgactgacgctgccggccatctacaaacaaaaacaaaaagaaaagcaacatttaaaagtcagattttggcgataaatgaagcagcaggacagagagagactagagagttttcacaaatagcaaaggatttttatttttgataatattgctaaggcttgggatctacggctcatcctagggtcaagggggctctgataccaacttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcgtaagactagggcgacgaccacaggcgcttgacggcaggcacgagctagacaccaaagccttcatcatccaggggctcctcttctgggttgggaaatgtcgcgaccgagaaacttgcattttcccgaacgctagtgtattaatccctgtcccaggaaaagccggggtacaccatacaaacatgatataaaagacacatctttattatatcgataatatttacattattacaaaggcacttaaggcctgacaatcaaaaataaacagcagcggactagcggtcctacggcttcatcttcacaggcgctcaactggggtgtaagccaagactccacctaagacttcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagaaaacagcatttaaaagtcacttagttgcccaaagccattttaaaaagacgatcctagagctacacagtattatcaatcaaggtcgtgaacctgcacgaacctgccttaacccaaggcctacgatgattcagaccgaactggcaacccgaccctgggtcccagctcgtcccaagccaacccaggccaaccattccacattttcgttgttgagcaaattttaagaattaaaacactaacttgggtacattgcttggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccatagacaagagtaccgacccaatcccacctacggccggaacctccgggacaggtaggcaggattgagcccctagcagcaggacaccagccctgtgccatgacatctcgactaccgggccgcagctcgtgtagccttcatttgtcctagagatgtccatcaacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatacagggggcggcgtgaatccaattccacaataaaccaacaattccaaagtgtccaggtgttatgaatatcccaaagtctagagttgtaaaaccgcctaatgttacctaattaatcagcgaagcatctacctaaaattatactagtggtactatgagtagagtgtccactagttggggttttgtttaatctagggtgaacaaggtaaaaataacaataacaataataataaggtcagaacaaaggtagataggcatggctagataaaacagtgataacgcgggaatttaaataaagcgataatgcaataatttaaagcaacataattttataaactgggattcaatatgttcaaggatgatgtgacttgccttgctcgctttcccaaacgccggcttcaacttccacgaagagcggatcctccgaagctgcagcgtctacacgaccaacggaaaagaaaaggcttttactctaataaactccatataacaagcagaaacaaagcacaaaaatgggttcttgacttcttagggaaaaattagagacttgaacggtccaattccgagttcaaatggccaagttacggccatttgaagtttatatgctctttaaatgaatatttgcgaatttcttcattcaaattttaatttaaaatggatttattgcgtcagccgaggggagcggcgcgcggaccgagtccacgggggtggggcccacgcggcagccccacggtccacggtggaccgggcgcacccgggctcacaccggccggcgccgtgggtcccacgcgtcagccgcacccgagggcgcgggcggctgatagccgggccccacgcggtagccgcacggtgcgcccgaaggcggccacgccggcgcagcggcgggaggcggcacgcccgcgcccctatggtcgccggcggcggccataggcacggcggagcggcggccgagagaggggaagggaagggggaaaagaagcggcggtccacgactcaccccgggtcgacggcaacgacggaaacggcgaccggtgcggaggaaggcggtggcgcggctcgggtggatggggtcgacggtgctccggcggtcggcgagcgaaacggaggggtggacaaggtcgccggggatgcggcgaagccgaaggaggcggcgccgaggggagaggtggtccggggcgacaacggcggcggaccggagctcggcggcgacgacggagagagagggcgacggcgcgagctcgattccggcggggagagagagcggcgagtggcgaaaacggtggagggaggcacggggagggtttatatagggtcgggagggggacagagcggccggacgagggggaaacggcgcggaagatccggccgccattgatggcgccggcgaggttaggggagaggtttccaaacgaatccgagggagagagggagggaaaaatggggggaaagagagagggaatcacggggaataattcccccctattgattgcacgcggggacgacgggatgcggcggattcggcgacggcggcggcgctagggcgcgggcgaggcggcgggagcggcgggaggacagggatgacaggtgggccccacccgtcagcgagggtggcgggcgggcccgcccgtcagcggcgcgcgcgcggagagagggccgaatgggccgcggggaagaggagagagagggggagggatgggccgagccggtccaagagggggaggagggggaaaaaggactttttagagcttttcgttttataaaatcattttaactttgtttatttcttaataattattatttgtgctctgaaaattccactaaaatttgagggctctttttagaccaaggagaatttaacaaaaattctccgggccacctttgaatttttcttgtacgtattttagtgtttgccaatttcttttcgaattttaattaattatattattccttttagaaaatgatttttatttcgggatgaatttatcaggacgtgacaaatccaccccccttacaagaatctcgtccccgagattcgaggaggctagcaagaagataggttgggcagtcttctcttcttgtttgacttcttccgctccgtcttcacaaactttcagcaaaacttcaccactcggaactgcttggcttgaccttctgttgcggatggaatcttctcttcacctgacttgaaccagggtgcaccttttagctgactcagactaggttgcggtagtttaatgatgcttccgttccagaacttctcatgattcatatcttcggagtcaacctcatacaagttaccacttcatgtcatgcgtcaacactagcttgtcattactaggataccatgtttgtcatcataagaatatcatgcttgtcatttacttctaacctgccaccaactgcctcatattagctttcctggtctccgggtgatagctacttctgctatttgatgcaagggtcgataactttgcctttgaattatgcttcccaagagaaccaacttatcccacttgacatactttgacgtcttcccaaatggctttactgctggatttgttattgtctaatcattatcctgccaaatctgaggcttcgttgttagatgtgattttaatctgacctctgtagattatcttcgaacatatcacttgattcataactgggaatagctctcacgaacaagcaactcggattcactttctttatgttcagtttactttccactattctcttcatgttgtcatcatttagcattcaacgtattcctttacaccttcagccttgatgtgttctttctcgatggatcgattgctaggaaagtgcgttgaacgatactagtgcaagtgcttttattctagtagcatctgatacaaagcccaaggttgaaccgagctttagattccactgttccggttttacttcttgacttcttggtcatgtcacaaaagtttccatccttgtccccatagaagtacttctacctgtggtcatctctcttactcgtgaattcacctactttaatgacagggcaactgttgtagggttgattgctatcgggagtcttcctcgagtgacacaaatcatggttctcgttatcctttatcaatcacctttcgtcctacttcttttcccagtaaccaaacatcttttccgatctcttccattaatcacctttcgacctttctcaaccaggtactcttcgctccgggtgttgaggatgcttctggggcaatgaggtccttgggcgtgctgtctttcagagaaaccttgaagtagttcgtcaaaagctagactgacgattgttgcctttgatccaaagaagacacatctgaaacacttagtccaaacatatgtctctttggttaatcacttgattttcttttccatcatcaggttggttattaactcaaggttcgaacatagttcctctgaaatgagaccctaggtctcctttatcagcaagcaattatacacataatcacatatccgcatcttccaaaagaatcctcatagaacttgtctgtattacacatttctccctcattacatgaatactaagcactgcctaaaaggaaaggtgcttagcatcggtacattgtttctgctatgggttctgattaacacgaggcctcacgggtacggcgtttgctccagtgaccacaatacgattgggatgtctgcttcgtgtaaattggcggtaatgtggaggtcgactttgccttgattgcaggcagtccctcgagtaatgccctggttctttgcaattgtagcaaatcaacgtcttctttgctgagctatccatctggggacgatcattctgacttggagttggaattggtggttggaaatccttgctaacattggcatcagtggtaccatagttgctatcaccattggagtctttctcagagtcacaattgctagggttgtcattttgggtgccatcattgatactatcgtcgacaccttggtgaatgatgttgacattgcacgcttgatttgagtggtcactaatggggcaagaagcatggttggtgggggtatcatcatcattagtattgctaatgtggttgtctgcattgtgtccatcttcttggggcggaaactcttgatgcgcaacagaagatccggtgatctgaagtggctccgtgcgctgtctttggttaccactgggaatactgggatgctgacaatccttctcttacagttcttcatccgattatgctcactttcgagttgtatggctttgtccacaagtttctcaaaatcttcatattcctctaggagtagttgcactgcgatctcatcttttaacccctggagatacttctcttgtttgtcttcatcattttccacatcttctggtgcatagtgagccaaacgatggaactcgtgcaggtactctgtgacggtcaaatcttcttgcttcaggtagcggaactctcgttttctcagtgtgatcattcctgcgggaacatgggatctcttgaatacagatgaaaactcgtcccaggtgatggtatgtccttctggccgtgatgcttcgtagctatcccaccattctgaagccagtccaaccaactgatgagttgcgaagacaacccgctcctggtctgtgcactgaatcaaccccagcttcttctcgactgtgcgcaaccaatcactggcttccataggttcgacgacaatggcaaaggttggagtctcagttttgagaaattctgataacttgcactgttgctggactgtaggtacttgaacgttggttgcccctgctgggtagttccaattctgtaatagttgaaaggctgttgccaacatgttggtttggttaaccacaatttggattagctctggtgaggtttcgttgatgcttttctcattcccattggcttgggttcttcatcttgtacttgatttcttggctactgtgctggaacatccaaaggtacaatgccgatactggcctctgtcttgtcaactggtggctggggctgaaattgagcattgacaccttgtggtaatgcactcgctggagttggagctgttgcaacgcgggctataggactgcttcgggatgcatggatgacaattcgctgaggagcaagcttctgattgcagggagttgcgtggactgacgtgctggcagctatgtctctcggttttgggcacttgtcggcgaaatgacccattccttgacaattgaagcaacagatatcttcccggactcggcattttcttttctcattttgattcctctgtcctggcactggagttaggctgaaactgtaatcttggcgaggatttgtgttgccttgatgcttctctccgttggaactggcgggttggttggccatcttcttcgtcagcagcaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgatttctccacaacgagagcatgccttacgttccattttattctggttgaaaccttggggagacttctcatcttcatcatctgaggagacttgatctgaatcttcactatcagacactctacctccattagctaaaagatgctctgtcaactgtggtgcacctcggaaggtatttcttctctgacgttttgtcattcctggtggaggccattctgtgctggtaatgatcatcttacggacttcatctttggttcgcattggtgtttttcttttctgctgaggacactcccttgcatagtgcccttgctcatcacacataaaacaaatgatacttgcttcttttgagtcaacatgtggcacgtcaccatgggtccttcgggatgctggcggcatgctgactcgtggtgtgagtgcttggactgcctccaactgcacttgaggttgtatctgactcaggttcagaattggcgtctgatgctgctgtagtatctctataagcaatcggttatggttaatcaggtgttggaccagtgtcacacaactggtgtctggtgcttcattcactcgggagcttgaggtaccgatgtcctgacttctgaccttattgcctttctcattgtcagccatctgttgcaaaggtttggagagggagagaggaaaacaaaggggagagacagattagaaactaaggataggaccttaacagatctaagtcttttgctgttatgatgtatgttaggcttattctgcaagttgattaagcaaacaacttagcatggttacatcacaacccactgatgcaaaccacgcgctacacacacaagcaaggaaacacacgacaaacgaaacactagagggtggcttaggttctgcgacgggttctccaagatcttcactcctgcttcacagctggcttcactgcttccttcacttcactagcggatcctgcagccttctggagcttcggcagacaattgacgacatcttcttcttcacaaagctgaccaactagtactaattgaaatccgaagaaggaagaagggagtaaacattttgcaaatagcattaggggaaggagaaaaaaaggaactttcgcaaatagttttatttataaaatatgtccttaggttttatccacttggcttatcctacagtcgagatggctctgataccatcttgtcgcgaccgagaaaattgcattttcccgaacgctagtgtattaatccccgtcctagaaaaagccagggtacaccatacaaacatgatataaaagacacatctttattatatcgataatatttacattattacaaaggcacttaaggcctgacaatcaaaaataaacagcagcagactagcgggcctacggctccatcttcacaggcgctcaactggggtgtaagccaagactccacctaagacttcttcttcaaagcttctctt

SEQ ID NO: 60537 - DNA, 15487 bp, Oryza sativa
acatgcgggacgggaggggaggaagggagggaccggcaccaaccgtggttggctgctccgtgtggcccgtggttacggctgctttctgtttggccgtttcgacgaacactgcgagtgcgagcctaattaactgcggtcggattcagccttaagatccgtgctatctggcgtcgatccgacggtgttgattgatttcatctagtagcggacatatctatctaggagtgcagaaagaaaatttcccggtccgactagctttcgtgaggtgcaacacatcaaggcttctgttgttgtacagtcgtgttccttcatgaaggaaacaggtacaagctgatggccacggaagcgtcgtatttcgttgtgtccaacatagaaacctcctatcacatctcgcttttagcaactactatcaataataaaccttggtccagactctaaacaacaagtccctgtcaaactttcgttgtatttacatgaaaatccttcatcaagattcatttcgttgatgcctgcataccaacatcaataataaagtatattaagaattggtgtcctcccagttctatagattgtttttttaacaagtttgtcatcatcatataaagctccaatagttgcgtaggatttctaatgtattttatacctttatattcatttcaaaattcgtgcattacctaacttctcctgttttttaatctctaagagcaactccaataaactatcacatagctagctcttcaactgacttggagagccaagcttgttgctctaacactctctctatttacacactctatttcgaatctataataccgggacacacatatcaacctctacttcctcattcttcttcctcctctttctccccttcttcttctcccgtggccatccttgagctcttccctcggcgacagcgatggcagaaccatgcgctcatgaggcgacgatggcggcggtgagaggggagaagacgatagtggctgatccgtgcaacgataagggatagcaatagttatggctacgacgacagatacggctacagtgatgagctcgacaagaggggtgaagccggcgacgagaggggaggaggtgcgaggagggctcagcggagcagccgcttgtcccttcttcacccgtaactcgagcggggggaggacggggaaggcggtgtgctgggcgggtgacctaagaggatgatgacggcgatgctgggtgagcggcactgggagtatgacaacgatgacgctaggcgggcagggagtgaacggcagacgtgatgggaaaaggaggagaaagagagagggggtgggacccatgtcgatggtaagttgtcttgccttgccaactttggccaatgtggagatgaatttagccagccggttggtaggtctattggagcttttttttatataagtttgctaaaatttggcttggagagccatttggccattcttttagagatggtctaacatgccatcgaattaggttaccgagttaggtgtcactattggcatcgccatcaatcccctctaaccctatctatatctatcactatctctactattataaaaatcgaagatatttttgcccaaaattttagtgcgtcgctctatttcgataagatgttggtgtgcaagcatgtgagatatctttgcctctatatctattataaaaattgataattttttggttcgtcacatcttttcttttgtccgtctttcatttccgactctattccctgttccgtgcgcgatgcgtgagatgagcgatggccaccatgcgaaatggtgccgcaacaaatgagcggatctgaaccggtatgcaacaagcgtgcaacctaggttaattctgattcccacgcttattcatcgtgtcatccctgtgatctcccgcacgtgccttaacaatcctactcgatcaaattctggagcacgtttgcggcaacgaatccaacgctgctccgactccaccaaaaatctctccgccatatatacatgctctcgatcgatcgatcacatctgtgaacagatagagatggctagcaataaggcgacggtaacgctccacggctgtgacagcacggggtgagcgtctaggcagagatgatgtcagcaacatcggttgatcaccgtgatcaggatagcgttgaaggtcaagtgtgccatgggccgcgatcgtgaccatgctcccgatgaagccatcgtctcagatgtcatcatcattcccgatgtcacagaccgctacatccttgtcatgtcgtcacgtttcttccggcggagcgatcagactgaagtatgggtgaagatgaaggtttgtgttttgccgttacggagtgggtgcattcttcatggttgccaggatggttgtgttggccctaaccaagcttaggccaaagaccgagtcagtcaactactccctcagattccataattcttagcattttgaaaaaggttgaggtctaacttttattactttgactatcaataattttaaaaatatgtagtttgaaggcattaaaacaacacatatagatttgtcttataaagtactatggtaaagtaaaaaagtatttattttattgtacatattataatacaaaagcgcaatcaaagatatattttgaaaaccgtatcattgttcaatacatcgagaattatggaaccgaagggagcagagctgcacaccacatagccttctacatgcaaagtgcagccactcctcagtcgacgaatagatagtagtacaaaaaattcaaaatgacaaatggtaatagctgaattcagaacatcgaaataatacttggatcatgaatattaaatcctaatcatcccatgtttaacgtaattttagttctttcccgttgcaacgcacatgtcttttagatataaattgaaacataaggggacaaaataaacatctaagggaccgatagatataaactgtatcaaaactgagcgtttatttgaaaaagaaaaagtttgatattttagagggggagggggaggggccttgagcccttgacccttttgctcctgtaagttttgtgtcagaatggtaagagaaagccgtacatgtacatacctagaaatggatgcatccgaagaacgttattttccgttcattaacacctccttttatccggctcctatcggcataaaatcaccaaaataaaatcaaaatagaaaaagagagaaaaaatgatacaagaaacatgacgttaccgatgaacagatcagctgttcacaagtacacccatgtcacgatcccccttcgtacgtaaaatggctcataatggttttactcactccacggtacggtgcatgactgcatgcatcacgtatgcatacttgccaagttgccatgaacgcctacaacctctgcaacctgatttgctccctgaacttggcgatgaactcgtcggccttcctgtccacctcgtcctccacctccgccgccagctcggagagctcatcaccgtcaccgttgtagtcgtcatggtcgacgtacgacctttgcggcgacgcggccatctcgtcctgcacgtcagccttctcgtcgtcgtcgtcgtcccagtcggtgacctcgccgtcgtcgctgaacgactggtcgcaacgaggcgccggagaaatgtagctcgggaagcccttcgacatggcggacggcgccgccgccgtcgcagtagcagcgggtttccgggacctgcagacggcgtcaagaacagagggcggcgaaggggcggcgccccagaatcccgccgtcgatgcggagctgtccgtctctgcgccaatgccgtcgtcgctggcatcgccggcttcggactctatccccggcatcgtcggcgccggtggcggcggcttcagcctccgcaccggcaaggaaagcggcctcccgctcgcgccgccgccgccgccgtcgtcactcgccgcattgtcggcgaccacgacgagggggtcgtcgctgaggtaccgagagttccacgccctggcgccatcatctccaccgccgccgccgccgcctccgccgctgccaccggtggaaatcttctgggcgaagacgccataggagacgacgaggccgaggaggaagaggtggggcacctcccacaccgcctgcgccagcgatggcagcagggagacggccccgacggcgacggcgagcagcacggccacgggcgcgagggccgaggagaactgcttgctgctgttcatcgcgttcttcgcgacgacatggatgccgccgccgccgccgccttgcgtactggaagagaacgacgccgcggcttcgacgacgtcgtcggccattgccagcttgcgcgcgcgcgcgggcagacgtacgcggagaaggcttgtgcgtgtcacggcgcgcggtgtacgttgctgggatgagatcgccgtgctttggatgcaaacctcgcggtagctgctactgtttggggataccttgctttgcgccgcggagaggcttggctgcaaagcaacggtgaatatcgagatgatgatgacgccgcggtttcaactttggaaggctgctctgctccgcgtgatcgctttggcataatcacgtccacacggtcacggcatggtaacagccctagcctagctcctatcctccaacgaactgaacgagaaatctccatagtacctgctactgccatctcaaaataagtacagtcgtgagaatccgtatacaaagtttgactagccatcttatttaaaaaatttatgagaaaattaaaataagttagtcacacataaaatattattcatgttttatcatctaataacattaaaaatattaatcgtaaaaaaatttcaaataaaacgaacggtcaaacgtgagacataaacagtgcaaaactacacttattttgaggcagagatagtagtaatgaatctaacaaagataaagattaagtggttgatacggaaaacatgaaaaccattaacacatgattaattaagttttcaattattataaacttagaaaatgaatttatgtgatattttaaaacaatttatgtgtagaaaatttagtacaaaatacaccatttagcattctgaaaaacatgttgggcagaaatagagaaaaaaatatgtatcttaatgtcttctttttgcacattttagcatgcgaggatgattgttttgcgcgaaaaacaaaagaaaatgttagtaggatgtcgtcttctttttgcgcattttggcatgagaggacgattgttttgtgcgaaaaacaaaagaaaaaggaacggtttgatttctcgagagaagcgaaaagggaaagatgcggttgacgaggggcatggggacgtctcggcgattcgtcggggctcaggaagttacacacttggccacaaaggcaccgacacccctcgatcacggctgtccgctttgtcttgctccgcgccggccgacatcatccaccatcagtggcgatcatttccctcaatgattctccggggctcgcagttgaaagatatctggccgatcatgctgctgatacgcacagagattacagaagatagcaatttgcctattcctagtttctacagtggatccatggattctgtacgatctacagttctacaccgctggtcataacagtgcaatgctctgtttatgtgttgtcataacagtgtaatgctctgtttatgtgtttcagtcgtctgtacttgggcagtcccggttgctcaatgcctcattgcctcaaccagtgaagactgaagagtagtgctctgtttccatccaaagcatgcattgcatctactacttgttaccggctggttcatagttcagactgatgagtagtatagtattcacttgtatttttaattaacaggacactggatcgctggctggtctcatgcttgctgccctgcctacccaatacccgtgtaaatccatccagctccagcagcatcagccgacacggatgctttgccggcgcacgggggttaaaattaggcacggtgcagctgtgcccagccccagtgggctaaatcgtcacagtgtgcagatccaccaaccattccgacgaagaatattattgccccagggtacgtcgcagtgtgcccagacatgttctgatcatatgttcgcttcactctacttccggatattggaatcactttttttttttttgaaacggagatattggaatcactttacagagcaagttctgctttattacacagcatgtcattgtttcagaccaaaactactcctgcacttagggggtgtttgggaacttagagactaaatttagtctttctcacaaaattataagtccctatggtagggacttatatttttgtgagagggactaaagtttagttccactttagtccctccaaccaaacaccaccttagtaaactacatgcctgctctttccggtggcaaaattgaagcgacccaggcttctgcattccgtaatctgggcgctgtgttttccattttctacagaaaaaatagcaacagagtatcgaacaggaacttctgtacagcatacaagtacaacacgccggggccttttgcaatcgtcccttcgggagaaaaaagagaagggaatagctacacctcgggtcctgacgcaaagaggttgacaaggcctccgaaagcttgaacagatacctcacaggcctgaagaagttctccgtccaagttccagacactttcgtcatgtgacgatataaaagtaaatgcttgtgtctgcggaaatcggaagatcatgctcagatataataacatgaaggtaaaatgaagaaagaaaagaaaagaaaatgatccttatgatgttcgacaaacttgaagctcagaggatctgagcccttcttggtaaattgtgttagatgcctgcagataagtcagaactcataagaacatactctgcaaacagggatagtgaccaaatctagaaactaatttctgagtgaatttagcatgttctttagtttgtgaaaactacataaaagtggaaatatactagatttattttattttgtattcccatttctgttatgcctgtgcggccatgttcacttcagtgagtaaacatacatcaactatgaaaaggttcagagttccaactcgagcgcaaccagtctataaaaaatagctaaatagggatggtgggtcaatatataggtacccattgacccactttagttcaactgaatcaactaaaaatgaactcatctgactattagttcagctagcttgggtaaatggatatccatgtattgacctactcccttcctaaattaagaaaactttttaaacttgggataatacgcacaccggacctcttgtaacagatttctcaccataagtaaaagggaagagggcaatctctaatgagcagaagatgaagaaaaccatcagataggtgtgcgtcagctactagaccatcaggggctctttcgttacgacatgaaatgacagctgcaccaacactgagaaaacgacccttggaccagacccattttggggtctcacaagctgttctggaactgtctggattttcatcttctgaattctgttcagatgttgaagttcctttgcatattaaacaatttgttcggcagatggttttccgatgtctattttgatggtattgcagtgtttggactccatttgcattattctctgccgatgctgtaagtgaatgagtgtttccattttcaagaaaagccacttttgcctcataagatctgaaaaacaactagagactgttaatttcaaactgaataggtagataccagcacaaattcattgttaatcacctgtgcttcaaaaataccattgttccagagaagtcatatcgcgcaggacccatccacctgtacttttcactctcccttataacttctccataaaatccatatctgtaatcagatttaaaccacagggtttcagcagttatgcaaaagaggaatccgcagatggtcatatccaaaagactccattttttaatggatgacgctgttgacttttgaacacatgtttgagcattcgttttattcaaaaaatgtatgcaaatgtataagatataaaccatgtttaaagtaccttgagtgataaaacaactcacaacaaaataaattataattacgtaagtttttttttgaacaagacgaatggtcaaacacgtgacaaaaagtcaacggcgtcgtctattaaaaaacggacggaggtagtgtatgttcagtgcaatccatgactgcctgtgatgctaggaagaacacaagaaaataatatgtttccctaaaagatttaggttaaaaacataacaatctagcttgggttaactttttgaaagtgacttcaactgaagctctgaagttttctccagaactttaagcccttttatggactgatgttaacgttgacataggatgcctatgctggtactgcacaacgacacagccacatgtaagaaataggtaatcagaaatcaaatttgtggtagtattagctatatatcatgtctaagagacagtagcataccctgcaaacgaagcagcatagcgcacagttggtgaaacctcagctgatgggctacttttccatctgacaacttgagctatatcaagtgatatccttctgccgaggataataagcagagcagaagtcacaggatctcgctccccagttgtactgcaaacatcaacagggcttcaacaaccagaaaagaactgaaagtgatgatcaataatttgtatgcaacaatattgggcttatttttagtcatcacaagacagcaaatggttaatacaatgcatgtgctcctagtgttcaatggatttaaagcttaatagaagaaaacttcccaaggtgcatagtagtgttgaaggatcagcttgatattattttagcaggtttgtgggttattgcatgtttggcgttattgcacataaactgtcaggtatgattagaggatcataagttcataaaccagcttgcatgcaacggaacatagttacagttttttaagggatttgaatttccaatgttaagcaaacattgtaatcctagtaatacagatcagtaagaatagatataaaattgattactacctgagaacaatagcatccgttgagccagaaggaattattccaagcctaaaccaattatttgggaaggagactaaaggcacctgatctgcagtagcataaagtggaaatgaaacaggaactctatgtaagtcagtaaatcttaaaagtgtaacaattttaagataaagcaatagttaggatttcgcactgacctccattgcatggttcatcactagaatctacaaataagagacaagaaaattacttacaagagaaatttctctgtataatatgaggtagatgtaaattgtaaaatcaaagacatacctgatgacgagatgtccaatcctgtagatcgtgtggttgaaagaaggggctcatgatcatcaggtgtgttagaacttccagagatggcatttgcatcatctcctgtgagctcactattgcttagatcattatttctatgttcttgacacttcatgttgtttctgaaatatccaaacccttctggagttggaggataagaatttgtgtgccttgtacttagtagcccattcaaaatttcattaaataaaccatcaccaccctaaaatgtacagtttggagatcagggtagtaaaacgaggaggaacttcagtatgcttatgatttatgaacaagttgaaaagtggattgagaatgtgagtttttttttctctcaaagtgaaaagtgaaagttaggtttgtttctctagtggcaatcaatgcaaggttttatatagccatacaaaatttttggacatgtactaagtaatctccaattctccatgaaatttaaccaagaggtatattttgacaagcttgaagtgtttttcaaaatacataataaagcagtagaatatgagcatgctcttgtggccagatgcagctgattgtggatcataactaagcgtgttctctggcctagcactcatcttgtaattgtgatgcttaatatcaaacaatgatagacaagcatttattgtgttctaataaaaaaagggtaagcataagcatcatagcacttccctataactataaattattcaggaaaacagagaacattattttgaacgaataagtagaaaaaaaatcactcaagttcacataccactgcaataacaccatcaaatttcttgagatctttatctgataaagatgctaaagtatcatatgcatgtcctgctcgctgtgtgactatcacctgaagcaatgtgcatatgaggcgatcaggagttggagctttgagggttgttcaacaaaaaacttataatggtaatgtcacaagatcagaaaagaaaatcagtcatacacatcatatgctcatctttaactgttatagattttttatacttccactggcagaagtttaccttcgtttttacttttgcccgctcaaataatggagctactgtttcccaattcttacaccctctaccttttccacacaatggatggacaaatacctacaacatgaaaattagttgatgcaagaatataagaccaacgttgagcagcactgacatgtttgtcaaaatgctatgtcaaggagcagaaaagcacatcatatttaccatgaggctcttgggcctatcctgttccttatttatgcacgtctttatatgctccacccaagttttgcaggtttgctggtctttatgaccaaaaatatattcacaaggtacccatggagatggtctttttcttggtcttgtgaccgtgtgtatgacaaatcggttcatctgcatgagcaacagttttttgtcaattatttgtaaaaggtgtcatctggaagagcttatataatgcattatttaatatggcacgaacgctttgacacatattacagaaaattaagtctgcaaagtaactagaagggatgttatacctcagtatttatcttgccttgaacggtagctcttgcattccaaggttcacatacaggacccacctcaagaagctctacagcatagacatctgaaaacttaagcttgctctctaacttaggttgcattatgatagatgaccaacatgaagaactcacttcctgcaatgtacagaagcacaatgagcagaaaacacacaggtgcatgtcaaaagcaaactgatagcttctatgagtacttgtatgatttgcagatggataatgtaagtctgacggaatagtaaaattgcactatccttgctgataggaactaaatgcatgtcaaaaatgtcatattcaccaactatgtctttccacacgagctgggggagtctggagctctttattgaatatttcaaccaaggttcaagctgtgttttgtgaaatgatagcttcacaaacacactactagtgttcctgtttctagtttgagtaagaatattatcccttttaaaaaagcatgcttatgctggtcacagacgcaatcacacatctatacaccgtcatcaacacaagctacttatgttccaaacagaaacttcaatatcgccatgttggccaagatagcgatcctctcctgagcttttcattaaccactgattttcatgaatctcctgaaaattgttggtataaatagtgaaccaactagcctatgttcagaattctaataggtacagtacaaggttgtagattcactatttcagacaccagcgcattattcatcgtctacgcctctctatctaccttccgtttcttcgattcaagaacccgaagaccggaagctacgaatttcctgactccatcctacaattcaaccaagactcctgtcaaaaccccagttaagtctgtaggatctaaagactagattcggggtgagcgcagacgggcagaagggcagcggcgggtgcggctgtgcgtaaacctggtgaaggggctggaaggagaggccgtcgtcgccgacggccaccgtgacctccccgacgccgtccaggaagagcgcctcgccgccgccttccatggcctttcccgcttgctgttgcttggtctcacgactcctccccggtcacccgcggtgggggaagaggaggggcaaatgcgaattcttcctctgtttttttttcctttttcagttgggtctgtgcgcgcttgggtccgtggtggctgctttcgcgtgttcgctggctggacgtttttgaccaacggcgccttttcttgtcagtccttgtgcttgtacagttcaataactttgccaacaaattatccgtagcaaacgactattcttactgtttttacttctcttaaagtttataaaatatggagaggtcaaaaaaaaaatatagtggtttgaaattacaagagagtgccatctcacaatcacttataactttagagcaagaataatagtttcgtcgacaaccgagtacataacatctaactcatctgcacaaggagctttatagcaaagatcatatgcaatagcaggttgttaaattagcaaactgctaaaacttttgcgtagatttagcatggctagtcgcacatgtcccacaaaaccacgtgagtttccgtcagcatgggctgcaagtgggttacgatctcttttttccggtgctaccacctagcgataaatcaactgctcgtatttctctctcttcttctctcaatcttctacctagaattgaggtaatgtggatcaatttatcacccgctgactcatctttattgtatctgctattaaacttctcgaatgaaattggataaaattctggatactcgtggcacgtttttaaaccgctaaacggtgcgtttcgtgaaaaaaaaattcctatataaaagtggttctaaaacgtcaaattaatttgtttttcaagtttgtaataattaaaacttaattaataaattaatttgcttttcaaagtttgtaataattaaaacttaattaatcatacattaataccaccttattttacgtaaaacacttaatctttatcttcaggagaaaataacaccacccgatggcatgcctttacattttcagcagcacttaaaacaaaatataccatcgatgcaaccattatatatttaaaaataaatctatttgattttatatggtttgaggagaaatagttgattcggtaagcctattgcataattgcacaaacgacgacgagcagcagcagcagcagcaccaccaccaccgcttcgtccgccccgtgccccaacggccgacgctgctgcacggcacggcccccggccgaatctgccgtgcgcgggttggcacagtggcacacgcccaaattccatccctcccgtccctagccggttcctctccttcctccccccctcgcaaaaattcaaaaaaaagcttgcgctcctcccgtcctccggcgccgatctgctcgaaggaggccacccccaacctccccgaccaaaccaatggcttcctccaacgaaacctaccgcgtcgagctccgagccgccgcccgccagctcggcgagcgcggcctctactccgccgccaaatggtacgtacgccccccttcccctaaaacccaccagggcccccctcctctaaaccctaaccctaaccctaaccgccgccgcctcttccttcctttgtagggcggccgagctgctcgtcggaatcgagcccgacgcgacgccggccccgtcgtcggtgatggacaccccttcctcgtcgggctccgccgcatccgggggccgcctcctgcacctccaccgcagcggcgggtccagcttccgccgccgcctccgcccgggcgcggccgaggccgggacgccgctcggcggcgtctcgtacgtcagcacgcccatccccgacgacgacgcgttcgacgtggggggtgataggtacctgctcgccaagacctacttcgactgccgcgagtaccgccgcgccgcgcacgtcctgcgcggccagaccggccgcaaggccgtgttccttcggtgctatgccctgtacacggtgagttcggatcctattgtttttttttaattattattttggtgtgcgcgggcgtgttccagtttgcagatgtttggtatagcgagtggtgtttgtctgcttgaggaaatgtctctctggagctgctgcaaatatttacggctgcaattcgcttatagagttattcatatttttcaacctgtagaaacatctgattagttatcttgacgtgtcaatggagtaacagtagtgggatcttactgaaggaaacaccaggaatacattaaaattgttgtaaaaacgtaaaaatatttttatttggtatgttctcctttgttcatggtttgggcgctaaatctttgaagccctaggagcgccgatactaggatttacttgtcttaatttccccccatgtcatggtataatgatgtactgatttatgtcagtttaaaccttagtaatttggtaaatgtctgaacatattgaaaaatgctgaaccctttattttacataactgttgcttatttgcttcgttcctggttgtttggtgtccttaattatgcattacagggatgcttgattatttttattgtaagcaggggatgctggtttgctgcaatgttaacattagacgaatttattgcatgcaggaatgcattttactaatacagtggttctgttgtaatgaagtttggaaacattatattctaatattgagatgtatgggcagtataagatgttaacttatagtagtaacatgattgcctgatgcaacaaggagggctgaggatccaggtccataaatgatttatcttttcctctttgctatttaatttgtgatctgctaaaataggagtataggacacgccatagtaatacagtatataactgtacgcttgaggctatgttgcttttgattgctagtgtgccactagtgaatagtgactagtattgaagtattcaatttagaaccgtgctgatttccattttagcaggtctttctattacctggatttttatttaagttggtaagcttcactgtcaatatatacagttattgtcaatctttgcatcaatgtatgtctatatacactaacttattagatcgtacaaatgtggctagcagtcttcttatccatggaaggattctattaaatgatttatcttttcctctacaggttatctaatcttctaaatactagaaactgtctcccatttgcttcatagtttaattagcattttgaaatttgacatgcttggtgatcatagttcttttctctacaatttaggctggagagaaacggaaagaggaagaaacagtcgagcttgagggatctctgggcaaaagcaatgctgttaatcaggaactagttgcattggagagagagctcgcaacacatcggagaactggtgctattgattcattttgtttgtacttgtatggcattgttctacgtgataaaggcagtgaagctctacctggaacaggtttggtgggaaactgtaaacacctacccttggaactgg

SEQ ID NO: 60538 - DNA, 1353 bp, Oryza sativa
cctgcagcccgttgaggatgggaaggccgatggcggcgcatggacgagcagcggcgcacggcgacgaacgcgacgccgaggcggcatcgcgtcacggcgggcgtgccggggaagggaacggaggcgtgcggtggcgcccttggtcgcggcggtggcattcttggccgcggcgaccaagaaggcggcgacgctccggggttggccgcgcgacggcgaccgaggttgagggaggaggcggcagaggacggaccgtgcgacggcgagatgtcgccggacatagagctcgacgcgacggcgaggagttcccatggcggcagggctccgccgcttggggggggaacgaagcaagggagggaggaagcacggggggtgggttttatagagacggagtgggagcggcaaggtcggttcgaggtggccgcggttttctcggcgctcggctggtgttcatgggcgccgcgagaacgagctacggcgaggatgcaaagggtggtggaggcggtggatcgtgtggtggaaatcgaaccgcgagcacgggaggattggcgcggggcgagcgggtgcggtcaaggtgggggcggcgaggcgctgcagcggcgtcagcggctctgccttttgaacaagaagccaaggagtggaggcagggagctcgctacccgggaggggaaaaagcgaaaggaggaggaggaaagggagctttgctccttccggtttgggaggaaagggatgagagcgagccgcgcctcacggttttggatgcatgcggcatggggcgccgggcccgggaggatgacgccggcgacgactgcaaaaggacggggacggtttgaaggcaagcgcggacacggtggtcgtcggggcaggcgacgaccgagggtggcgatggcggcacccaggcggtcggccactcgcacgggtgtgcgggaatcgaaggaggcagccggaattttgggcggcgtcggcgggaagcgacgccgagagagagagagagagagagggggggcgctctctgagggagtcacgtgcggcgcacgtgcgatggagaggctggcgaaagaagaggatgggccgaggatggtttcggcccgagcgagttggagggaggcaaaatagacttttactggaaggtttgatttggagagaagtttgatgtggagattgaatttgaatttaatttgtgtatttgtacacgagggttcaaggtggatccaagggaggggtcaaggaagggcttcaaaagcgggaattttggtattcttgggatggatttatatttggcggcacgaaggattatttcagaggatttcaaaaagggaagatcattattcaaaaatggaacaagggagatagggg

SEQ ID NO: 60539 - DNA, 1426 bp, Oryza sativa
gacgtagaatcagaaccattggaatactgagattctccctgatagtactgcactggcgggtctatctcttgacgcaaaccttctcttgcttgatcctctaaggacattaccttgtgcttcttgtagtcctgcatttctttttctgcatcttctagtaacaaggctttattgaccatgtgctgaaacgttggaaagtcgtgagctaaaggtttcactcgcaatttcgcttccgttccttttagaaaccttttgatcttcttcttatcaatgtccacatcttccggggcatatcgagccaatccgttgaagcgactcaaatactcgttgatgcaagaggatccttgcttgatatttgcaaattcttccttcttcaaatcaattatgctttcagggatgtgtgctaagcgaaaggcttctgcaaactctgtccagatgatggtactagcatctgtatgggtagcacagtagttatcccaccaatttgtggtatgtcttcttaactgatgtacggcataaaagggttttcttctacggagtgcactgcaccaaatttaatttcctttccacatctttgatccagtcattggcttcaatggtctcagttgtttgggagaaccccggtgggcgagatcttaagaattcgttcagtcttgaccgacaattatcttgaaccatatggggttgatgctcttgcgtgtgttgtcgttgcataacaactatattctgaatcattccttgtaatatctgggtttgcatggccatgagtgggcaaaagtccactgttggggggctgatttctgtactgcggcatcattagttgatccagaaacaactgcatgatcacttctcaatctgttgctcatctgctaggctaattgactgatcgggaatttctgactgagctgacccttctttagaaccagggcggttaggggcacggatctgacggatagaacaatgtgccattggcttcagagtgactgagatctgactgaaccagaaatgggataagaaaagaaggaaaacaaaaacactacatcaaaacggttttcgaaatcacagaagacataggtggtgtattccagtcggtatcccaactggtctaacacctgaacacggactaccaaacaaaactcacgcacgcactagttcaccacaactcctaccgagcgggtgacggtactagggtctgcctaccaacgagggcttaactaagactcctagaggcttgagctcacctttcttcaactgggcgtgaagacaggtttactctaggataaaggtcaaaacactcgactagcttctacttttggacacgaaaagatttttcgcaaaactagagctaaaggggacaacgacaccttagctttcacaaatagtttttttttttggtactcaaataatgccatcctattaaggggtttcg

SEQ ID NO: 60540 - DNA, 590 bp, Oryza sativa
tcctgcagccccgacataatgtacctctaactaatacaggatatcgtaattgtgttcttttgtaggtgcaatgttagtttcttctgctgaaaatatgatgacaaaactgtatagatgcatatgttatttcctagctgcaagatcatgattagatgatgtcatgattgtgttcttttgtgggtgcgtgatataccttcttatgccatagatgattcgcaaggtgccgcagacttcttctgctccgtccgccggaatcgacttcttctgctccgtcgtcggaatcgacttcttccggaatcgactaatgtcgcatgctggcggggtgtatatatatgtatgcaagccttacgaatattgtctcatgtatatggaactaatccttcttgcaattaataatctttcctagtgatctaaattttgctttttgagatttggaatcttgccctgtgtacacgtacatatatttatggaaataatgtgcgggccctacgaggtgctgaattcctctcgttacgccacgtggcaacttgagagtgttttgagggagacacgtggcagcttgagagcgtttgtagggagtttaatggact

SEQ ID NO: 60541 - DNA, 691 bp, Oryza sativa
taggttgacgtatttcaatcctagtagaaatgcacagtaccaccacccctagcaggtaaccaagtacgctgcgacccagtttctacttagagaaccctaggtcgcatcagagagggtaaaaaaatggcgaaacgagggaggggcgtcgcccgacctgaggaaggcgtcggcgccgtcgtcgccgccgttcgcctcctcggaggaggagccgtcgtcgttgaccatctccacgttgagctcctccatatcgagctgcaggatctcctccatctgccgccgctccctcgccgggaccccgtcccagtccgccatctcgccgccggtgccggtgccggtgcggtgcgccgcgggacggggagaattccaacgggaaggaaccggcccggtccctgaccgcgcaagcgagatttgggttggtttccccttccttcctttctgggccgggtcgaggcccagctttctgtagacgcttctcgtcttgtcgagtctcgacgacgcaaagcgaggcgtacttgacccacacagcccaatacataagagaaagtttaatagtacagttcactactacctccaattcatctataaccaaacctaatacctaattcataaaatagttacttactatactattaatatatggtctcacccatcatatccacattgcgtcttagagtccgtgctgcaactgagg

SEQ ID NO: 60542 - DNA, 1220 bp, Oryza sativa
aaatatgcagtacaagagggataacttgaacgtaaagcagagacaaatcgatacagagcaaagacatgggaacagagcaacaggacattagtgcagtacacattgacgatgcagggatgcacgatgcaatacctgaggacagcgcccgttgtacagcccaatcgcgagtgaagcggttggcgatgcagtagctcggcggcgcaaccagctcggcctcgcactccacaaccttgcgggagcgcacgtcagatcgagacctccgtccccgccacccacgtcgccgtccccccgtccacaccgcctgcagctctccgctagcgctctctgcccgcaacccacgccatccccgccgcccgtcgccgtccccgccatctacgccagcaacccacgccatccccgccgtctgtcgccgtccccgccgcctacgccgccaacccaagccatccctgccgcctgcgccgccgtcccccctgcccaaagctctccgctcgcacctccggcccgcgccatccgccctcctcgtccgcccttcccctcagacctcatcctttccattttcccctcttctgtcactctctccttgctatccatacgtatactcgtatagcggaatagaaaagaagagcaaaaaaaattagctagagttacagagtattagttgcctactactaattagtattttagtcaaagcaaagtgatgcaaaatttgtttggttaagtgcagttttttttcacaaatgcataattatttcatctacatagattaacaaaatttaacaatcatctgtgtttttcctgtacttgcgagacgaaacttttaaaactaattgcgccatgatctaacaatgccgtgctacagtaaccatttgctaatgacggattatttacgcttaataaatttgtctcacagtttatatgcggattatgtaatttgttttgttaataatctatgtgttaataattcagataaccacttttctctatcctctattttacacatgcttctaaaaaatcctacgctaccacatgatttaaaatcttagacctattattttggaccattacattatatcttttcaaaataaaaaacatatataaaatataagaaaaaaaatatgaccattgtaactttaatcggtaaaacaattatttacatccgatagaccaatccttaaaaatacaaatccattccacctccctcccgtacataatcactcatc

SEQ ID NO: 60543 - DNA, 2997 bp, Oryza sativa
cagcaccggcgcctggacgcacggcaacttcgtggctcgccgccgccggcggcaatggcgccgctgcctcgccttcgtcctccccgccacgcggacgctcttcttcttcgagcacatgtccggcgacgactacctcggcgtcatcacgtgcatcccgatgccggacgagccggtcggcggcttcctcgccagaatccctgtcatccgccggtgggcgacccctcgccggagcggcaggtgggactgcgtctgcaagacgtgccgccgcggcctccgcgtgacgcaccactggctgaagaggaaggtgatcggcgagttcccgtgcgggcacatggtggcggagagcgtctgcaagatgtgctaccactactccgacgtcgtccatccgagcccgggcaagttcgcgcgcgggtacctggagcacgaagacgaatttggccactacggccgtaatggcttgagggattatccatgttaactaaccccagcgtgtttctcttcgcttgcaatgctcacattagaagatctacactaataaatacgtatgtaacagatatttttgtcacttacaggtaggagtagaaatttgacatgttgcagcaaacaattcgtcatgcatgttagagctgcacaatttcagattttgctatatatatttcagaatttgatgcttgtgttggataatttcgtaggtgaaggcgtccagcacgctgtcatgatgcgataatgcttctctttggacaatttcgtatgagtgaaggcgtccagcatgctgtcatgatggtattatgaactgcactgtaatattattagtccaaaattctagaccccaggaaattggatattaatttcctattaccaaagtgctaaatgctgaatgtcctgcagagaaagctaataatcaggaaaaatccgccgtccgcccattacttgccttgctcaactgggcttgagcacatcctgatcaattctacgggcttctagaaaaactgtgaagcgaggcttaaaatctgaattttgattctaggactagaaggtgtttctttcagaacgatgaattcttgttagtgacctgtcctcatatcaacatctgaagccttgtgaaatcgaggagtagcatctagcagatagtgccgttctagaatcttgatggttacaatccctgtctggatctcgcgtgcggttttctcaaaagtcaaaaacacaagctgttactctctggaagcgaatcaatcatatagtcttcgggtacacttggaccatacagtagcttgcatctctgtccacaacctttttactcaaaactcaaaaaagtcgttgaagtttcagtacagaaggaactgacagagtagtgccgaactcttaacgaaaaaccaaattcgctacatctgcagcgcaatttttcctttgcggacagtgtgctaagcggtgaattctgcaacacaacgagtttcagagtctacaatgtcctagcctactacaccaaaactcagactaatcatggacttactgccagaatagttagtactaatgtttagcaatataaaacgcaacaatgtgctggtaggtagtaggagttgtacagacagtgggcatcagagtgacatcctttatgtgtttttctgaagctagtctacgcacaagtccacagtcagcaaaggcgagccgggctctttgaaattttcttcagtttctgacgttgcacatgagacttcctgctcctttccttcgtggccactctcactcatcgctagccactggatcaccgaacgtgcggctgagatcgaagctgggatctctctgtgggagacgggtcaatgggctgcacagctgcatcatccagaagcatttcctgtcgctgccagcattgtcatcgagcacctatacggtgtgcattttcaggttaaaaaaaaaaacggagtatccaaagctatactcggtattctagaagtgaagaaaccggataaacttttcactgtggtatttatccatatataccgactatatactgtatgcacgtgtggtattgagtgcagtatcttatgctccctttcacttaccgtttcaggcctacgactagtcaacgaatgaccacaaagagtttaaagacaacccagaggcgccagagccacatcattatctaagacttttctgtttgactcaactttagaccagggatttgtgcacgagtacatctagatgtgacactgacatcgtgggcccaactcaccctgaacccgtgacctcgtgctgacgactcacattcccggcctcaggtggatgatccccctgtaaaatcagtggaaacaaaaagcttatcatcatttgctaattgcttccactttaaatttacttgccgtgcttgaccggttataatctcgactctcgtaatagttttctttttctttgaagactaataaatagtgtgatactagttctaatcggtttgaagatatactaaaagaaatggtttcaacagcgacaatacggccagtggagcaaaattagatgtttaaattattggtggccatgggtgatagcaataagatcgcgcgatctgcaacatcttccactcctctttgtcgcaagtgatcgacacctctgtgcttccgaatagtttgaccattcatccgacggcagagtaatgtgccggcacatgctacagtccaagccaacggagcatattgtcgtaccttgatcatgaaaagatcgcaaaactcccataaagaaaccatgtcacgagctgtgcaattcgtacacgttgctcagcttagtccttaacttaacttagtagtagctgcataaacaaaccatctagaacatatccctttcaaacaacgccaccatctgaccagcaaaaaccaaacaaaagatgagctaaaccaccaactggtgaactagtatcaaattataaaggaaagcatggctgaaacttccaagcaagcagcacccaaaaactaatcctaaattcctaacaaattcaatcatttaaccaaa

SEQ ID NO: 60544 - DNA, 14557 bp, Oryza sativa
tgtgggtcccatcttttttattattattttatgtgactgacatgtgggtcccacagattttattatttttctagatcggattgccacgtaagcaccacgtcagtaccacatcaaatgaagaccgagtcaaaatggacacgtaggcgttacgtcagccaaaaccacccttaaaatcgtcaaggtacctcgtttgtccggttttcgtaagttggggacgggtcgtaccggttttgcagttcagggacgaaaatcagactgggcgacaaatagagggacctaaaatgaacttattccttcaacgtttgtgtgctgacagagtgacgagcctcgattttctaaaaaagaaaaggttacaggcctcgaacaagatgctgttaccaaagttagccacgaatttggactagaaaatagctaaacatgacggcttgatcgaagattacgcaaagttttagttcgactttcgaacttataatagttcaaaataatcatctgctgtcatcatctactcaataaaaaccgaaatcctctgtcaccatcaaaacatagcaaaaatcaaatgccattaaaaagtgccaaatgacagttgacagcccaaaataaaaaagaagaaaaaaaaaggaacactattatattccagatttccagctgcaatatcaagctaccaaatggatccccaaaaaaattgcaatccattccatgaactgagcccaccatgcaccacacaacccccgctcctccacgcttctcgggctcccgtagaccgggtccacccgccaatccccccacacgtcgatatctccagcacccaccgcacccactctcctcctcactccgctcccctcctctcctcctcccttctcgcggaggccgccgcaaccaaaaaaaaaaaagtctaaccctagatccaggccccgcgtctccggcgatctcccggccatggcgactcgccgggccctctcctccctcgtccgcgccgcctccaggctccggggggcctcgcccgccccgcgcccgcgcgggccgctccaccgaccgtcgccatcggggtacctcttcaaccgcgccgccgcgtacgccacggccgccgcggcgaaggaggcggcgcctcccgcgcccgcgacggggaaggccacgggtggaggtaagatcaccgacgagttcaccggcgccggcgccgtcgggcaggtgtgccaggtcatcggcgccgtcgtcgacgtgcggtttgacgaggggctgcctcccatcctcacggcgctcgaggtgctcgaccacaacatccgcctcgtgctcgaggtggcgcagcaccttggcgagaacatggtgcgcaccatcgctatggacgggactgaggggcttgtccgcggtcagcgcgtcctcaacaccggctccccaatcactgtaatgcccccccgcccgtcttctcatccttgtttgcgatcgtacatttcatttcgtgttgtctccgaccagatctgacgaaatgtggatctactgctgtcagatttgatctaggtgtacagttctgagtggcgagcgatcgcccttccatttcgttcattttatcggtagactgttggctgctttgtggtggtctgttcgtgctagtgaagaaattgactttttttcccctataaagtgctgccttttggtttgtggtggtcatctagagtctattagaattcattatgttcaccagtgttgcatttccgtattggcgtattgtgaggttaacatgcattggttggtataacttttccactgtttgcttgaatgaaaattgtcgtcatagtctaggaatccattccagtttttgtttatttaatacccttgccaattgtttagcataaaatgggcattactgaattcagagaactgctgatgcattcgtgtaaattctgattataattagagttgctgaaccttgtatctgtagcattgtcttggaagttgaaactaatcatatataatgtgttctactatgtttttgacttggaagttattcttctttgtaggttcctgttggcagggccacgcttggacgtatcatgaatgttattggtgagccaattgatgagaagggtgacataagtaagttactatatgttccatgtcttcattattcatagttatttaagaatttgtgtgtccagttcttatttatgttttgttattgatgctgacttctattgtagcaacgaaccacttccttcccatccatcgtgaggcgcctgcttttgttgagcaagccacagaacagcaaattcttgttactggaattaaggtataattgtcccacccttctctgatcctgtggttatctgaagtatttgaatggtaaatagttgcaaccatgatttagagtcctaattgctgtacattggtttaattttataggttgtggatctgcttgcgccctaccaaagaggtggaaagatcggtctttttggtggtgcaggagtcggcaaaactgtccttattatggagttgatcaacaatgttgctaaggcccatggtatgcatctatacatagtctcatgtgtgatattgttcaaatttcagtcacttgttctatttgactgatgatgatttgtttgccaggtggtttctctgggtttgctggtgttggtgaacgtacccgtgaaggtaatgatctttacagggaaatgattgaaagtggtgtcatcaagctaggtgacaaacaggtaattttagttgatatcttattttctgtgggacgcacacatgtgcaagctacttatatatcaattttggttgcagagtgaaagcaagtgtgctcttgtctacgggcaaatgaatgagcccccgggtgctcgtgctcgtgttgggttgaccggtttgactgttgccgaacatttccgtgatgccgaaggacaagatgtgcttttgttcattgacaacattttccgtttcactcaggtaatttatgcaagacatctcttcttttggtatttctactctgcataaaaaagaattactagtagtatacgtagcgtaggtgtttctactaagtcccattgttatggttttgattaatcttgaatcttgatgtcaggcgaactctgaggtgtctgctcttcttggacgtattccatctgctgtgggatatcaaccaactcttgctactgatcttggaggacttcaagagcgaattacaactacaaagaagggttccattacatctgtccaagctatttatgtgcctgctgatgacttgacggatcctgctcctgctactacttttgcacatcttgatgctactactgtgttgtcacgacaggtttgtccaactgacctaatacatcgtgttaataatgtcctcattatgacttgaatttgctatctgtgcagatctctgagcttggtatttaccctgctgtcgatcctctggactccacatccagaatgctctccccccatgttttgggtgaggatcactacaacactgctcgtggtgtccaaaaggttcttcagaactacaagaatcttcaggatattattgcaattttgggtatggacgagctcagtgaagatgacaagttgaccgtcgctcgcgcaaggaagatccagcgtttcttgagccagcccttccatgtggctgaagttttcacgggtgctcctgggaagtacgtggagctgaaggagagcgtcaacagtttccaggtcagaattgaatatgcatagtagtttttggagttcagtaccactacggttacagtattttgcaatttttggggttataattgatgaatcagtatgtgcctgcaagaatacactagttttaccagacagtacaatccatctacacttttttaatcctttgttcagtaacacattttgctagatctgtagttgtagacacgcgatattacagaacttcattatgcttattagtaatgtatattcatgtttgcttgtgtgctctttgctaaagtttctgttgatgtgcagggtgttttggatgggaaatatgatgaccttcccgagcagtcattctatatggtgggaggcattgaggaagtcattgctaaagctgagaagatcgccaaggagtcggcttcataagatctcttcattgttaagttctgtacaagttaaatttttggattctggtttctatatgcccgttctgtagccaggacgtgattacaagcaggggtgacatcttctgatgagcgatgtttttttgtcttccttttctccttttacccctaataaggaaccgcagtgacattgtattgtgctgcacaaaagtactcggaacttcgaaagcatgtgtcctttataatgcagatccatgaagcataggatcattgagttcttgtttttagttggtaattctttctttattatttccatatccatgctttggttgtggctattcgcttctccggcggaagaatttgcaatcagaatgattgtgcttaattgtaaaattgattttaggatttttcattatagtcaacttctcaaccttagcttttaaaccgtaatacagatacaaaatttttacctataaattatttttaattgtttcattaactctttttactgccccactatgtacttctactagtttggttctcactactcaccactcagcataatctgcaacagctttatgagttgtttagcctaggcccatatcagtaaaactttccatctccagcccaattcaaaataaaaggcccaagagtgactagcccggcccagtatatctatcagcctgtgccgcccaaatccggtgatccaaaatcgtttccccctctccctcccattttcaagttgtttcgaacaattctcttcaatccctcatcatttcccccaaaatcgcgcggccgtctccggccaaatccacgccgccgccgccgccgccgccgccgccgccgaggacgacgcagcggtgccctcgtttcggcctcccgtatcgccctccgtcgagccgagccaccgagactggtgagtgaactcgaggccgtaggcgttactgctggttgatcgtgccaaccctaattctgacgccgatcaatctctccccgtttgattcccctgcaggctgcgtggtatcgtcctcacgaggagcggcaatccgaaggagcgcctcctcccgatgaagaccatatgcggatccctcatgcacgagctccaggtgcgcctcgctgtcgactgatctgctgttgccgcgatggcggtgacaggttttgttggtctctcgctgattcagatcgctcgtggttgcaggtcatctgggacgaggtcggggagcccgaggccgcgagggacaggatgctgctggagctcgagcaggagtgcctggaggtgtacaggaggaaggtggaccaggcgaaccgctcccgcgcccagctgcggcaggcgatcgctcaatatgaagctgaactcgccgccatctgctccgccattggcgagacgacggtccacgtcaggcaggtctgtcacttttgcttctgttttctgtcgtttaagagcttatgttttgatggttgatacgatttactgtgttatggtactataatggtttggggcgcatcagaatttagccgtttctccgattcaaaaacactacccacaattgtattgtgatattatcgaattattattaggctatgaattcatatgttcttcgtatactacctttcgcctgtattcaagcatggtaacttcatcattttccgttagcatattttccgaactggtaaccagtgtgtgttttgcaaaaactttttgcataaaaatttattctaaaaaacaaataaacccaatttttgagtttataataattaattcttaattaatcatgcactaatgacttatattgttgtgcatgccacggagttgccacacccaatagccggaaggagcacaaccctctagattatatcccatctagtactggttgctatatcttgagacggaggtagtatatgattacagtcacagatgggctcatttaatgtgtattatttagttatccaacttgaaaggtagaagtatgctgtagcgaaataggatctaccagtaaggcagtaattagttctttgtttttgattgttttatcagtctaatcagaaagcatgtggattacgggatgagctcggtgcaatattcccatacctagaagagatgaagaggaagaaggttgaaagatggaaccagtttcttgatgtcgtaggaaggataaagaagatctcatctgagataaggccagcaaattttgacccttttaaagtgtctgtggatcaatctgatctatcattaagaaagcttgaagagttaagggtggagctgaagtcccttgaaaaggagaaggttcttcttgaagcttttagctctatgtattatttgaattccttttcaatttctattttctaatgtattctgattcagttattaaatttctgaattctgatagggtgagagggtaaagcaagttatggaatatttgaagactttacattctttatgtgtagtacttggtgtcgacttcaagaaaacaatatctgaaatacaccctagtcttgatgaagctgaagggccaaggaatataagcaacactacaattgagatgctagcatgggcgattcagagacttcgtgaaacaaaaatgcagaggatgcagaaggtctgcatcttactatttcaattcagggaatggccaaatggtatatatctgctttcaactaactgtattagctctgccagcttcaagatcttgcatctaccttgctagaactatggaatctaatggatacgccatttgaagagcagcaggcataccagaatataacatgtaatattgctgcttcagaggctgaattaacagaacagaacaccctttccattgagttcctcaactatgtgagttaatgatcttttggagaacttgctttcgtgagtcttgtggttgtcattttctgttttctactgagataatgatactagagtcagaggacatgatattctttgatccaggtggaagctgaggtattaaggcttgaacagcacaaagcaagcaaaatgaaggagcttgttctcaagaagaaaacagaactagaagaacatcgacgacgggcacatttagttggagaggaaggttatgcaactcagttcacaattgaggccattgaagcaggtaatatgttatggaatgattccctgggtgtgttcgcttttcctagatcccaaccggatccctctgcacggaaaatggagtggttcattagcgcgtgattaattaagtattagctattttttttaaaaaaatggattaatttgattttttaagcaactttcatatagaacctttttttttgcaaaaaacgtaccgtttagcagtttgaaaaacttgcgcgcggaaaacgagagagagaggagttgggaaaaggggcatccgaacacacccttagatttctgtgcaagttcttgaaggtagtttcagttaattgatcctcctacctcctttgctcatgcattccgttgagaggatgtgtcatgtgtgttaagctgttaatgctgtttatttagtaaaatgttttattgcccaaaatatgtcttcactctttccatttcaggggctattgatccctctttgttgctcgagcaaattgaggcttatatttcaacagtgaaagaggaagcttttagcaggaaggacattctcgagcgagttgagaagtggctaaatgcacgtgaggaagaggcttggttggaagattacaacaaagtactgtcctatcagaacaatttatatgaaaagattttttttccgcacctgctgctgattgcggtgtccgcatgacatgatcaggatgacaaccggtataatgctgggagaggtgcacacattatgcttaagagggctgaaaaagcgcgtgttctggttagcaagattccaggtgacaatcaattattaaacacaatgttatgctttcattcttaatttcttatcatttctgctcctgatttgctgctattgtgttgtggacaggaatggtagatgttcttgaaacaaaaaccagagcttgggaaactgaaagaggcaatgagttcacatatgatggcgtatatttctctattcatgccgtttattttatgtattatttacaaagccagttttgagaattgccaaaactcgtgtcgtacaatgtttgcaggtccgacttatattgatgcttgaagaatacatggttgttcgtcaagagaaagagcaggaaaggaagaggcaaagggtactagctgtatcctaatttgtgtgcttttgttaccatcttcttacgtggtaacgtgggtgagatctgaaatctgagtaattgtaggatcaaaagaagcttcaagatcaacgcaaagctgagcaggaggcactttatggatcaaagccaagctcttcaaaatctcacagcactaagaaggtacccagaaactccacacctggagttcaacctcctaaatcagagatacttcattcaaagactattcgtgcaaccaagaaaacggaagatatcaacactccttcccctggtaacttcgacttaaatatatctgaagcaatatttctaaatttttacttagtatgtagtacgatctgactatctctgatctcaaaaataaactcaggtcataaaggtttagacactgttggtctccctatcaggaagttatttccatcttccaactcgagcactcttcttgagatggagacaccccggaagcccttctctcagattacacctggaaacatatcctcagctcctgtgcgtccaatctccactggtggtactgaagagaacaggactcccaagacatttgcaccagttcctacgactccgatgacagtgagccctcatatgcaaatggcagtgacgcctgttcttaccgcaaaagctgtttctgtactctcttatgacgaaccggagctgacttcacaagaggacaccgagtactcatttgaagagaagcgtcttgcagtctatcttgccgcacaagtggcttgactgtcaaggatgctgatacatccgttgtgtagctgaaagtctgaacctttgatagcatttctcatgttacagagacttgtgtaggtcgacagcagtcggccttattcataaccatactttacgttttcatcccattgttaaagtagttaccttgttactgctggcacttgtcacctgatgatgtgaaccattacctttcttcgctatgttgatggttatcattaggtggctgagacaatgaattgaactggcaggtgcagccgtgcaggtgatgtggtttgttatttggaaaagaggtttttaccgttgtggtaagaaagctaagatgcggccggtgaactagagtttcacaaagcaaccaggtaacttcccttggagttcagtcaataatcatttcaagtaaatgaaaggcaggccagttcctggtgatgcactgatgctgatatttgcatcgcgttcagatgacacacttcatgtctgaaagcaataggaaagctagacagataatttatggctataatacaagcagctgtcaatttgttcatatcgtaattcacctggattttcctgcaaaagaggtcagggatccgggacattggtttgcaagtcagaatactataaacctgaaattccgtataggccaaaagttgagctaaaatttgtcttcgagttaaaggcttaaatgagtactctttgctaacctctttcattttctgcgcatatatttcttaaattgttaaatactgtattttttaaaaaaattctaaaaaaacatatcaatctattttttttaaaaaaattaactaacattagaaaaatcatattaattatttttttagaaatatattaactaacattgaattaatcatgtgttaatcccctgcttcgttttatgtgccgggaagagttccctgcgcacctttggatggaaataaacgcaagcttagctgttaaaacttccctgaaatttcactctaaaaaatacttccctgaaattcctttgttcatcctcaaataaacaatacattgttcaatgttatagagattctcagaaagaagtatttgaacaatgctagtttctttagcagttctgctatgggaggctctcaattttggaaagggctgcatcattgcaagacttgggttgaaagacttgtggagaaacatgttcataagggaaatcatgtatttttctggaaagatgtgtggtgtggtgatattcctctcaaaattaggttccctgacctttttgagatcagctaccagtaaggggctcttgtgagtgaagtgttcaatgggagagactgggatctagaatttagaagaaatctgaactctcaaagagaaactgaacttgcccaattgaagcaactcattcaggggttttgtttggatgaaggagatgaccaaattgtctggcctcataataagaaaaaaagttttttctactaaatctatgtataggatcttgacttttgggggtataagggatgcagacttatgggagatttggaaatgcaagctccctctcaagatcaagcatttcctttttctggttgggaaagggaggttaccttgtgctgaacaactagttaagaggtactggaaggggggtgataaattctgtaaattgtgtggtaatgttgaaactaccagccatgttctcttctgttgccctttggcagtttttgcttggtgtgttatcaaagaggccctgaatattcagtttcatcctgccaatttctgggattgggttaggatttgggataaaaagaaagaacatagactctggattttcctgttagggtgtatctgttgggctctctggataattaggaatgattgggtgtttgaaaataatttggtttcctctcctctgcaaactgtttacaaagctttgtcttttgcacagaaatggggcattctgctaggaaaggaggaacaagcagtgctgggtgattggtgtgaggcgatcctgaagaagcttaatcatcttagaatcagagatttacctgcatccctgtagttccaattttagccagtgggtgcggttttgatgttgatggctgtctgatgtttttgctgtgccgaatgtctgtaagctagaatttccaaccagtttagtttcctttaagatgtaaaagactctgtttggtgttttgggctttctccaaaagctgggtcaatatatttgatctgatttcaaaaaaaaaaaaataaacaatacattttgttcgtgactaacatggagcatatactaataaacaagcagataccacacaataattccttatttccaagtgcagaaacatcatttaaaggcacatcgttgactaacctcaagtcaactatccctgaacagatcacacttctgttccaaatgacggtgcagcatctatatattttttttaccaaacagctttcacaaagctaacatgcgtagaaaagtcactggtcgtttgccatctggttgcagtgatctaacaccacacaaaaccacattagggttcgtcgctcgagaacgtgatttgtgattccacagtccacacggccacacagcgtgtgctagctcagcctgaattattcattattcctttcacgccatcgccgtcacttcactcctgcaggttctgggcagcttcgccggcgatgttcttgagccaaaggatcaatgtcagctaagggtgtgcttagttcacgttaaaattgaaagtttggttgaaattgaaacgatgtgatggaaaaattaaaagtttatgtgtatagaaaagttttgatgcgatagaaaagttgaaagtttgaagaaaaaatttggaactaaactcggcctaatactacgaaaagttcgtcctgtttcccaggtcaacctgcacttatccttttctcaaactgatgatcaaatcaaactaagtactgtttatttcgcaagaagacccgctctgtcagttcattggttcaggcttcttctggatctcccaggcgccataaactagttttacgcttaattagtgaagactttgcttggtagaactggtcatattggatcgactgatctcatttttatacccagtcgattaattatttatccaggttgatagtttggtaggtttcagcgaacttacacggggttttacctcatcttggtaggtagatgatgatcccgtgtcagtgatgcactaattaattggatatgcgctaattgagcaaggcaactttgggaggacaggtggccatggttgaaaagcaaaaaaaaaacatcttgtgttcactgtctctctctagctattagtagatcagtaaagtaacaaaggaaagggcatctagctttaaccggaaatggttaagaacactgaacacggagtagacacctcaaagcaccaaccaagctgttgttgatagagcagtacactgggcgccaccactgcacacacatatatccatcacctaacactctctccatcttagcgactaacagattgtaaactagtggcagcagcagtaggtaaatgggctaatggcagcagcgagcactggaagtctggacacacgtttaaattgtggagtaaaaggccagcgttgagatgtcgactgaccagccgaactcttgatgatagagcagtccacagaaaatgacctccaactccaataaaaacaagagatagaaggtagagtactcctactctcccagcccaacagaagactaatcaaagatgaaatgtcgacgaccggactcgtgccggccaaacaaaattggaacgttctgaactaaaaacattactaaaaacaaaagtggaactgatcagctagcttgtgtccctatggagcgcaacccaggacatcatgctaaaccaaaatgagtcggatcacatcgtctggaagctctcgaatcatggagaatactcggcctcttcggcatacaaggctcagtgtctaggaacagtcggcaccaacttcaatcccctaatttggaaatcttgggcccctgcaaaatgcaaattttatgcgtggcttgtgattcaaaatagagtctggacttccgatcgactagctgcaagaggatggccaaatagtggagtgtgcccctatgccgtatgacgaacgagacggcatgccaccttttagcttcctgtagatacaccagaaggatctggagactgacggccaactgggtggcttatcagcaattggatccgagcaattgggagccatgccaaagcgtacacgaatggtgggaaatgctagccaacaaaagggaagtgtccaagaaagggctgcgatccttaatcctactcatagactgggaaatttggaaagaaaggaaccaaaggatcttcgagcacaaggaaacggcggcccccaatcttatggcaaaaataaaggaagaggcaagaacctggatgatggcaggcgcaagacgacttggagaattcctaccaacttaatcatagcgcttatgtaattttgtacagctcttttttttgtccttaggggttgtatatttttacgcctatatctaatgaaatagcacggtctcgtgctgattcctttcaaaaaaaaacattactaagagtatatattgacacaatgtttaacaaatgataccggttagtgcttcggtactctctccgtttcaaaaattaactaacctaatgcatatattttttaatttagttcagattcatagtaataaaatatatcacattctatactaatttgttatttttaaaggactgggagtgaaaacggtcggaattcggaaatgataagaatcgttagcatctcttcaaaaatgatgctcaattgcatggtaattgatcatatttatcagctaaactactcactgccgacattaatacgatacagaaagaaattagaaaaataaaatttatatatagaaaaaaaagatacggtcaaaaacggtaccccttataaaaaaggagctcggtcgatcaggaatttccatgatcgttttcatccctcagtggttatcgcctagatttgcatacgcaccacaccactcggtgtacgtagtttatacatgtgcaatttacttgcacgaataggtgcagggggtgtaagtgggttagccacgaactcccttatagatcaaagtaaatgggtttacagcttattttagtctataagtggattttgtgggttagccccttacattacgtgcagccccccagcggccctcgcgagctgggtggagaaggataaagccacctctcggaatggtaatggaacggaaccactttctccgactccaacccaagccacggcaaacccaaaagccaccaccgcgttcgcggctcagccagctctcgccgccacggcaattcaccgcacccgcccgcgctatcatcccacgccacacacacgcgcttacggacgaacacacccgcgccacacgatccatcgccaacccaacaaaccactctcccggtggtctcctctcctctcgcttcccatcaccgtcaccttcccccacacgcgttcccaagcccgcgcgcctcctatataatccgcgg

SEQ ID NO: 60545 - DNA, 14243 bp, Oryza sativa
  unsure (1)..(14243): unsure at all n locations
gatttatcatctaatatcttttaagcatacataaatattttcataaaaattaaataaaacgaatggtcaaacattgataaaaagtcaacggtaccatatattaaaaatacggagggagtacttgctagtgtgcaacttggaaatgaacacgtcggccagctcgtgaattttaacctctgatctcatcattttcatgtgtactcctgatctttctttctcaactgtttgttgattttttttgctcgtgtgttgtcattattttctttgttttttttacatgtcgttttaaatatctgacactggctagcgtctgctaatacgtacgcatgtgtttttaataagacgtacgtactcttgcctggacataaagaaagactatcatgcgtgaatatgtaaccaaattgttgaaacatttctaaaaagaatatgtaaccatcagtacagctataaaaaaaatagacatcatgcgtgaatcgtgatcgaaacattagttcttggtaagaattcgtctactccggctgatataattaattggtaaatatatttttcccaactgtacgagatcatgaggtcaatctttccggtaaaagtggactcttttttactttaccatggcattagctagcaggtagtacaatatatatgtacgatcgcaacaataactataattgtatcaacattagtacggatgaaacctttggcgagctaaaaaccaatataattaagcagatgcgattcattgatcatgactcatcaggtcctaattagccaacgaattaaccaattacctgccacgagttgaccagaaaccatgcgtgcatgttgcacaaattaaatcaaaataaaaaaccatacggtccagcatatncttcgatagatcataatatggctccgttagaatctgattatatgatgaatatcaagtgcgcacgtaaaacgagataagtcattagcatataattaattaagttttaattattaaaaaaaataaaaatggatttacttggtttttatagcaaaatacactgtttattaatttgaaaagcgtgctaacaaaaactgaggaaaaatccagatgttgtggatgttgttggagtttagaacaggacctatgtcataatatgatcaaaactggttaaaatactggttaggtcatatcatatttatagttaaaaaagattttagtaccagacaacatagccatcgataattaatgaaacaccaatatttaagatatacatgtagctctagtcatttgaagattcttataaaaatacgataatatatttataaaaataagtgtacatgtgtgtgaacgaacgtgtcttcgtactgtattttgggagaaaaatatatagctagctagaagtatatttaccggctcgatatgagatggcctaattaattaagctgatggcgacacccaaaaatgagcactagctaactagagaggaggttggctatgtcggcacggtagggttaaaaggttatcttcttttgttttatttttcttttttattttttagatagatgcattttgtgttccggttgatccatgtatcacgcttcaaagtgatcaaacccgacagtgactgcctgtcctggtacggcagcttatttgacgagagcaccccatggatcggattttacaatcatcaaccaagtttggctagacaccctcacacattatattgatataaaaatgctagatactaactcgatccgttctaaaatatagatatttttagagttgaacatgtgtattacaaaaagatagaattaaatgaaggttagttgtgattggttgagaagtagaggtatgtgagagaattgaatgatgaaacactggtggagaaaccatctttggtcggtcggctaaattccacaatagtcccggttctaataaaaatcgggactaaaaagcatttttagtcccggtttaaaagttgaggggtaaaaatttctaaaaagcatttttagtcccggtttaaaagttgagggatactttttgatctttagtcccggttcaagatcatttttagtcctggttcaataagttgtcgggttcaagacattgtcgggttcaagacagaccccaattatttttattcccggttggtataaacaaccgggactaaaagtagatctttagtcccggttgtttataccaatcgggagcaaaaagtaccccgagccgcgcgccatcgatacttatccgcgcgcaattcctctcgatctcctcccctctcattaactccttctccatcccttcctctccccttcccctcccgttcctccccttcccttctctgtagcggcggccaggcgggagcggcggcggccgagctggcgcggcagaggccgagaggacgggggtcgggaggccggcggcaccctcccctcgatctgctgccggattttttttttcaacttatggttcattggatttgatttgtgatgtatgtgatattggatctgatctgtgatgtatttgagttgtgatgtatttcttttaggatttgtgatgtattttttgtttgagattctgtgatgggatgtatttgtgatctgtggtgtatttctttccaaactgtgatgcatttcttcccagatctgtgatgctattggggatatctagggagcggatcaattttagcaaaaaaaaaatcaaatcaaccgggactgctcccaccatctttagtcctggttactaaagatggatttttagtcccgattagtcatctttagtcccagattcgtagtcccggttgtataaccgggactatagggggatcccaaccgggagtaaagcccctttctccaccagtgaaagatcgtggttggttgagaagaaaatgttagtggagaggttatattttggaagaatcttgaacgctacatgttgttatattttagaacggatgtagcaggctagtagcttattttttattgcctaggaatgtactcccttcgtaccataaaaaaatcaatacgagatgtaacgtttcctactataataaatctggacatgggtatgtacggattcactgtactagcaggaaacatcacatcatattctaggttaattaaatttttatgggatggagagtattgtacacactctcctcttaaaaaataactgaattatgtcacccctatcaataattaaatgtaatttcttacagtttcacttattatagggtgttatgcgtgcatgtaagtaagtatctccgtttatttaatttagtcattgcatcattgttttttcactccagtaaatttgtgagggcgttttactaaagatttttacgtatttataagcgtaatagttgatgctaccgtgtcaatattgtatactcttagcaatagttgtatatatatgatgccgtcctaaaatttagaagtcggagtgacacatcactaaacaatatgctgacgtatatcagtatatcacaatcacatatagtcaatatgttattgccaattactacctccttccctaaatatttgacaccgttgacttttttaaacatgtttaaccgttcgttttattcaaaaacttttgtgatatgtgtaaaactatatgtatacataaaagtatatttaacaataaattaaatgatagaaaaagaattaacaattacttaaattttttgaataagataaacggtcaaacatttttaaaaaagtcaacggcgtcaaataatattttgggatggaggtagtatatatattaaggtcctttgtcgtagcctagctaagccatctaaattctaccgacgtaatcgtgctaggaagcgtcattaattactccctatgtattttaatttaatgtacgacgtcgtttaacaattcttctggttaaaaaaaattatataattatcatttattttattataatttaatttattataaaatattctttaagcattacataaatatttttatatttgtataaaaattttaaataagacgaatgatcaaacgctagtaaaaaagtcaacggcgtaatacattaaaatacggagcgagcatatgaattagtcttgtaatatatatagtgtgtgtaggagtgcacgcgtctacactgtattcttttttttaaaaaaaatgatagtagatgtggccatagtgaattgttggggtgaacaattggtgaggccggaatcaatctgtggatgaaaaggacagaaaagaaaaggaaagaaagtggctgggcacatgtaccatgcatatccatggatagatgatcaagacatcgatcaagtagaaatgaaggaaaggaaaagagctagctaggcgccaccaccacttgatgccgacgtatacgtgatatatatatatatatatatatatatatatatatatatatatatatatatatatatatatatatatatatatatatatatatatatatatatatatagtaaatttgtttggtgctccatggtgcccgggcaccattgttgaaattgagtatatacccaattcaaatgagcatgaaacttttttaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttaagttgttttgttgataggtataggtatgaatcaaattcttataactaggtatatactcacaatttgaaaattttgaaaaatttgagtgattttgtgcatttgaaaccatggtgccccatatgagtgtcctatatatatatatatatatatatatatatatatatatatatatatatacatacatacttcatacgtttcacgatgaaagtcactcaatcatttcctatatttatattgatgttaataaatttaaacactgtgaaacggagggagtatacgtgtcctttgctcatgtatgacaatggactaattattctaatcatcatctgctgatataaataaaaatatatgtaattaatataaatactagtatttaatttgggtctgattggttagaacaatttcatttttggtggctcacgttaattggctagcggcgtgttaagtaagacactcatcgatctatcgattcattaatatatgcacgagatggcttgaaaaattcacagcaattttagattttcagggtcgagagagagcgatcgattgatggagatgtatgcattgtaccggcctactatatttactgctctcttgcattgcaaaaagtatcagtttgtcggctagctctagccagctcatactgcccctgttctttttatttaatttcaatatattgagacaataaatacacatgtttttattattagtagtgttcttaatttctacctatatatttgtaagttgtagtatataacgattacaataattggatatagtttctttaaaagcaaaagcaggaatgaattctattattaaaaaagatatatttgtagtaattaaaaattatatgaaaaatattcatcatgaaaaatctgtgaatatcattttttgcatgttaacccttaaatttatatgctaataatttaatgtcatcatatttgaccgtatgtattttagggtaaaatgttaattagagcggaggtagtaacaacttgcaagggagcatgcatgcatgtatgaagcaatcagctctgaccaggagttgttgtagttgtcgttgtagttggacctttggtttgattttgcgacgaacttttgggctgtccgtttcacacgtactcatacacgctacattaatatttcttcagattcaggggtacatacagctaacctacctagctcatcaattaatacgtacttcatccgtattttaatgtatgatgccgttaacttttcgatcaacgtttgaccattcgttttattcagaaattttgtgcaaatataaaaatatttatgttcaacttaaagaacatttgatgacgaatcaagtcacaataaaataaatgatagttacataaattttttgaacaagacgaatggtcaaatattagacaaaaaattaacgacgtcatacattaaaatatggaggtagtacgatatttatatgaagcttatctctctctgtatgtatgccgcacggttagcttggagtacagtgatgtgcatgcatgcttgcttgcttttggaagaaaattaaaaagagggattattctcatgactgacctgacctatgcatgcgttcatgtatgtatcacaaaaaagattggaacaacacgtacgtcaatacatatatgtgccaatcctatccacctcatcatgctcgtgattcaaccactgcctggctgcatctgcgcaagcaaacacacgaaacatctcgtaaaatttgattatcacacacacacatatatatatatgtcattggtacgtatatggtatattgtttagaaacacaatataagcacttgtgctcgtaattaacacgcacacactagtaagtatcatctatcactgaaagaataatcacccataaatatgagcatctgcatcaagtttagtacttcaatccggatggatatatttcaccacaagaattcaagaaacatactcccacagttagagaaatcaaatctaatacgggatgtaacatatcatagtactaaaatatgtcacatctcgtattaggtttgtttttcataggacggagggagtaactagttgagctttaccctatatctagagaaagaaataaacagtgagagagaaaaaaaaagacacatgaatctctgtagatcatctagttggtcgccgctcgccatgtgattggcattcaggaaggcgcttgtgggttccattccggcccatctagtatagccagcttgttaatatcctccctgggccggcccaagtaacccacccactggcatggtctgctccggcccaactaacccacgactgcttggctatttccgtcattttcacgctgaaaacccccctcctcccctccaccacaatcgtcccgccaaactcgaacgcaaccgcctcccaatccccatctccgccgcacgatccgcctcgagattcgcggaatttcccttccctccctcttctctcgtacgccacccactgattgcgccacgtcatctatattactacacctctcactctcactctcagtccataactgaccaagaatctatcgctacccatcgatccaggaggaaggaggccagtgagaagcttccagaaggttcgatcgggagcgcggagtggtgatggcggcggcggcggagctgtctcgcggggcggtggcggcgatgtcgcggatggagcaggggctgcggccggtgctgcaggtcaccgacgtgcggcctgccgccggtcgatacctcgtggcgctcttcgacggaaccaagtcggggcagggggtgctcgtggcgtccatggcgcacctcgtcagggcatgcgccatccgcgccggcaccatcatccgcgtcctcgactatctctgcatcgacacaaggtgaccgtacaaatccttcttctgctctaattttcactcttatgtacttcctccgtttcacaatgtaagtccgaatgtggaaaatactagaaggatttacattgtgaaacggagggagtatttcatataccagatgcttgcctgctgtctggtcgatctttgcgatccaaattaatcggggagccgctctttgatcatttgatgcgatgtgtcgtgtactcgtgtgtgtgttgaaagggggagattttggtgaagtttttgttttttttctttctgtctgactgctaaggttaacttttgttctgaagttgttatgccgaaattagttttttgggagttctaaactaaacggcgctagggagggactgatgaataacagagccagctctttattactgaaccaggacagaaattatatctgaaaaaataactaaagtccagtctacttttgtatagaacttgcttcttttccaatttatttacatcatgtagcatcctaatacaaagttatgacataaaatggacgatctacttgttactatggataaattaaataatattactatgtattatataaatctaaacaaatatctcggaacaagtggtccaaatgatgcagtataagaaatcttttcacaagtcgtgtttttagaagcatcgagcaaataatccgatggacgctatttcattttgttatttgaacttaagcttccaaatactccaacatatgtcaactgttactgaaaattgtatcaacaactaacttttcgtatcatgtcttgctggtttcttaattcagggttattatcgttgagcaacttgaaatactgcaaattaactgcgcactgatcggaactagcaatactcatgggcgccttacttagcctaacacccattgctgcactgagcccatacaagtgtaaatggacaatcaaggccagggtgactgcaaaatctggtctccagcacttgagcaatgacagaggtgaagcaaagttcttcgactttgatctgcttgatgagcagggcggtgaaatgctcgcaaaatgcttcagttcggctgctgaaaagttctatggcctaattgaagttgataaggtctacttgatatccagaggattagtgaaacctgcacaggagcctttcaacagtgattatgaattagctctggatgcctcagcatcagtagaggtctgttccagtgatgttatataatggatcatctcgttcagttggcaataatgcagggctcgtctccagtccatgctgcttcaggtgcaaatcaaaggttgtccagggctatgtctgctcactaataataatgctcttagtgatacagtaggcagggtactgctaattaaagggcacttagcgagatgcatccagctactttgttaaatgttgaatgctagttatgtaagaactctgtcattaccattatatttctgttgatgtgttgaatatcccatcgttcgagttatgtctgataagtcatggaaaaatgaacgaagcaacgaaagataatgtgtgcaaaattttgtatctatgttattagcgactaaaaaccaacactgaaaaagagaccgataagaaataaaattctaaaatcaactctaaaactaaaatctgaaattcaaaaattagatgcatttgctaagataatctaacaaccagacgatgatggtgcaataggatagcagggaaatgtgcatgatcttctgtttggtccttcggttttgcctcaagtgtggactactaaataatgcaggaaatgctgctcttgttgctgtatcagacatttgattttgcggtatgtttagcaagtttctttgtcacgcaaacgaatataatctaaagaaaatttgaacaataccattggagaaatacgtgagttgtaaaataccattgtagtgagaatgacatgagagatctagatccacatgtcaatgacactacttattttgctgacatgttaattgaaacacgacgctgtcaacctaaaatgcttgcttcttgatacaaaatcacgttttggtaacgctgccatacaaaatcacgttgctgcgttcgttttggggagttcccaaatctccaccctcgtttttcgcacacacgcttttcaaaccgctaaaaggtccgttgtttataaaaagtttctatacgaaagttacttagaaaaatcattttgatccaattttttagctaaatatttaaataatcatgcactaatggatcgtttcgtttttcgtgcgcagcagatgtattgggacagtgatcacggaaaaactgcctagggtgacagagcggtgcaccctgttcccaaccaaaatagtgataatggaaaacggaacggtccattaacgcataattaattaagtattagctatttttttttaaaaaaatggatcaatatagattttctaagcaacttttataatttttttttaaaacacacctttaaaaaacgagaaagcggaaaatgagagagatggattggtaactagcgtgtgcgcctggtgtcatgttcatttcacttcctactagtaacgcttatttcttggacgagaaaggaaagctctgaattacccttgggcttatcaatcgtacaggcccatctcaattcccaaaaggccaattcagcccaattctattccacccaccaagggcactaccgtcatttcgcaacgaaaatttctctctccgtccgtttccctccactcctccagagagcgcgcgtcccaaaaacttcctccactccacccacccgcatagacctggtccatacaccgaacccacatccccaccctccaaaccgcctcgagattcgcgcaaccgccctagccttccccactatagtactctccgcctcctccctagggttcccaaaaaccctcccccgaattcgaaatcgaatcgcctcccacatctctctctctcgcggaagcttctggaaggttcggaggcggcggcggcggaggcggcggggacgacgatggagccgcagctgacgccgggggcggtgcaggcgatagcggagcacccggacgggacggggacgatccagccggtgctgcaggtggtggacgtgcggcccgtcaccaccaagaacgcgccgcccacgcccaagcccgccgagcgcttccggatgatgctctccgacggcgtcaacacgcagcagtccatgctcgccaccgccctcaaccccctcgtcaaggacgccacgctccgccccggcaccgtcgtccagctcaccgacttcatgtgcaacaccatccagggtaaaaggtcagcaaaccaccacaacacgcgccccccttcctctcttcccctctgatgagactcttgcagtctttttggtttggatgtttccgcgagaaagattggatcttgatgtgttagttcatctggttactgttttgagaaaaaagatttggtcttgcggcgatgcgcgggttgggagaggagggctctgtgtttaggtttctttggattgcgatgtttgcaatccagattggatagttcaagaaatgacgggttataattggtgcatgccttcaggtgtttgttctagatggcctgtgtcagtttccacttaactgtaatgccttctcagataaggagaatagttgcttcttttcccctttggggtgttcgttatgtaaagatgccaatgcaacgaaatatttgtctgttactacattgttgggattctgtgatttacatctagatctaattcgcacagtagtctttatgtcaacatgggggacagtgagaaggtcacattgctttttcaagcattaatttttttcttctactcagtataccttgttcgttctggtctgtctggcatgcgattacggagttctcaacttttcattaagttacagttgaacaggctgtccttattttgaatcatcatggtaaaattgggggctattgtgttgattcattgtattgaactctcaaatgaatgttttgtttaagtatgtacggtggcttgcatgtgatctcatcttatctgtaggttctaaggaaggtttgcttttccatctctacattgatttcagatgcgcttttatctttgtcatgtttcatccaacgagattttatcactttggggttctattgttagcagttgtccaatgtcgacaaatattcaacctgcaaatatgtttcaacttgcaactaatttgctggctaggttggttagtaaaagtgtactgtattttgagtaatttctcagagtattgtctttcatttaggtttccattaaaccattgaacaagtcacaacggcatgttgcaatgggctgaactgtagaactatcattcataactaagtgtgcaaaccttgctttttctgtaggggtgtgtttatcttttcactgtttcatcaccctcaattgagaaatcttacctatttatggtttatgtgctcatttctgtgtatcagtttggttgatgtgatttagaactggcctaatgccttctaaaaggaacatcctatttggaacttcagattattttttcttcatttttatgaatcactatgaccactatagttgacaattcttcaattctttttttcaggattattattgttgtgaaacttgatgttctgcaaaatgactgcattgtaattgggaaccctaaacactatgaaccaaagagtctaactaaggagcaagaccctaacttacaggccagtgtggctcaaaccaataatggaacctattctggtggcgcaagcatgctgggcccctccgttgcgccaagggcagagcaggctgctagcaacagttcatatggtggaccttataatagtgctcaaggaatgttgggttcttctattggcaggacagttgaacctggtcctgcaaatgtttctgctgttggctcttacggtgcaatatcagcacagaacacaacgaatgccaacatgatgcagcctacatctcagctgaacataatgaatgccaacacgatgcagcctacatctcagctgaacacaatgaatgccaacacgatgcagcctacatctcagctgtcctcgttgaaccctaatcaaaaccaaaggtttgcagctcctgcttcgggtggagtctttggccctcctggcaatgcttatgggcagccttcacgtccttcatatcagcagccacctccagtgtatatgaatagagggcctgcctctaggaatgactctgcaactcgtatcatcccaattaccgcgttgaatccataccagcctaagtggacaatcaaggcaagggtgacagcaaagtctgatatcaggcattggagcaatgccaggagttcaggaacagttttctcgtttgatcttcttgatgcacaaggtggagaaattcgtgcacaatgctggaaagaatcggctgataagttttttggccaaattgaggttggtagggtgtatttgatatctagaggatcactgaagcccgcccagaagaagtataacactttgaaccatgattatgaaataactctggatatcgggttatcaactgtcgaggtttgctctgatgatgataacagcatccccaggctgcagtacaatttccggcagatcagcgaactagagaatatggctaacgagaccattgttgatttacttggtgttgttacatcagttagcccttctgcaacaataatgaggaagatcggcactgaaacccggaaaaggtctattcaactgaaggacttgtctggccggagcattgaagtaacattatggggaaacttctgtgatgctgagggtcagcagttgcagttgcagtgtgattctggttcgaaccctataattgcttttaaaggtgcccgtgtgggtgattttaatggcaaatcagtgagcacaattggttcaacccagttaattataaatccagactttcctgaggtggaaaggctgaggcagtggtacatgacagaaggaaaaactgctccttgcatttctttatctcgagaaatgcttaatatgggccggactgatgcccgcaaaacaattgcacagatcaaggatgaaaatttgggacgattagagaagccagactggatcactgttaaggctgcaatctcccatgtgactactgagagtttttgttatccagcttgcccaaagctcttgcccgtcgggaggcagtgtaataaaaaggcaataaataatggtgatgggatgtggcattgtgaccgatgtgatgagagttttcaaaatcctgaatataggtacatgcttaggttccagatccaagaccacactggtagtacctatgctagtgcgttcgatgaggcaggtgagcagatttttggtcgcaaggcaggagaacttttctcgataagaaatgtcgaccaagatgatgcacaatttgcagagatcatagaaggggtccggtggcatctatatctattcaaactgaaggtcaaggaagaaacctacaatgatgagcaaagcttgaaatgcaccgctgtcaaggttgaaaaactggacccatcaaaagagagcaacgtcctacttggagcgattgacaaccttttactggacccaaaggggcaaagtgatcttgcccctaatgctggtttcaccgatccggtaggcggtcacggtgcgcctacatctagcaatgcctatgccatgaatactggtggcgtgaatcagtttgggcagcaagcgagtataagcgccggga

SEQ ID NO: 60546 - DNA, 16138 bp, Oryza sativa
  unsure (1)..(16138): unsure at all n locations
cagcgagcgctcacggaggccgacattggagaccatccaagaggagaactacatgtcgacaaactaaaattatcaagaaatagccagcagctcacctttttttaattttctcttttatgtgcgatattgtttctattatcttttctgagatctgaattggaaaagatatgtaatgaaacagagaaagatgttcagtcaatttttgtaaagaaatcaagaacacgtagatcaggattgtctttttttaaaaaaatgattgggtgcaagcacaagcgagttatccattttactgcttatttgcatgcatcccaaattggaacactgtataaaagcttttgagaaaaatgaatggactgtgaatataattgagcatcacaataaaagatttattttttatttttatcttttgctcttcaatcttgatttgattttttagtggtacgatagatagagtttgtaccatttctgtctattttaaatatttttaatgatgatttactaaaatctgatcccaacatttgaaaagagtgcaatattgcactttaaagtgtggcaatagttctcatgtgcaagaaaaagaaaaaaaacacacaataatgtttcttacagaagtactgttcgtctatctctgttatgtaaatttataaaccaaacatcagttttgattagagttcttttttaagaaaatatatattcatgattattgaaacgaaactaagttttatataaaaaaaactatattgtactaaattaattagagtcttagaccactttattttagttattattaagtttatttcaaaaataaataattcacggtagtagttcgctcaataatatataatcgaatagggccgagaagatggcatattgtactgtcgggaaagagaaaatgaaacctaccgatcgttgctcgttgcttacaagtttagtacgaactacgaaaaggacattcgaaaaacggtgtgaatacttcaaataacagcctagtaggaaactgtgttgttttttcagcttaggaagaaaagcatcgatgtgtcgatttcgcagactttctttccaacgtaaaaacaacttctttgtcctatatatattttttattttttattgtaattattgaactgctgccgcgttttcgtttaccctatacctagaccaggtgattataaaattcagacaattcgatcagcagtacggagtaacataaaagccatttgctgtctaatttgatatatgaatgagcatttctttgtagaaaaaaaatgtagtgcgcctgaaaacagggcaaggaggtgaagattgatcgatgaaagcaaaggaggggtgatcaaacaggtacctgaagcaacgcagacagatggttttctctcggcggacagaatgtctcgtgtacaaggcgaagaaaagcattcttgtccgcacgaaataggcaaaaaaaaccccggcattaatcagcacgaaatcggcaagcaaaccgcgcgatggtcaacccccaccctcgtgctgatccggggtcgtcgtagcagctacgctacgtgcataccttggctcttctacgttttaccgctgaggcgcaaaaacgtgtcgcgaaattttcacgctgcgccgaaccgtgtttcgactcggagtcggcggctagtcagccgcgctcgtgcacggccaggccacggggcgagttggatttcgtctaggtacgtgcgtggcccgtgtgccggtctgcgtggctatgcgcctatgcggtacgcatcgctgcacgggccgcgtgcagcaggtttcgagtcagaagcctgcacgcgcgtcgcggacgagcagtacgcacgccgacgacgcgcggggattatcccgtgcgtgcgtagcgtagggtgcgcacgatttcgcggcctccatccgcagcagatgaacgggccgggggcactcgcgctggcagatttgcggggagcgcgtcgcgcgcggttttgtgaattttttttatttatacttttttttattaaaatatttacaaaaataatttgttgttttgaaaatttacaaatctaatcgcctgccgccctttccacagggcggcaagggacctaaatgtaaattttccagcataacttgttagctctatgattttacaatttaaaattatattatataaagtcagatgaaataaaactttatatcaaaagtgtagagctcaaggagatctacaattttgtagttaataactttttcatttaagatgtccaaatattcgttacaaaatataaaacacattttaaaaaatctcagatctacatttcaaacgacattggatggagataaactttatataaaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgcccttggagagggcgatttttaaaaatcacccttctagagggcggcaggcaattagatttgtaaattttcgaaacaaaaaattatttttgtaaatatttttataaaaaaatgtataaataaaaaaaattcgcggttttgttaggctctcggcccgtgatttttgcgcgggccgtacgtgcggttgtcgtgtctgctttgcaacgaaactcgttaggaataaattcatcggtggttccttaactttgtcgacgaatctgatttccgtcctttaaccgaaaaattaaaccaaatacaacagatcccccaactatcaaaaccggagcagatgagattcctcggcggtttagatggcggttttggctgacgtaaatcctacgtggctaatttgaatcggtcttcatctaacatggcattgacatgacgcttacgtggcaattcgatatggaaaaataataaaacccatgggacccacatgtaagttttacacacaaaataataaaaaatagtggaagccatatgggccccacatatcatcctctttctcccctttatctctatcctctctctcaatctctctgatgggagaggagcagggtgcgtacgtgctcagtctattcttgccaccgacctgctttgtcggccgcccgtcccactcaaccggccggagatagagaggacagagataagaggagagtagtgaggatgatatgtggggctcacgtgggtcacactattttttattattttgtgtgtgaaactaacatgtgggtctcatgggttttattatttttccagattgaattgccacgtaagtaccacgtcaatgctacgtcagatgaagaccgagttaaattagccatgtaggcgccacgtcagtgaaaacctccgagggatctcatctgcaccggtcttaatagctgagggacctgttgtatctagtttttcggttgaagaatgaaaattggatttattgacaagttaaagaaactcgtatgaacttattctaacacgttacagccggtgcagcggccacctcggtgtgacggcccagggcgtttcgggctttcggccccgttagctatctggaagactggaactggaacatgttacgtcaactgcacagttgatagcggctgctcgaggctcgcggacccgtcagtttaattaatcatccgtctgatttgggaatggagaagatactctgacgggatgagatgacaaccgatcgatttttaagggattggatgctccgactaccgtccacgccatagaatctcgcccaccacataatgttacccaacttattgatagatgcttcttctgaaatggattattaatttggaagtttttattttctgtacgtagataatgggattgtcctaaataggagtatttctttaagctcaacaggataatccgattcttgtgctaggcattatgagagtttgtagctctgttaaattcagaaagagaactggttagatagtatagctattgtgttggacatctttatggggaaataaaagtctcttccaaactctgtttgcttggatattgtaaaaaaaaatccattccagcaaaaaattgtgtgtaaacaacgaatatgagcagaactgctcagattcacagcctgaaatttattccttttcaacgaagaaagtatgtagaatatatggtggtgcggaaagacacttggcataacaatcttctctactatgttatagccaatcgcgttaggatgctagtggacgataacattacataactaatggttgttttatactatctttgttttaaaatgtagctacctactatacgattggatacaacctatactacgaatctgaacagggcgcatatctggtttcataatattagaaggcatccaatcaattatactatataactacattttgaaatagaggtagttctatgctatacttcaaatgctagcacctcaagagattagaaagttgcttcgtcagtttgtctcccttgggccatttggtatgctccacagtctacgcgagtaggggtgtaagtggctaaccagcaaaacccacttataggctaaaataagccacaaacccgcttattttgatctataagggcacccacaatggttatctatatgctctctacaagagatccatgtcagcatatttttctacttagaagctattcaatgaagagagagagcaaagctatctactaacttatagatagtctatagagaaaaacgaggcaatgcataagagagatatagataccaatgtagacatactattaaagtgatttactattaatcgagtctattgctgagatgtacatgttttatatagagtgcaccttactttaccattaattgcgggtgctctaagtgggtttgcggctaagcacacttccacccctacacacgaggctttgcatgacgacactagcttgcaactgatcgcgtgagataagatcactgcaaagatgacaagacggctctgctttggctggcgggaaactacaagtcagaggacatccgaccaatgctttggaacttttgaagcagatcagatgcgcgcagatggcgaacgggctccatctgtccgtgacgagtcccgtgtcgctgtccccgtgcgttgtcgccgtgcctccgccctcgcggttccttggtccaaaacatacaggactcggcagtgcggccaatgttgcactctcctgtgccatcctctcccagagtcccagctcgatctgtaatctagactctagagtgtgcactcaccttgccgtttggccattatcggtacaacttgctgattataaaccataatattattattgatacataaaaaaatttataggtgaaacttttatgtatatattcttaaggattaagcatatgtttggtttttaatgaatgaggtgggtcgggttgtgtcaaatccatatttaggatgttgagttggagcagtcccagaaaaataatagtattcttcaaagatctgcgccagcttcacacttaaaaaaatggtggaacaatccactttctctttctcactgacacgtgagccacaccctcccatctaaccctcccatctataaaaaacaagtaggactactcaatccctagtatcaaacggataatgggatcatcctattctaaaagaaaatcaggatcagtacgtacaggacgcttagataaacgaaaatcagggtttatctttttttttatggagggagtacgcttcaatgcggcaacaggatcagtacgtacaggacgctgatcgatctgatctgtgcatgcatcaatgcatgcttctgacttctgagggctcgcctaggcctcagcctcaccaagtttgatccgatccttgcattggaacgataagctcatgcatggtgtccggccgccctcgatctccctgtcgacagcaaacatgtggaggctaaactactacggagtactcctgttcttcttgtaataaacaaacaccgttactttttaatgatgtttgaccatttattctactgaaaagataactattagtttttttcgttacgatatgtcactactagaaaaagcatttttctcaacgtaggggtattattttcgtagtcggacatgacctttgaagccaaacgaccgcctacaaaaatataaatcggggtgaagttagctgtccgcctgcgaaaatagaccacttaagtggcgcctgcgaaaatcattttcgcaggcggaccacttaagcaacgcctgcgaaaatcaattttcgcaggcgcatgttaggtggtccgcttgcaaaaatcgtacctacctgcttatcctctactgccccatacttatcctatcctcacctatcctgtccaccactcatttgcctccccacctctctctctctctctctctcacttagaaaaaatctcctctccacccccacctccgccgccgggctttcttcccacctccgccgcggttggctccatcctcggctccccacctccgccgccggcgacgacgacgaccgcgacgcccctccgcgcgccagcgacaacgacgaccgcgacgccggctcccctcctctccccacgtccgcgcgccgccggccggctccctcctctccaacgtgcatgcgctgtcggctccccacctccgccgccgggcggctccctcctcggngacgacgacgaccgcgacgccggctctacgcgctgatggctcccctcgggcacgacgacgaccttcgcgccgccggctcccctcctctccccacgtgcggcgngggtgactccctcctcgggtccccacctccgctgccggcgacgacgacgaccgcgacgccgcctccgtgcgccggcgacgatgacaaccgcgacgccggctcccctcctcttcccacgttcgcgcgccgccgggtggctccctcctctccaatgttcacgcgccgtcggctccctacctccgccaccggccgggtccctcctcggcgactacgacgaccgcgcgccgccagctcccctccctctccccatgtccgcgcgccggcagctccctcctctcccacgtccacgacgagcgacgacgacgacgacggcgccgacgcagcagctcggctcctccctggccggcggcttccgtggtgaggccggcggcagcgcccgtgtttttttttattttttttgagatgattttcgcaggcgggccacaggtccgcttgcaaaaatggtctattttcacagtcgatgtgatagcggcggtcctcctccccgcctgcgaaaatggttttgggccgcctgcgaaaatcctttttctagtagtgtgtttcacaattaaagaaacttttaccatatgtactttaatttttaataaaatgaatggtcagaagagttaacggtaccatttattaaaagatggatatagtactatcttaaatgggggatgtctttcagctgatacaaattgaagtttggatacgtggaacttgcacaataactatgcgaatgattctgttgtaaaaaatattccagtacgttttaggctagatcaagtactacgttaggttaaactggtttttctctaaccaacacaagtttcataaaattaaagtttgtattaaaaaaactgtacaaatgattctctttttgaaaaatatttttgtaagctttttttttcttctctctctatctctaaactatcatatagccacttggccagcaaagctagctgtaagttatactatccacatgttattcagagatgatataccagatatacattttcttcccttttacccattttctttttttctttgacttgtttatttatcctttctatatataattgagcgtgtataaagttttcttttatatgaaaaagcaatagagttataatggtgaagtcattgacacaaaacactatatgctattatttgaatcctgttgcctacaattatatacacacaagtgccctttcattaaaaatataggtcatgtttagtggagcttaaaattctgagaattagctagttgatagccagcttatgagaatctaaaaaagctgggtttccagcttctggcttctattttgttttctggattctacaaatacaacttctcataattttgaccaaaagctatactgtttggggcagcttctgattctgggagaagttgcagcagctagaagctccccaaacaggcccatagtagggttcaccaatttaccctagattcttcgtatatggagctttgtgttaaagagtcatgttatatgtgtacatatgtgatgatgatccgtgtgtgtatatatatcttccatataatcggaaaaaataagttttatgttacctactcccccgttccaaaatataatcattttttatttcaacacagtcttcaagatgctacttaatttgaccaacaacatctataaaaataatatgttttcaataaaatgttttacatattattatagtttgtttaatgataaatctagtaacatcaattttacatgatttgattttttaaaaatattttactattaatagtcaaagttaaaaagatttgtcttaccactattctaaaaatgattatatcttgggaaggagggagtaagagctaacacctctttttttccttgggctgcatgcataaaagaataataaacttaaggtatagttaggaactgaggacttcgtgattatatatgtgcgtggaaaactctcctcgatctgcatgtataaaaataagataaaacagaaatctaccatatacgtaacacacatttacgtgctcgcgaagagcaccgattgtttttggtgcgagtgtgcgttgaaagagaaatgattcacgatgatttaaatatttgttttcgcgctattgattggacatccgcaaggtacttattgttgtccacgtggtcgataatcacgctcagcacagtggcagagctggacagaaaatcaaagggggacagctggcttttggcagtttaaaaaattagcaatttctctttttttttcatgcattggtaatacataaaagcgaatagtttgcaaaagtcgacgacaaagatcagctacagacgtcagattttaaaatttaggattagtgggtacatcaagttcatagtgacgtacggagtaattgacatctcaaattggctctctcttgttctaaaaaatcatcaggatagaactttgaagctagagagcacactttatcaatgttgaatgaactgaataaatcacttggatccaaagatgtacacaaagtgagaagctctgttgtttgttcactgaatctgctatgatatatgggggtaataaaaaaatttgtttttattgggaggggccatggcccctgccagccccccctcagttccaccactgactcagcatgaactgcatactccctccgtaatcataaagaaagttgtttagaataatatttaagtcaaacattgatataaatcataaataactcttgtcagggttatggataccacatacctaatagtagttgactaaatctcggcaggacccaccacataccatgtcttatatggaagcaacctgcagatataggaggagttccggataaggaaagacaaccagtgttctacatggaaacgacaaggactactcggattgtattcatattggtttccctagttctacttggacaaggggacacctatgggtataaatacaaggccccctaggaggagaggggacaataaacactcaccatagacgacacggaacaatagatcaagacagaagatcaacatacaagccaacatacgccaagacaagacgctggatatcgacatcagagatatgcctggatcggccctatccagtacctacagaggccggccgtagggatttagcgctgtctctgatatcgtcgggcacgaactcgaggaggaagactacccgttgttgactacgagttagaccttcagaccgccatatcgacaacagttagataggctatcccaaatattgtactggtgtaattatggtgaataagagcaataccggtttcggccaacaggatgtagggttattacctgacaattcaggggcccgaacctgtataaaaatctctgtctccatctcttttacctcagtctcgtatataccctagtaccaacgatccccatactatgcaaataccggaatcgcgacatcaaacgtcgacatctcttaagtattgagtttaaaaatgtaaaaaatatatgaatagacttgtcttgaaaaatactttcataaaagtatacatatatcacttttcaataaatatttttatgaaaataagaagttaaagttgtattttggagaccatgtcgctgtcctaattaaacgacttataaaacatggtagttgatacgtactcatcaactatagagaaatgcgacatgcatttgtgtagactaattatttggataataagattgtcgaaagtaaatcaggaaattaatgtcactgatgtaacactgatgtaacttgagttggcctagatacagattaattattaatgtatcggatgttttttttaatatgtaggagatggttttatgttttttttataaatttaatcaaactaaaaaacgttttatttaagacaaactttgtttaatttatgttgaaaattgtgttgcggttttttctataaatttattcaaacttgaaaacgttcaacgtggagataaaccttaaatattttacattttattttaaaatggagagagagtagcctacaaacaatatgatagattaaatgcgcatgattctcgcaaaggaaaactgttgtttattgaaaaacaatgctccgatccagtacactcacgtggaaaattcggcaagaacagtggcactgaggcagtgttacaactaacgtgttgcatgcatgcaagacaaccaccggcctattaaccgtccggagcagggaccggccggccgggcggaagcatatgaatttgaagaatatgtacaaattcaaacttaaaaattactatatttgtttcgacaggtttttaatagtatttggccgtatttgagataacttaagattctgaaaaataactgatgagaatcttaaaaaaatggtttcccagcttctagtttttgattcattttttaaactctacaattacatattcttaaaatctaggagaaaaatattgtttggaggagtttctaaccggagaagctgcagtgtcagaaactctcctaaacaagccctttaattaattaactatcttggcaactcctaaaattttaaattatggcttaattttttatatgataaattggcaagcgattaaacaaatccaataattcgacgacgccggtatttcaaacactgttgcaagtgtgggcacagtgcgccgctattcacacagagatgcctctttccctatatatatatatcgaccgaacgcaaagaagcagctgaactagcaagtaaacctgcggtgtttccaacacaacaaacgctacaacccttgtaggtttcagaggaaaacacacgacacgagccggaggcaacaaggcgctcaggtccatggagcctcacgtcctcctcgtgtccttccctatgcagggccacgtcaacccgctcctccgcctcggccgccgcctcgccgccacgggcctcctcgtcaccttcaccaccgtccgcctcgccgccggcggcggccgcctccgcgacgtgccggaggacggcgcgtgcgccgacgtcgggctcggccgcctgcgcttcgagtacctgcgcgacgacgacgacgacggcgacgagcggtgccagcagctggcgcccaacgacgtgctgtcgcacgtcacggccgtggggccatcggcgctcgccgagttcatcgacggccaggccgacgccggccggccggtgacgttcgtcgtgaacaacatcttcgtgccgtgggcgctcgacgtcgccgccgggatgggcatcccgtgcgccatgctgtggatccagccgtgctccgtgctgtcgatatactaccacttttacgagtcgcccgaggcgttccctaccgccgccgaccccgacgtgccggtcgagctccccggcttgccggtgatggccatggtcgagctgcctttcatggttcgtcccgagtacgcgcagtgcctgtggggcgacacgctccgggcgcaggtcggggcgatcaagaggacggtgtcctgggtgctcgtcaactcgttctacgagctcgagcgctcggccgtcgacgcgctccgcgcgcacacgacggtcaagctcgcgcccatcggccctctcctggagcatggccatgacaacggcggcggcgacgacggcgcgccggcgccggcgctaggggccgaggacaacgaccgctgcgtggcgtggctcgacgcgcagccgccgcgctccgtggtgtacgtggcgttcggcagcctcgtgaacatcggccgcgacgagacggcggcggtggcggaggggctcgtcgccaccggcaggccgttcctgtgggtggtgcgcgacgacagccgcgacctcgtgccggaggccgtcctcgcggcgtgccgcggcgacaaggccggcaagatcacggcgtggtgcccgcaggggcgcgtgctcgcccacggcgccgtcggctgcttcgtgacgcactgcgggtggaactccatcatggaggcgctcgccgcgggcgtgccggtggtcgggtacccgtggtggtccgaccagttcgcgaacgccaagttcttggtggaggactacaaggtcggcgtccggctaccggcgccggtgaccggcggcgagctccgagcgtgcgtcgaccgcgtgatgagcgggccggaggcggcggtgatccggaagagggcgatgcattggaagcgagaagcggcggcggcggttgccgacggcggttcgtcggatcggagcctccaggattttgtcgaccatgtacgacgttccaaaggaccggaggagctagctcgattagctcaagacatccagattatgaatgggccggtcaatccggtcctagtttaataaatctagcacagcccatgtacggtcatgtgggggctatgacgctatgtagtgtgttaatctatctactccattaagttgctgtcgagtctaatccttgttatcataggattccaaggcttacataaaaaaacggtgtaaaaaatgtaagtttgaagtttgaacactccaagtcaaacacgattacatcgtattatacgaattcaatttcgtaaatcacaacagatcatataaaaattgggaggtcgctgtaccacaagatcgcgtccggtgagatgacaccaagcagattttgagacctatcgatatcagaacttgtaccttattggtaccgctagatatccgacaggtactaactgatgcccattggtacccgctaatacctatcgatactaagaagatactcaatacgagacttgggtacccccatcagtatcaattgttacctcaatactagcgcgaggcttcttgatggcacgacgaaggagcgtgtatcccttcactggcaagcctccttctctcccccccttcttcggcaactcataatgtcagagaggacaaagcttgagacaaaacaaaccatggcagaaagaataaggagacgatgtgtagcctacctctgatcttcttgctgatgtcaatgtagatacacacacagtgtgcaggacgatgacgcaccggtaggatgcggagagctccttgagaagcgccgcgagtgggatatggcttgcatcatagtccattcgaagctattggtgctaggtgctagctggaccatattcggggacacaaccaacttcaccacgcggagcaagtcacggaactagatatagttggccaaaaagcctgaaacccgatggcccggcccacggcatggagatttggcccaacccaagcgcggcacggcccgcctattgggtcgtgcctgggcctcttccttggcacgacgtgctggccttgcatggcccggtccaataagagggaggcaaaatagacttattccaaccatataagcgtaactcaaagagatgagggatgcaaaatagacttgcttgaaccatataagacacggtccaaagagatagggtgggggggggggcaaatagacttattacaaggtggagcatagtgagcttgtcgtgccttcagaccgacccggcacgtttcgagtcttattgagccgtgccttagccgttggtgtagcccgtggcccgtgggcgggcacaacacgactaggcgtgtcggttggacagtgcctgctagactgatctcaggccgtgcctggtcatgcctgggccgagcggtacatttgaccatctatagaattagatctccgcatcgcggagctgctcacaagggttgtggtgccgctggaagagagctctaccttgagctcgagcctaggagagaggaggagggatgtatgagagaagagggcgagcagctaggtataggtagctcgtgcagtggtgcaagagttcaagctcaagttttcgctgttagatccggcaacaatataggatggtttggactcaacatcaataggaggttaaacgacgtgcacggtacaaccatccgcccatgcacctcttcctcctccgatgccactctagatccctagctcccgcccatccggttgccgacgtccacctccaaaggcagtggggcagcaacggcggctgcaagccccggctctagctccgactcggtgtcctgctctaccttcgccaacatgtgcgcgtctatgctgcgcgtgcgaacgatcgacacaatgggtaaggggagtgggtgatcccgtgccgatgccgtggacgggataccgtcccctaatattcaggataatttttttgaaataatatggacttaacagttataaaacatatatgataaactagcccatgcgaatatgcacagcgcctttatatagtacttgaatatataatgtgatgtataacaggagttacgtataatttgacacggttacatgctgaacatggagtacaaattgatgatcagggtccatctggatcgtgcagacgcggacgccgatactaattatttctcgagaacttgaacgctgcgagagagcaaattgtcctacttcttgcacaccaccccgacgccgtcgaggccggtggagcacttgacgtcgaccagctcctcggaggcaacggcaacggcgccggcatcgccggcgcgcccgaaccgagcgacggcgcagtcagcggcgaaaagacccgacgaggtgaactgcttctcgcctcccatgacgggcatcttcgcggacacgtcgagccggttcacgtagctgctcctgtacgtctggcccagcacgccatggacgtcgtcggtgagggcgtagaacttgaacgccaggtcgaggtgggcgaggcagtcatcgtcggtgaccccgtacctgtggatcctcgagtcctccttggtgatgggcaccacgttcgcggtgatcttgaacacgccgtcgagctcgacgaggacgccgttggccgccttggtccgcgtcacggacaggccggaacccgactcccacctggcgtgcgcgacgcgctgcagctgcacggtctcgccgtcgaagacgacggcgaggcggtcggagtcgtcgtcccacacggccgtcctgcgcgcgccgacgtagaggcggtggccgccggagaactgcacggcgatcgcctgcacccaggtcgggtccctcttgaggcccgggacgtggttgccgatgaagtggccgttgatgtgcaggtttgcgtcggagagcaggcagaagtcgcggtctcggcggccgtggaagtagaacgtgttgccgtcgccgccgatgaaccgcgggtcctggcacaccgcgcccggcaggttgcagtctgcaacgcacgtacgcgacacgtacgacacgacacaaaaccattaatcaaccgtgcatgaacactagctagctggttaacgtgcacagatatgcacttaccgcatacggtcttgcaggtggcgcagtccatgtggcaggatttggggcacctgctggggcagtacgccggcgaggtgcacgtggggtacctcgtcgtgttcgtgcagtagaccacgtcgctggccggtggaggaggcgatgacaccggtgggg

SEQ ID NO: 60547 - DNA, 711 bp, Oryza sativa
tcgaattcctgcaccccgtatgcttattaattactaaaactaagctagaatatatgtatgtagctttttgtcatttacattgatctcaaatatataggaaaataatatatatatatatatatatatatatatatatatatatatatatatatatatatatatatatatatatatatatataggggggatattatataaaaaagtggcgcatatatgagggcgactgagaccccctcagctcagctagagaggagtagtatatgagttgagctgagcaaatcaaaatggcccccatgaaacactctagatcactctgtgggatatcttcacactctagcacgctctatctctgtgaaaggagcacaaggtgaaggtgaaaaaaacacaagagccgcgcgtttgagtgggccctctcagccctctttgactacaccctctaatttgtggtcgcaattaacatggcaatcctattgccacgccgcactacgcgtgctatacaccgcagagacatacacatatacgcgatgtgcaaaatgtgcgcgtgattaaaattaatagggcgtatgcgaaatagactacacatttgtgaatagaccccatgcgatatatgtggggtcgcgtgtgtgaaatacttgcgtatatctcactcagagacgaaatcgcgcgctagctcgctcagctatagctcctaatatatgtctgagcctcagg

SEQ ID NO: 60548 - DNA, 20997 bp, Oryza sativa
cctcgccggcgcatcaatggcggccggatcttccgctcccgttcccccctcatcggccgccctctctcactcccaaccctatataaacactccccgtgcctccctccaccgtttccgccactcgccgctctctctctccgccggaatcgagctcgcgccgtcgctctctctctccgccgtcaccgccgagctccagtccgccgccgtcgtcgccccggaccttctcccgcttcggcgccgcctcctttggtttcgccgcaaccttgccgacctcgtccacccctccgtttcgcccgccgaccgccggaacgccgccgtccccgtctacccgagccgcgccgccgccttcctccgctccggtcgccgttcccgtcgtcgccgtcgacccggggtgagctgtggaccgccgattcgtttcccccttccctcccctctctcgggcgccgctccgccgcgccggtggtcgccggcggcgaccatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggtgtgagccgggtgcacccggtccaccgtggaccgtgaggctgccgcgtgggccctactcccgtggacccggtccgcgcgcccctcccctcggctgacgcaataaatccaaattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcatgtagacgctgcagcttcggaagatctgctcttcgtggaggttgaactcggaatatgttcacatcatctttgaacatattgaatcccggtttataaaattatgttgatttaaattattgcattatcgctttatttaaattcccgcgttatcactgttttatttagccatgcctatttacctttgttatgaccttattattgttattgttattatttccttgttcaccctagattaaacaaaaccccaactagtggacactctactcatggtacctctagtatgatgttaggtagatgcttcgctatttaattaggtaacattaggcggttttacaactctagactttgggatattcatatcacctggacactttggaattgttggagtattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcgtggcacagggccggtgtcctgctgctaggggctcagtcctgcctgcctgtcccgggggttccggccgtaggtgggattgggtcggtactcttgtctatggctaggatgggttggaaactatgtcacgtctttcgtctgtataccgtggtggtatgtggcacgtggttgtacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggatggcttgggacgagctgggacccagggtcgggttgccggttcggtctgaatcatcgtaggccttgggttaaggcagattcgtgtgggttcacggccttgataaataatattgcatagttctagaatcgtgtttacaaaatagctttgagcaactaagcatctttaaatgctgtttactgcaaccctaaccctttatattataactcccttgtactcccttgcatttattatgcacttgtgggtgtgtcttgttgagtacggtggttgtactcagtcttgctcaattttttcccaacccagaagaggagcccctagatgatgaaggctttggtgtctagctcgtgcctgccgtcaagcgcctgtggtcgtcgccctagtcttccgttgtttctcgtttgtctttgtgtgtgctgggccttcgtcgcccatgtaataaattatctatttacgcttccgcttgttaaactctgaattgtatcaactcttggtgtaccttgcctcctgggacaaggaataatacacgcacgaaaggaacgcccgttgggttaattccggtcgtgacatgtgaagaccatatttgtgtcatttttttatgtcaattgaatatgacaattaagaaaaaagtgtaatgctttgaacagatgcttgaagtgtaagttgtgtttgtacagattgaaattggtttttgctgcttgaaatgtcatggtctgtacagttttagactgatatgcagtatgtcacttggaacaaatatatatgtacatcactttgcatactgtttcaccaggaaacttactggattacccaaaaaacagaagtaaaatattttctcttctcctgaaatttttgacccaactgcttcacatattgttaggaatatgagttagcaccatgaacctgggaaagaaatcaaataaatgcaaatcattgctggtaacaactctgttcttaaaattgctagctcagaatctcgatgtgtttcagatatacaatggcaaatgagttcacagaataaatcagttgtgacatctcagttacataacacaaaataaatgagtttatagctcatcccaattacatatgacatatcagatagatgacacaactcaagatataatttaatcatcatcggtgtcttccggcatgtcatcttcagcgttcccattgccaatgtcactacagtactgcaatattgtgtcatcttcatctgcatcatccctactgtcttcagtcaagttagcttggttgttaaggtcttctaaattagcttcaataatagtaacttctccatcttcctgcaaatggtctagatcctcatcagcattaccttcatgcacttcatgttctgtatcagaacaattatcatcttggtgtacatcaaaaatgtggtcatctttttcagacacattatacatgttcctatgttcgaatttctgcacaattcgccattcgttgcccaaagaggtgtcctgcaagtaaaatatcttcttcgattgagttgctaaaatgaaagggtcatccttgtaccaaaatgattggatgttgatggatttgaaatgcccgtcatccctaactcctcttgtcttgccaacttgattgaaccaatcacaacggaaaagaaccaccgatcgatagatatctagatcagagttatactgcaactcaagaatctccctaaggacaccataaaattcaatgttatccccttcatgtgtaccatcaaccattacaccactattctgcgtttggaggtatttctcacggtcaacagtgctatacctgactccgttgacaatgcaagatgcacaactctttactcggagatcaggaccacatgacaatgcaaatagtgcttcactgaccacccctggattttctttcctcagcttcctgatctgatatatatatatatatatatatatatatatatatatatatatatatatatatatatatatatatacaagaaaaatacacatgttattcccaatttgaaatttcatcaccaaaaaatgatatttttgtaagtgtgtgtcacttacatgagtcttaaaccacctagcaaatcctttttcaagtcttctgtcaacatcatgtgcatcttctttctccaactcttctctatgcatgctgtagcatattatgactcaacaattaggaaaatattatatttaatacaatacatgtgaaataaacctacataaatggtgcttactccaaatatggttgaacctcctcacagttatttagcacataccaaactagcttatccatgatttcatcctccatgtactgtatcctagtggatcctatgagtttaacatcatgcataaaaacagagctgttaccatccaatggcccatccccatgacgggcgtcccgattaaatctagtgtcaacatcctccatgtaccttgaacaaaatgtcaaggtgtcacttgctacataggcctcagcaattgatccttcaggcctagccctgttccgcatggaattcttaaaggtgccaagtcatctttctattgggtacatccatccatattgtacaggacctctaagtagtgcctcatcaggtagatgtacggccaagtgcaccatcacgtcaaagaaggctagaggaaaaattttctcaagtttgcataggatcagcgggatgtcttttttcagtcgtttgaggacatctatccttagatttctactacacaattccctgaagaagttaccaagctctgcaattgcttcgtatatatccttgtccacaaatcctcttatgccggcaggtataattctttggagaaggacatggcagtcatgagttttgagcccctgcaccttggaaccatctgaacttatgcatcttgctaggttggctgcatatccatgtggatacttgacacctttgaggaagttacaaaactcaattctttgttccttcttcaagacatagcgagcttgtgggatgcgaactgagttgccatcctgctgtaagtgcaagttatgtcttatgttcatatcatgcaaatctatcctcgaattgactgtgtcctttgtcttgccctcgattttgagcaatgtgcccaaaatgttgtcacatatgtttttctcaatgtgcatcacatcaagattttgtggcagcaacaaatctttccaatatgggagcttgcacagacttactttgcggctataaattagtggcccttcatcctctccacgttttcttttcttacttgtatcatgcttacccggtctaacatctttcaccttctctaactgctcgaggacctcatctgtgctgaattttcctggctcaacctggttttcatggtgtccatcaaaagcatggcttcttcgccaagcgtgtgtccttggaaggaaacaacggtggccaaagtagcctatcttatttcttagtgctcgtgacaacgaatttttgtcacaatgaatgcatgcataataaccttttgtagttcgccctgacaaggtgcttagagctggataatcatgtatgcaccatagcatggcggcacgaagattgaactttctagcactgaatgcatcataagtactaacacctatccataattcaagcaattcttctatcagaggctccaagaataaatcaaaatcctttcctggagatgttggacctgggatcagtaatgacataatgcagttcgatggatcgacagattcccatggtggtagattcaaaggcataacaagggcaggccacatgctatacgaattgctcaccttgccaaatggattgaatccatctgtagctatggcaagcctcatattccttgcatcttctgcgaaagttcgatactttctgtcgaagtccttccaagcctccccatctgctgcatggctcatttcattatccactggcttccgcttgattttgtgccactgtgtgtcttcagctgttcgttttgatgcaaatatcctctttaaccttgggataagtggaaaatgcctcaaaactttgcgaggaaccttcctgtcgccaaccccatcttcccatctggattcaccacatattgggcatagatccatattggcatattccttccgaaatagcacacaattattcttgcacacatggatcgacacatatccaaggcccaattcacgaagatatttctttgcctcatcataagattttggtaattgacattgagggaatgccgaggacaacaacttcaataattcagtgaaagctgtattgctgattcgataatatgacttgatatggagcagcctcacaagaaaggaaaatcttgaatggttagatcctgggcaaagtacctgcttcgcatcttcaagaattctagcaaaccttggtggctgtccatcttcccctgccgcagtgtatagttcacctattaactctggaactccattgtcatcctcgggttcatacccgcccacatctgtcccttcattatggttagtttcatgtacctgttccaaatattcgacatcttctgtatcaactaattctccatgataaatccaccgggtgtatgttgatgacatcccaaaaatatgtatatggtcatgcatttcttgctgaggcagtgaagtgtggttaagacacctacagcatgggcatggtatgtcaacgtgttcatcaaatctttgtccaacaaattccatgaactgtttcactccctccatgtatgcaggtgtgaattgtctcccatgtatccaagttatgtccatctgctttggcatgttaaaaaaagcaattaggcaaacaaagctaatccattttttaggacagaatattttctaaaacattagatggaacagctggttgctacatgacttaaaccatgttgatttgttcataatactctgacttgtttctctgttcatacaacacaaagcataatctttcatagctgaacttgcatttcatacttagagtaatgtacttatggaaaatcataccttatatctactgaacggcgttggtgatgggctgtgcgcgctgacgataggattgagagaggaggtgctaggataagacggtgggcgaggagcagccgatccgtctcagtcgtcgaggatcccccgcgccgactgggatccctccgcagccccaccgaccaagatcacttcaccgcgccgccacccaccacgatgctccacatcacgatgccggccagcctgtggagccgcccttccctgcaccggtgggataagaaacctcctcctctgcaccgtcccggtggctaggatccgcccccactgagctccgcctgcgccgccgccaccctccctccctggctgtgaccaaaccctgcgccaccgcccccctccctccctgaccaaaccactaggtcgcccgcataaagcattcaatcattcttgtgttcgagaattgaaaggaaaactaaaagtaaaacatcatcagcatgaaagctccttgcagcgtagtggttaagctagaattatggttagtcacaagtcgtgggttcgacccccaagtgctgcagcattttttttagaaaaaagagttcacatgggctgcacagattcacacatgggctgcacaaattcacggactgcacaaatttgggctgcgaaaaaaaagttcacatgggctgcacagattgacacatgggctgcacaaattcacgtggactgcacaaagcatctgctggcccgaaaacgcacctgtgctgcatatacaatgtggggtccaataacaatctggattgccacgtatacaatgtggggtccaatgacaacctagatagccacatatgcaaggtgggaccaacagcagaatagagatttacttacaactgacgaaatatatttcagcatattgtattaataaaggagcgtcataagtgtgttacatgaatggtgcgcaccattttgtgacgaaattatctattgttttatgagaccattttaaatttcgtcatggagtttcgatgtctaccctccgccatgagtgatccatgacgaaacatgaaatttcgtcatagatatgctgtattcaatgacgaaattatacaacgtcatgagcaaaacgtcatagatggatgatttcctactagtgtctccgccggggatctagctaacgaggtggtttgcaagcgagtgagagacaagggattatataggttcgggccgccaggaagggtaacaccctactcctgtgtgtggaattaagcttgtgtgttacaagggagctccaaccctagactgaagcttctcaaatgtcgtcccttttctcggtgggcaaggtcctccttttatagttcaaggggataccacatgcaccgtctttacataattcatcattggagggggggcccacaaaacctgggtcaagccaccgtccatgccttcaaccagaagcaaggcagtcgttcaaccccctaatgggtcccagcgccgtcctccgcccatgggagacatccctgtcattccctcttaatttcatggagacttttgtggattcatatgcacagggggcacgcttggctccacgccgatgggacggggcatacctgcccccacttcgcttgacatagggcgggacgtgggtgcgctgccacccgtcccatccacctgtgaccggccataggccggtcaaggccgattgacacacgccaattggtcggcgccacatgcctgcccacgccgcattaaacgcggcgagggacggttggggcgccgctcattaaagcgcttggcagcgtcccatcctccgcccactcgaccgccacgtggcagccgagtgagggcctcggcgcggcgcgctccaagggcccgaggggtgcgacggggcaccccgaggccccttggccacttgatgactacccgacctcccccgaggggagggggaagcaggccgcacggccacgtggctagatgaaaggattctttccctctattgtgcgtacccccgtgcccaaatcaccgacaatggcaataaaggacgcgttgtaatattttcagcataaataattttctaaccaatgaatgataaataaaagtacaaatagattaaatatgtatgttgatcggctcgtaaaattgattattatgaaagtaggtaaactgtacataattgcatgtcagcacccggtgacatgaatttctgcatagctagggcatataatatgtcccatgatcagtgactagtacatgcatgcacaatattattatcacatccatacaacatacaggtcatacaaataggtaagtgattatcatgacatacatgatagttgggccaatcggtcaaataaaagagtataaatgcagcaaaaatagatgtaagatacataagttttttggtatgctcatctaccaaacaaaacaggcaaccgactaaagtcaccctagaaagaatcatccctgaaagctccaacattcactgcaaagtaaatgtcgctaggcacttcacctccagcgtccatgtctaaaaacaacaacaagatgaccaagagtgagagtgtgtggtcggggctccctatactgataccgaatgcacaccgatttattctgatcccttaattggttgcatgaaatatagctacattagcacttgatcgatctataggatgatgatgggagaacaatttgaactcggttagtagtatggccacaccatatctatctaatataacctatatctattcctacttaaaaaataccaatttttcccattgtcacaatcgtttttcgtccgctgttgtgtcactcttgtcaacgttgtgcgtcatccgcctccacatcttgcatactcagtttggtggcatccggtcacatttatgtgattgcctcttcaacgactctaacactagatcctacctcaaattagaatgtaatgccgttgggtcaatcacaaacgcatacacgcgatcacctgaaaagtcaataggaacaacttgctcgtattttttttcctgttccaacgcaagtgcattatttctagtacatctcaacttgctcatattttttttcctgttgcaacgcaagtgcattatttctagtacatctcaatttgttaaaaaaaaacttgatgttcgttttgtttatcatttgtctttttccctctttgttcttatcctttattacctctctatttttcatggaaaaaaagtgagatttttcttttccacgggctgaacggcgcacgacgctgttcccgtgtacaccatgtttagattacgattccaatccaattaatttgctaatggctctgataatactagggtgatggggaattggggatgaagaacatgtctcatgtgaaaaacgtaaaaaaaagcaagaacattgagggtcattaattattcgggtgattaacttgggtaattatccttcattcacgctgaggcttaagaacagcgccgcacttttcagttccaaaacgatagtggccactgagatacatatgtctatcaatgatcaccttggcttgcaccataaagtctatcattttaaatatatatattgtcattcaagcttatagttaagttttaacaacaataagacctacgtagtagaaacgcctataaatccaggaataagtacaaatctatcataggatttgcatgaataacacttggttagtcactcagtcgccaatcggattctctatgtgcagatctgttatccttgttatctgattgccacatgctgttaaaatatactagcactattatctctcaaagaacagatgctacattgactgtatttagcttattttggattctatgtactacttcagtgatatttagaagcaagaagtaaaacacttgtttctcctagctagaagaacatctttgatttaatctaaaacattagaatgatcttcattgagagaaaaaaatattgcaaaatgctagaaaatttattaataatgttccaagaaacatgtcattaggtttgacataattttctacataaacatggccagttgtaatcctttacccttatcattctatgaaacaacaaatgaatacattatttcccttgctccactgcctattggaaaatattccatttttgacaaagaagtatttgcatttgtacttatatttgtatttgtgtattgttattgtttctagtcatctgataaaacaagtcttatattgtatttgtatactaattttttatgactttggcaatgaatcctaacaaaggaataaaccatgtccgttctgtgcccccacatagttataagcatcatctttacatcctctagctatcttgaacagtaaaatattgaaataagatggaaatatttcctgataagacaaaatagtgaaattattatcacatgaaaactacatgtgacatgaagagggataaagacattatccaaattattattttaaatttacgtgacaaccgcttataccaatggcaactgcaatctatattcttagatttctgttgttggtaggatttgcctcatgattatctatagaattatggggtttgacttatgtagacaaaaactacatatcattatatcaaacaacatatacagaaaaatcatggaccttttattgaggacactaacactgaaattgtcagcaagtgacactttgtttgccaaggttatgaccaactcaaccaaggaccaggtgtatgcaattgggccgtgctttggcttcacaaatattagtatctgcatgaggtgtatcaccaaggcattgcgggaaatgtaacaagcacgtgcttaaaagatggatgctatgacattttacaacttatgtaacgttagaatttttggtgatcttaggttcaatattagacatgacacgactactatagatgtatatggtgacccttgttatgtcgatcataataggttgtttagtaggggttgacggttgttaagtacaaatttttactgtcaactactgcataaaagaaataaaatatattatcaaaacattattggatttcagggtgttcaagcacgaggatttcgtgctgcagcaacgtgctataaacaactattcggtgcggtcacacagcttgtacatacaattatattagtcgcatcatatcgtcggtgatgctgactgaactgatcatggttttgaccctaactactaccagtacgccagctgcaggtttgccgatggccatattgattttgtaatatataggtgtgacgtaaaaattaataagtttccgaacagttatgttgccaaatacgttgtcgaccatgctctgacatacaacagtgttgaactgcctccgtttaaaaaaaatagttttacactatttatgttcaacgcttgactattcgtcttatttaaaaaaaattatgattagtatttttactgttattagatgataaaacataaaaaatacttccttcgtcccaaaatatagggatttttggattttgacagtcttcaaaatagtactttgattaataatatttataaaagtaagatattttaaataaaaaagttagtaaatttagtaacaccaattttacattattgatcttaaatttaaatttagtaacaccaattttacattattgatcttttttattttttttctattaatagtcaatattaaaaatgtttgacctggcactattctaaaattgcttatattttgtgatggagggagtattttatgtgtgactatttttttttacttttttataaatttttcaaataaaatatatggtaaaacgttcgacatgaaaatgcacacctgcatttaaattgggtcggagggagtattcaatagcactgtcagacatgctagttggtgccctttcagtcaacctaacataattgaagtgtgaattggatagtaatcgtactatttatttgctggatttttcttttctatacctcgatgtggtacttgagtatagacttttaatgtttcatgaagtggtatatatatgctgctgaatgttgtcaaatttttcgataattttacataacagtttggatagtattttaaagctcaacatacatgtgagtatagtatttataagcactcataaaacctaaatacaagcatatcacatcaatctattaagcacaaaactcaacatgcaaacatatagtaattacatctataatttatttttttctaaaagtaaacatacacatgttaaattattattctcaaatcatttttataatattttaatccaaattattttatcatttctctattatgtggcatatatccgctggcaagcacggggagtactacgaatagtcgagttacagcattttatttcaactgttgtcgcgtcactgcacagccacatcatctttatttcaagaacgtcaataacagaattattacggcgctgacaaaggcacatgcatgcatacatgcatggcaccagctactagccatgttcaacgcgccggcgagttctccgctcctttgtgcaccgagtagccggcgtcgacgacgatgttgtgcccgttcacgtacctggcctcgtcggaggccaggtacaccgccgccctcgcgatatcctccggctcgagcaccttgacggcgtcgctggcgccctcctccaccatcctcctcagctccccgctcaggcccggggacaccacggcgaggcgcgggatctcgttcagcatcatcggcgtcctcgtcgcccccggcgagatggcgttcacccgcaggccgtggcgcgccagcggctccgccatggcgcgcaccacagcgatgacggtggccttggagacggagtacatggcgagcgccggcatggggacgacgcccgcgccgctcgccgtgcagatgacgcagccggtgcggcgaggcgccattacgcgcgcggcgtgcttgatggccgcgagcgccgggcgggcgttcaccgccatcacgcggtcgaagccggcgaggtcgacggacagcgcgtcgtcctgcggtatcctccccgggatgccggcgttgctgtggaacacgtcgaggcggccgtgcagcctcacggcgaggtccacggccgcggcgacctgcgcctcgtcggcgacgtcgcagcgcgtgtacgcggcgtccgggccgagctcggaggccaccgagcgggcgaggtcgtcctggatgtcggcgaggatgaccttggcgccattcttgatgaactccgctgccgtcgccttgccgatgccgctcgccgcgccggtgatgacagccaccttaccagccaacctgtgcatacatctcaatctcatcacgaaacaacgtacatatgattgaaacaggagatcatccaagaactaaaatggaaggcagatgaaattaacctctgtaaattggacaccgtggagaagcaacttagtgttaaatctgcacgggaagttgtttttgttccaataactctcttggtagtctctctgcaacacaaccggatcacaacaaaatctttccagtttcagctatagtgtgtataattcggctatattgtatacaatacctgagaagttgtgttactctgaacatcctgctggaaaaaaaaaataaatggctacaacgagatattgctacaacgagctagagctggtcgtcgttgttggctcaggtgtggtaacacaggcagtgggagcttccttaagaaggcaagcgcgcagccagaaaaaaaaattctcaaaataaaactggtccacaaaattatgaaaaactattctgttctatcaatatttgaggcaatcttcttgccttcctttcaaaaggagagagagaactttgaaaattcgatgaaagtacgatgcgaattgttctaaataaggtaaattattgtacgttctttaaattggcaacgtcacggcgatgaagtcaaagtaaacctttaatattctataccacaaagttgtacatcaaggttattatagccaacttgttattattgtttacttaagagagtatacgatgtgtacgtaccaacacacgccacgaagtaaacaataataacaataataacgaagttgtacatcaaggaattcacgaagtcacaagtgcatgcatcctctacacacgctggaaactgttaaaaaaatttgggattggcccataaaagcctggcccaaatatatttattgggccatcacagaactttctatatagtggattgcactatataaaaagagaaatgagctactcattgtacagttgattggaggattgaatagtaaagagagtctcaccccaaaatcttgtatacgtcatcagacacgaagctctaccggagaccaatgtaggagaaaggtaagaaactcgataatcctctttgcatcttgtagattgaattgcaaaaatgaattccttgcatcttcctcgttccgttttttgactcccaactaaaaccgccatcaccgacttggagtcgccggcatgtaaacgattggggttttctcggcatcctccatcgtggcagagacgaaactcaccaatgcaagcacggatcggagacacgccgccgcacggcatcgcaccaccggtcaccggccacgccaccgcacggcgtcgcgccgacggccacgccacggcatggcgtcgcaccgcgccgccggcaacactccgcacggtgccgccgcctgcagtcgcggccgtcgtgtgcactgctgtgagccgccgccggcagtgccctgcacggcaccaccgcccgccgccgtggcagccgcgtgcactgccgcaagtcgccgccgcgccgccatccccacacccagcaccgcgagtcacagccgggcgagccccgtacggcgccgttgcgagccaccgcacccccgccctgtgccgccgcgagctgaccaacggccgcgccccgcacagcgccgccgcccgattccgcgaccaccgcacagcgccgccgcgcaccgccacgcagcgatgtcattcgcaccccgcatggcgctgctgcgcgcgccaccacgcaccgccaccggacgcatcgacgcgcactgtcgccggccgcaccccgcatggcgccgccgcacgccgccgcgacagccgcgtgccaccgccgacagccacgcgaaatctccggagagaagaaaaagaaagaagaaataaggaaagagattagcgattttgcggaaagcctcctagattttctgaaaattagacgcatatctcccagcatggaacttttttgcgcataggaccctagaatttcggaaacgttcatttctaaccattccctgcatggaaaacttagaaataggcccttgaattttgcaaatgtcgcttatattccatatttaagcattttatgtcttataaaatttcaatttaaatttattaaggcattaattactgttaatgaatattttgaatattttgtttttagtatttatatgaatatatgcaacttttgcaccttttttctacgaatatttgtttgcatttctacaaagtatttatttattgaatattttgcacttcttattcgcattccctatgaatataaatattggaaaaatcatgaaatacttgcattcatatttgcaactatgtcactggcagtaacatatgaatattttgtcagttttgcaacagaatgtcagaatcacgaacaaggagttcgctgaactggcccagcatggccagagctacctgacctaggcatctgacgtccagatcgttcttggagccaagaagctctgccagaggatcgggatgggcaccccgcaggaacgtgcgcctacccctgatgagaacgattaggcgctgcacttcctgcgacaccacctctgtgccacgctcaagaatgagtatatgggattacggagcgcactcactctttggaccgcactcaagaagcggttcgagaagttgaagtacaccatcctaccccaagcaggactgggctcgccagaggttcacgaacttcaagagcgtctccgagtacagatccggtgccatctccgcgctgcaccggatctgtactaacctctccctctgcggcaaggttgtcacggattacggatacgacaacgctctccatcttccaccctagcgctgtgcagagtgctcgtaactacaggcaggcatcatacaaggagtatgacgagatgatcgacatcatgcagttgtctgagtcccatgacgaggttctccgcaagaattttgtctcccagccgcctggcatgagtgttggccttgatgtcaatgttatcagttataaggtctacaagcccgtccagaggaagaggggcaagcgtggtgggaagaaggcagtcgagaagtcagagagaaaagctccagctgcccagggagcacagggaggcaagggcaagaaggaagccaagccacccgcaatgacaagccgtatggccagcaggatcagacatgctacaagtgtggcatttggggccactagggccgtatttgcgaggagccccaacacgtcatcgacgcataccaggccagtaggaaggccaaggcgtccatagaagcacacatggttgaggctatcactgtggctactctctccatcaccactccacctgacgcccctacagttgcagcagacaaagcaaatgaagaggccgtcacacaggagcagagcttgatactctagctgattccatttgagtatttgatgctcctattttttttcgtgaactaagttgcattatgaacaattttgaataatggttttgtaagctctatgagaacataatatttatttcgtgatttgccttgcatggctagactttatttccaatattatgttgcattctgctatatgataaagttttacttattgccttgaagtagtgatattttactttattcacatagacaatatgcatagcctaaggtaaagaggaacattgtggaagaaaagcaccacaaagtgtaatcttgagagagatgagacaagttcagtttatgcaaagacgtgaactaccttcacaactacacgttatgattgtaaaagatattgtttttcccgtagataagctattacacctcaaatctcttgagaatggaaaactctcgcagaaaagttcccttgtaggaactagaagatgagagaagcatacacatcacctaagcatgcgagatcaatgtcctcactaagaaatgtaggctaaagtagactatttcatagtcagtttttcttagaatttagtatcttgcaaatgaacatagcacaaacaatgtcacatcatctgtcgtatcgcaatggtgagatatttgtcacgtgcactgcctgagcgcctcgcgccaggcttgtgccagacattggcgtgcatcatacaacattatactagtgccgcgcactaaatattgtacaatgcaccaactagcaaccccgctgtactgggggactgaacgaatcaagccgcgttagcacgcgccatgcaactcctaccatgcgccatagctgcacccgctgcataccctgtggtcactctggatacgcatgacatcgaacatcggatgcgtgccaaacgtcgatcaccacatgaattctagaacgaattcgcgcataccatgtgaattcgcatacatattttgccctttaatggatcgtctgatacatattgggcttacgaaaaagctgcaattgtgtctaattgatactacgctcttgccaaatcgatcctacaagatcacacatgttggcatcagcacattaagaaaagcactaagtaccggacgtccacaagaataagactaaaaaattgtccattgcaccactattgaaattcccgccacttgaatggactcttagctccaaaggcagcgaattatcaataaccggactattcgaaatgtgttgtcaacttaaaggaacactagtgttgactcaacacatgtgcataacccagaaccataagggctccctccaaaaaactgaaaatttttaacagaggtacgaacgtagcctaaattccttgacaataagaaggattatttccagtcatttagagggagagaaataacccttaaaatgataaatgtcaagaaaaatggtcaaggaaaggatggatgcacctttaatcaagcaccagcgaatgaaagtatgaaagcacacataagaattggataactgcctatcacttttgtgattcggagagcatgactaagttgcattatccaaatgtaatgcaccggaggagggtgaagtaccgaagaatgcaaaggtatacctcatcttgtctagaggcctcgagaaaaataatgggactagaactccggccccttaaatccctaaagtaaccagagacgtgtggtgaaaacgggacaaaaaggaactctcaaggtcatagtcactaaaagtaaccccagaatttgaggaggagccagttcagagctggcaaatggtatggaaccttagaacaggcataccacatcttcctatcaaggaagaaaaccagcagttggagtgcacaccaacgccggtaaaatgaaaggatcatgcccatgtcaaagaatagaagcataaattgcatatccccatatatccatggatactcgcataagtgtcacatacaaccaataggaattggtaatgagacctgctatgggcaatattctcttcgtacagcaaatcatttggagtcaacctggagttgaaaatcaactaaaatatcaacccgcaaagctgacctatagttgacaatgaatgtttaaagaaattttggattgggcactcgcatacaagcattaaaagtcccaaaccaagttgatgatccgaatatcatcgcataaagaaagaaagctcactctttccgaacgagtttgagataaaaaaaggtagaaacctatgttgcttaggcctgtaaacctacaacacatggtaaaaatacataggttccttggatatagttcaccatttctagcaagtaacatggttcgagctttgtccaaaccccaaaatcattatcaagaagataatcatatgtgcgtcgcaccagcactaatagactatatgaactctataagttatggaaaaatcatgcaagatttgaccattgaagcatcacttgaactatcttttgaaaagatatgagcaacgagttttgatggttcacacttaaaagagatgcaaaattcagggggagaattctgccagtctattaacaaaggcttgaactgaagaatcaagtacccaaaactgattaagaaaatcggtacaagaattttggtagattgtactccttttcccttcgataagttttcctgtagtttcttatcaaggtttttaatgagacaatctatgtgatatacatgcgtatgctatgtactctttatggagttttaacgaggcatggacatcacgcggtgagtgcctaagggggagtgttaagaaacttttgggcttggcccatgaaggcctgacccaaatacacttattgggcccatcaccgaacattccatatattggattgcactatataaagagaggagggggttactcattgtacggttgattggaggattgaatagtaaagagagtctcacccctaaactttgtgtctccactttctgtagaaattacgagaccctcttggactacttcatgtagcaggaagattgtgtaatagaaacatcggggcaggccatcaaacgccttcagctcatagcatgagaacacacatatcgatggaaaaaagcgcacatgcatgttataattgtgctcgcaagtacttaaaaaaattgaaagacattaattaacgttaaatcaaggatttaaactcagtgctccctttatttttttagttttaatagagatagttgttcgcaactttttgtgacaagtagacaagcacgatcgcaacacccaaacgccttcggtgattgtagagttgccaaccatcctaatccagcaaaagctagatcaagatgggttttgatagaacaaaccggctagtcaagccgatttagatagattgatggataactacccgtctcgtgggcaaaacggaaggtttcaggacaaacctacaaaagattttgcactctcgcagcaaaggtggacgatttacggtgcaaatcgacaaagatggacgaactaaactagggcgaattgaa

SEQ ID NO: 60549 - DNA, 4344 bp, Oryza sativa
aatgttgaagtgcaatgatgattatggcttcactgatttgcaaaaatcagaagatgaggtaatatataacaaataaaaaatatttttacaatatatattatatatataattatttattggatgttctgtagtttgggcagcacaattttcagataaaagaagagccaaaaaatgaaagtagtgatgattatgaaatgaacaatcatcgcaaaacaaagaaagagagatcaaacatgagatgtacaaaaagatcaaacaaggtatgtataattgctttcttatataacaattcgtaaagttatttatagtactacactaataatgatgttttataggaaccatacattaccgattttgatgggaaaacaaatgaaaaggcaattacaatcgatgatgattgtgaagaatcacttgatgattattttgatgaagaatacaatgaaaaggttacacaggagagtacaaagacgaatccttctaaaagaagagttacaagatgttttaaaacatctaacaaggtacttcatttattttactttccaattcactcaatttagttttcacataaattatttaccatttcaatatggcactatgatataggctaagaaaggaaaatgttctgaaatgaaaactcagagaaataaggtacaattcttacttttctttcatatacaaaacgatttgtcaaactattactgacatgttatatacaattgatgggtattaataggaaccatatactactgattgtgagaagatagcaaatgacaaaccaatttcgcttgatgatgattttgatgaagaatataataaaaatatggtcatggcggacaccagtacttctaaaagaaaagtcagacactacataggacaaactaacattgtacttcattgagttttactttctatttaatgttacctttcatgtttgtccattaatgtcaatatgctattgtgcaggtaaggggaaaaggttgtggaaagaagagtacaaatatgggaacttgcacaaaaagtgcaattgaaaatacaattcaagatgatgaagtatttgatatatttgttaaataaatcatgtattttaacataaaacttttttaattaactaactaagaacacaaaatttaggtgcatgacggaaaaattgcttcaggaactgctaaaagaccatcaaggaaatttataatttcagatagtgaggtactgcatgagacaatttatcaagttattaattaatatatttttttttgtaacaactaatttttttcccataggatgagcacagcagtaatacaaaggtgactggggacagcaccagctgtaatagtagtaaggaagatataaacaaaggtcgatgcaattataatattgagaacattaaagttcacatgaatgagcagtccagtcgatgcagatcaacaaggattagaagaccacccacccgatactcatattaggtacaacatattacttatgggaaaatgttggttgctttagatttggtttgattagtaaattataataatatggtctttcgtctgcaggtaatttatcgtcaagaaggcccaaaagaaccaattaaaaggagggttcagccaatactttttattgaagaatagtattatatatgttcctattaatttttatgttcattagatattgtcagatgtaacgtacaacttgcacttgccaaaggaatccttggattactttgtttatttctaagatagagagttaataacattcaatataaatgcatgcatgtaccttcagtacatgtatatgagtcgatccctgcttgcttcctctaccgttgatatcctaaaagcatataaaacaagatcagttgatttatatttcttaattaatacaaatccccaagcaagaaacttaatgattaaaaaaacttgattatgtaaaatggaaatcaatcaagaaagatgagctctcggggctaccttcgctctcagccatgcttgatgttgctgcacctgctatccgcactgccccaacacctgccatccccactgccccatttcctacaaataccacctcccataccagagccaactaaccgatggctaacactactcctgatctagacatcctgcggtggatctaccaaggcactgacttggatgccctatggtggatctagccaaccagtctttcagccgtcgctaccacaaggcattccctctcaaatcggctccgatggatgagtagtggaggagaaggtagtgatgagtgagctagatagattggagaagaatatatgttcagattctccgccgcctggccttcgccctcatgtggccattcgggacaggaagacaaacgcgaccgcagcgcagatatgtggccaggaagggcttgggaggagataacgatgtgcctgcaattttacactttggtcctgcagtggattttaatttataaatgagccctcagtctattatcagtacttcagtaatgaaacgtgtttagtatttaccaaaatataatgaatctccttaggatgattgtaaacctttggatgttctaaataaaaccgcatcaaaggaactttccaaatgtgtaatatttaaatggattttacaataatttaattaacttctgtaaaaatcaggcaaaaaatatctaattagaaatttgacaatatatatatgcaatctattttcaagtacaataaaaaaaatataccatctattcagcttatcatccgtaccaataatttcaattttaaaactgccaaaaaaagccacattgttttttatataaccgtactaaaagtattgcaaaatagagttgaccgtacacagtattaaggaattacatcttatacatagaatggaaacgataccattaaaaagaatggaagacaattgttcaagtatagtaataatatggatggagtactaatccacgacacataggttcatggaaactccacggactctatattcctatataaattaatcttacaacaatgctgcaataaataatctactcttcctttcttccggagacaccagtcaggtccctatcagttctctccatcatcttccatcatagtgcaacttatagatttatattgacaaacactcacatatgcagttgatactttatattttttgacatttgattcgcagttgatacttgcacaacaaaaatataggaaaacacgatgcagagtggaaatcaccctacggatgatggcagtccaacacaggacaggtaagaatcaccctaaataccttaatcgtttgtgattgactcctgcaaactgcgacaattatgaactgattttcatatccaattttaacagttcaaacttgactgctcgagccaattcaaaggaattatcgcggttagcaagatcgaaaaggaaaagaaaactagacctgagaaggagcggatctccatcgaccaaaaattactccagtgcggatgaaacaaatgctcttcaaaggtaaacactcaagttatcatcacaattactaaaaaggaaatgcgtcatatttaacaaggatatgccaacatttaccaggaaaagaaaacttgatgaaaaaaggactgggtttcaaatgagcaacaatgagtcaagcgcagacacaggaaatcccctgcaaaggtaaaattataggcgaagaatacaattacctatgaaggtcctgtatttaataacaatttatttcaaccgcaacaattatgaactgattttcagatccaagtttaacagttcaagcgtatgtatttaataacaattaatttccgaataggtacaatacatcagaatcagtcaaaaaaagtagttatctccctgttttgacatccaattttcacagctcaaacttcactgctgaagtaaactcaacggaactcgcacgcttatcaagactgaacaggaaaaggaaacttgaccttagaagaagcggatctacattgaataacagttcgacctgttcaaatccagcaaatcacactgaaaggtaaacatacagaaaatcaacaccattgttagaaaggaaatttttccttattcaacaataaacactgactgtgatatgaataaaatcaggtctagaaaagaaaaatatcagatcccatcaaccaacatggaaacgaataggtatgttaaccacattataaaaatgatatcatcattcagtttatttttaaatcacttttttcttttatgaaaaaaatatttgtcttccagtctcaagatgaatgatcgagtaagtaaggaaggaaacattacaaggaataaggttgctgtaccaccaaggaagaagaaaaaatcaagcgtgaaagaatggaattttggcaagcctacat

SEQ ID NO: 60550 - DNA, 601 bp, Oryza sativa
cttcgtgttggtgtcctcggatagcccggccgagctcactatcaccggtggcagcgtcgtccagtgctaggccggcgatgacgtcatcgtgacgtcataaatcctttatttaattcgtaataattttctgtattagatgaaaatcgattaaacttcggaaattcataactaaatcatcgtaactcggattcgagtggttcaagttgctaaattcatctaaaatcgagatctacatgttaaaaatatccacatatactgtttatgcttatttttgtactgttttgttgattttgtttatttgctttagtttccgacgttccggaggagagcgtttacgttgaggaaggttcagaagcgtttgcggaagcttaaggcaagtcacacagatctcaaacaaccctttgagcatgttgaacctatctaaagctaatgttttatttcaacttatgcattattttcgaatgtcatcgggtggtgagccattcccaattaattatggccgaagatgactttattttcctatgggtaataaattgattagcttggactttatatattggattggttcagctaaatgctatatatataattgcttagccat

SEQ ID NO: 60551 - DNA, 30953 bp, Oryza sativa
acactttactatcggttggtataacaaccggactaaagattgaaaagaaagatcatggtagagaaagagctgtgcgcgtgcgtcctttatttttcttcccccttctcttccttatcttctccccttcccctctcctcccctcctcggcttctatcgaggcgggcgggtggggcgggcccgatggcaatgggtggcagcgtcgacagagcctcccccaccttctattcccctctcctcggcttctactagcagtgggtgggcagggtgggcccgatggcggcgggcaacatcggcggcgggaggcatccgaggggtggtggcgctctgcccctccttccccttccctccttggcagcgggcagtaggcggtgatgcggggtggcgccctgggaggtggcggcaagccccaggcgacggcaggcttgggaggtggcagcgccctgggaggtgacgacaggtggcgatgatttgtgaatttgtggatgaattttgttattgttgagtatgatttgttgtgggtgattgttgacagtcgttatcgatcagtttcgaccgtcaatatttcgaaaacaagagagaactagtgatacttgcaatgcataaatatgttagaataataatattccgctagtattaggtctactaaccttttgcatagaacaacaataaagtgaaggagaatcgacatcaactcatacgataaatcaatcggacgatgtcgggaaccagacttgtgtatgaatgggccaagaacgcagacttgacataatgaatcaggccaaaattcacaagtctacaaagtgaagcagcagagcaggctgccagccgaaattgggctggattgggccagccccaggttcggccgaacctggtggttcggccagacctccctcgcctccgttggatctaggttttggctgaacggtagaaatgaagccccaatgatggttggagggtattcccgaccattccaaccgtcacaactgtcatagttcagctatagaaggactttaccttctctcttcactcacacacctcaagcaatagctctctcattcctctcaggtttagtttagtagtatctagctggtggaatagaattagaataggaatcaggagtccggaagtcttcggaagagttcgggtatggctctggtagctttcctttcctcttttgtaaactttgtacttttattagaatactcttctaaatacatttctggtattgaaatactttccgagtatattagtaccaactttacattatgttcttgttatactgaatatgctgctagcttatctgggagatgttttagtgcgagtatagtgtttgcttatgcaattactctatgtcatgacgatgatattagagtagtatctggtagtttagacgtggtgtctagattacgggatatcattatttggggttatatattgcggataagaggtggaccgctgatggtgacagctcagtacgggtattcctccgcacctatatataatcctaagttaatttcctggggaggatattcctccgtatttagccccggttggatggtcatgacgggctgtcataaggaactcggcagtcaggggtggcttctcgaagtaccaggagggcatcggatagaggatattagctagtatatgtcacgcccggaaattcactaataatttccgaactaatttgtgcataaaatcctcgtccaggaatcagccgaggtacacaaactgacaatttaatatacaaatccatcataataataacgttacatacttacaaaagaaaagaaaaacaacggcagcggaataacagtctagcgatggcttcagctccactcccacaggcaactcaactggggtataagccaaacgttttctccttctggatcctttttcttcaactgaggttgattgattattgcaagaatgagcatatgacatactcaacaagccacacatcaaatatgcaagtgcacaaggacaccaaaggatggcataatataggctcatttgcaaaaacagcatttagcaaagatttaagagtagtaaaacagtagagtaattaatcatcaattttaatcaacactgaacagcaccctaatgctgcacaggcccaaccaaacctgaacaaccaaccccggctgtacagatctaactccaaaccaggagctaagcaaattattaccaattatagcatcaataattattgtgagaggtgtgaggctaatcacgaaaaacattgctcaactcacccataaccgcgggcacggctatttgaatagttttactctggccagaggtgtaccactgtacccacaagacacagcctcaacatcatgtctaccatgcgtcgcgatactggaaagtacccgaatagaggctgcgacaataccctctgcacaacacaactcaccacagtgcaccattcctggatcataatcaccccctctataaatataaccaaagacatggactccccagcgacccccacggacttatcaccgcttctcagtctggcaccccgtaatgaatcatgctatacaaaaggtaaagccgttgcccacgctggcttgtggttggcacggttaatgtctcacaacagtagctcgcgaactggtccttaattgtcatgagcacgaccttcaaaaccatgtgctcacaacccaccagtatcaattttagttgacaattaattaataaccaatcacgattaaccatcgtgagctaccattaaatttaatcataaataataatgtaatgtgattcatcccattaatgatctaatgtttctaaacatggctaagcaattatatatatatggcatttagctgaaccaaaccaatatataaggttcaagctaatcagtttattacccgaggtatcaaggaatagggcattcaatgcaaattggctataacaaaggaataggttcacaccacccggtgacatttgaaaataaatgcacagttgaaataaatagagaatttaaatataggatcaacatgctcaaaggattgtgtttaggatctgtgtgacttgccttgcagtaatcagtcttgaattaatcttcttgaacacttccgacgcactcacgaatcttcgcaacgacggaaacggcaagctaacacgcaaaacgaagaaaaagactaataaaaaccaaataatcagtacacataaagtaaacaaacatgtagatcatgattttagatgaatttagcaacttgaactacttaattccgacttcatatgaattagttatgaattttacaagattaaactgattttaagatttaattttagaagggaaaagggctttatgacatcacgatgacgtcatcaccggcgagaggctcgggacatcacggtcaccggcggtcacggcggcgagaacagagggcaccaacgcgacgagcacgacgcggggaactcaccgagtggcggcacgacgacgaacgacgacggaagacggccggcgacaaactccgaaggcggcaaggtactggtcgacgacggcagcggcttttcggcgacgagcagcggcaacggaggggtggacgggcttctccttggtgctgcgatgccgagggaggtggcggcacaagtcggggacgaccgaggcgacggcacggcgcggatggaggcgaagcagatcggcttgacgtcggcaatggccttccggttgtcttcggcttcggggaagtggaggccgctcttcctctcttcgatgcggtcccgatggaggcgacggcgccgaccggtgatggcggagccgacggctatagctggctggagcggcggccggaggaggagagagatggctagcgtggggagagacggctagggcacgggagctcgagctagaggttggaaacgaaagaggagagcctgggggttctatttataggcatgggagagagagatcggactccaaacgagaggatttgagccggaaaaaccgagggttagttggagagataaactcgaaaacgaattcgattccgcgttgatttcttcgggataaagtccaattcttgggggtaaggatagaggaggataagaggaatatttcccctcaactaattttgcaaacggagcacgggatgcggcggatttggtggaggaagcggcggctgcacaggtacaggacggctggctcgggctctatccaagcttgaagacgacactgtagcagggaggcgaattagactttctgtcttgggctggctgaaaacaaagcaaagaaaaaaaagaggaggagctcggctgggccgacttgggctgcacagcacgcgcgcgagggagagagatgttgggctgaaatcagcccaacggcttaggagaggatttaaaaactttttccaattaaaataatcactgaaatgatctttgaattgttaaaaatacttctaatgctcaaataatttcaagaaaagtcctgaaaatactggaacacccaaagtacttaaaaaaattataatcagaccatttaatgattaatttaatatgttgataattactgaaatgttctttgtatgattaaaattaggaattgagctccgaaaaatctgagaaaattctagagagtataattaaccatggagaatttaataaaaaataaattcatccatgctttatatttagaaaattttatttcccacatttaacttctcttgtaaattaatgaacatttaatataaattctaataataatttattaaataatttataaatcctaacacgaaaatcaggatgtgacagtatatcagttaattagaatgtattgtatactatgtatattagaagtataggagtagattctctttctcttttctttccacctagtttaaattatttattatgaggatgagtagttgaatgcttgtgtgtcactctacccttgaattatcctaacccctacttagaatatgattatcacaagtaatatataaattattagttgagttctctctatatgatcttcccatgggataaaataaatactatacccttggaatactctcgggtgaaatggtacaatggtatatccgtgcgcttgcggatgaattctgtaaccataatatgccagaagtatttctgtgtcattgctgggaattatatttctcataatgtcgttaagaaataccaacagtgattttgttgtggaggtggatgatctgggatgtctgatttgtagctattcgattagatgattttgattgtattttgtctgatttgtttgatctgtgatgattttgatttctagcaactcgatctgtgatgtggggatttggggatgtcgggagcaactctgggacgagttcgactcgaaatcaatgtgcaagccagctaaaaacaatgaaaaaaaatgcaagccaactaaaaacaacaacaaaaaaaaagcctagcgccacatggtgggactatcatctttagtcgcggttgatgctaccaaccagaactaaagacaccgctaatcatacacatctttagtcccggattggacatttcggttgcatacccggaactaaagagggttgcgaaccggccgagtaaagatgggttttcaagtactgatagtatcacaacagattcctatgcctatcttatacaacaaatctattgtgctgctataaaaggcaaaaattgccctaggacaaccaaaaattttgtaattggctaggagacgctgtacaatcgcgtcgctactcatgaacaccccaaaattcgtgtaacttgccctcatctgagacaatattttatcatttctgataaaaggaggagagagaaatttcaaactgacaaaattgccctcagccctatctaatatccactaccggttcccgcttcccagcaacgctcaccaatcaccgttgctggcgggctcaccgaccgtcatcgaagccaccactgcccgcttcccagtaccactcgacattgccaccgtcgtcgaagtcgttgccgtggggctcgccgaccttcattgatgctgccaccgtcgcacccaccgctaccgccatcggccaccgtcgaagccattgcctccgccgctgttgccgagctcgtcaaccgtcatcaaagccgccatcgccgccaagcttgccagccaccaccgaagccgttgtccccgggctcgctgttagtcgtcgaagtcggcgccgggcttgccgctgccgcccacttcccagtgccgctaaccgttgcaaccaccgtcaaagctgttgctgccgaggggctgagggcaatttaatctttttgaaatttctctctcctcttttgcccggaaataatagaatatcgtctcgggtgtcctatagaaaattacatgaattttgtagtgtccatcagtggcgatgcaattttatgattcttctagccaattacataaattttgggtgtcctgtagcaaattttgccgctataaaaatactccatataaattttttgataagtaagaacaaactttttatatcatatctaaaaataaaaatactccatataaattttttgataagtaagaacaaataaatttctacactccaacttatatatttcatcatactaaaaagcataatggattttttatagcactttaatttaatgctaaactagcggtcaactaacgaaaaccatatggaatagatctaaactaaaattcaaaagtatataagcaaatgagcaaaacttaggagtatagaagggattggataaaaatttaggaatatataagaaattttctcaaaatcagtcgtgcaaatcgatcgatcgagagtgaaataaaaaatcatggatacccacggttatctttatatttgctgcagaaaccttgggatataaaactagctagtttttgctagatccgtagatgctgccagaggaatataattgcacatgccacgctagtgttaggtactaataaattggttatacaaggttaaatattctggtgtagtgttatgcattcttagtttagaaagaaaaaacttggaagtgcttgtgtgtccaatccttacatatttgaacattttctgtccacagggcataactgtagaaattcctaaaacttcaaattggactgctcagaaaccttacttggaaaataaccccaagatgtcaagcagtgttattcgacaatgttcattgctgcttttaattactttgttggttatatgttttgaagggaatgatatatatggcgattagttatgtcatggaaaattactggaacatcgaaaagggtaaaaatacgacgcaggcagggactatttataagttggaccccccatcaccccatggcatatcattactaggaacagcattatcacaagcggccgaaaagggtcttcacaggcggggcggcagtccgcctgtaagccaacgactgtgaagatcaccgatcttcgcaggcggggtggccgtccgccagcaaagataattttcgcaggcggacgttggctagtccggtccgcctgcgaaaataggaatcggccacctgaaaaaaaaaacttccgcctgcgaagataggtagaaaatattgaaatttaataataatttgcccgtaaattacttttaaattatttaatataaattcttgcaggtagattattatgtacatatattagaagattatcaagcatttggtaatgataaatgtacatatattacatatctcaaaagtgttgccaaaatatatatattacaatatttttttacattgtcactttaaatacgccatgtagttaatacattatggcatagcactgttccactcccgaagatccttgaattcgtcacttgtggctagggcaccctctgggtcgaagaaatctcctttcacatgacagcactcatggttgatgaagtggcacagatcacgctggacatttttgatgcctgtatcatcaaaacttgttcgatattctaatcttggcaactgcatgcattgaagataaacaatatattagtatcataaatatgtgaagctgtctagcacatagtatagagacttatatcctctgcgttagtcctgtacctcccattaactctaaggaattcgcaagcgtaatacccgcaaaggatcgttccttgcggttgcttgtgatacttcaggacatatcataaaaaaatagttaaaatttgcaattagtgaaacaattggtatacattaagtgagtggagtattaccggccaataggtacgtactagcagcttctcccttgttcgggtctgttctccacccatgaacttgtagtactggtacactctgtatggatgtcgtaccgtttcacattaaggaggatatttatttaaaatacattcatataaaaatgtaagagtcataatcacctactactgtaagattgttagaaattctttgtatgactggtgtttgtaatcgagagggtccaagactaacacagctccgtctttagggtggatgagtaaacagatataatgatcgctacatattaacaacatcatagttagttagtaccagctaaaataagacatatgtgtagaagataaatgtatcggacttaattaaaattataagcggccatgacgactctcttattttgaaagtgcaagaaggctcgtccaatgtactacgcgacagtaatcaatttctccttgtgcaagcccttcttgtattcagctatctattttggattcttgcccttcagttggtcagacctggtgctagcctcacggtatgttgtgtttggtagatccgagttggatccaagaagccgataggttcttttttcttcttagcatccatgtattgcatcctacagaagaagtttgttagtaacaatcacatggatttgtattgtacatatttttcatataattaattaaaaatcatactcacatgcaccaaacaccgaagtagttgacatccatcttatcccgacgatatatggcatggagatctgagaaatctagccatacgtaaccttcttcgccgaaacaatctgtcggtgatcgagctgttatattgcccaagcctttcttgctggcctccatgtagaaggtatgtaaccttttcatctcccatggtccttcgttcagtgcccattccggcaagagtgctttcccatgttcgtacttttccgggcaatcatcggttgcgaagtatgttggcccggctagttcagcagccttctaggggtcatcatttctgagcttggcacgttccttaccccttctgaagacggttaccatgaacttctccttgttctcatctttgacttggagtcgtggctcctaagcactctaggcacctcagaactggtagtggccttctcagggaccgtggtctcttgcacctcagggtctttcgcaggagaagggttttcaaatatttctagctttgtaccgtcccattccaatcctggtacttcttctatttctgacccaactgatgccacaaattgcacctctggttctgccactgtaatctccataggcacattcggcactggaatctccatggctaccgccggtactgcaatctccggtggcacttgcagcactggattttccttttgcatcttgggttcctccgccttatcagtcaccttcctcttaggaggtctcggaggttttcccaaccccggttttggcaccacaggtttttgcgtggcgtcggtgcccaatccaaaggatatgtcattcttgtgccagagaattacaaggtcgaccgcatccccaagtacggatacaccatctgcagtcgagaagtcaatgtcgtaggactcaaacccttcgtggaccacttgcggctgcaccttggcatacgcatcgggtatgaattcttcattgtatgttctcccagggatagcaatggctatagcggcctcaagagttttcccggagtgtccaatgggaacgtgcaatctacagggtgtattctccatgaggtcatcgaaggggtaatctggctcatgttctttggtttcggggtgaggcaaaatcatgtgcttgacgcagaaatccatcatttgcctttcaaactccgcagccccttcgtctctaagtttatccttgtacgcttcacgcttcttgtgggggtcatgtttgaaccctttcttccaactcatcttgctcgacacacctcgaacccttcccccatgctcaggagtacccagcaccgtacttagcacatctttctccctcttaggcttgaaaagtcctttcttctctgaactggataaattctctattttatcggcaacgctctgcagtttcggatcttcaaacgatacttttccttcatccgtgatcttcagagttctagctcttacccagtccttgatctttgtgtccattcctccattagtaccggttgccccttcttcctcatttcctcctcctcttttgtccactgctccacctttggtgcgtattccgcggagcctaagcgatgaggaaatttgttcttcttggccaactctgcatacttttggctcctttgaatttcttccggggagttcttcaacgtcagaaagtcatcccactgattcggggttatgttggcatacgtccaaaacggtgtgcatcccgtcttcacaaatttcttgcttaaggtggttttccaaccacgccaagacttggccattgtttgcagtgcacagttccacactgctatctctgatccatctaggaactggaagattttcttcaactctttccataggacttccttatccccattcgatacatgatcccagtccttgaccgtgatggggatcttttcccttactattatgccacactgtgaactgaattttgcacgtgcagtgttaggggcgagcagctctccttctggcgaaacatgggtaacaacatggaacccttcatcctttctattcatgcttctttcgcccttccttttcttcgcctttgctgaccgttcgcttttctttgagccggttgtgttagctggtacctcgtcgtctttcgacataacttttttcttcggctaccgttttgatcgccgtggcgccgtttcctacgagaaggtatacatgaaagtttcgaattagctcgggctaatagttatcacgatgaacagtttacatattaagtttacttaccccttctttagggggaatgtagtctttgtcgtcttcttcatcgtcgacctttttccttctcttcgggctcgggcttgggcttggacaaggatcgcttggcaacgagtactcatcgtcttcgtcagctatgtcgttatcggaactatcttccggtgggaccgttggtaccggagcaaccacaacagtaagggactgctcttgctcacctaaacccttctcttcagtccctttagtactatcggccatcgtttcaaacctctaacataaaaaaaagagttatcctccatattttaaaatactcaaattagtataaacaactttgtacaaaaataaattgtatattaacaatatgtcgtatgaacaaatttaaattgtctgagattaccatatattaacacgtagggaaaatagatatgttattaattagtacttactattatgctaaattaattagtacaaacaaatttaaattgcgaaattaattactacttacaattatgctagaatagatatgttattaattagtacttatgctattaattagtacttactattatgctaaattaattagtacaaacaaaattaaattgcgaaatgttattaattatacttactattatgctaaattaattagtacaaacaaatttaaattgcgaaatgttattaattagtacttactattatgctaaattaattagtacaaacaaatttaaattgtgaaattaattactacttactattatgcaaaattaattagtacaaacaaagttgtacaaaatttgatatgttattatcatgtagtgcactaattcacaattacatttcctcgacatgttaacatatcctccacatatcctccacattcttttaaaaaaaaatgttaacataccctcccacatgttatttaacaaatatgacaaattcacatatactgcaaatttgaacataccctcccaatttcattcacatatcacccacattcccaaattcacattcacaatcaacatataacccctcattcacatatcacccacccctcattcccattcacacccacatgcacacacatatataccccctcacacccaaatgcacacacatataaaaagaaacacccacatgcacatacgtccgtggacgacgaacggccgacgacgagcttcggtcgtggacgacgaaggaagggccgacgacgaggttcaaccgtggacggcgaaccggccgatgaagccgttcggccgacgacgtcttcgctcgtggatgacgaaaggccgatgaagccgctcgtggacgactgcgagagagagagagagatggcggcggcggctgtggagcggccggcgacggtggagaggtcggcggcgcggtggaggggccgggggggaagcagccggcggcggtggacggtgccggcggtggagcgctagcccgcgagcttgcgcgcggtggacggcggtggatcgatcgtcgacggcgcaagctcgaaggcccgtggcgcgtagaggacgacggtcggcggtggcggaggacgacggtcggagggtgaaggtcgtaggcgggcggcggcggaggacggcggaggcatgcgggggcgaaaaaatttggcagcctgacggggccaaaatttatagggttcccgccgagacttagaaattttggcaccgcgggcttgcccttatatagggaaatgatctcagtccgcctgcgaagatgtaaaccctactcggcataataattttacaggaattattacaagaatgaccctatctatttcagaattattttaaaatcatttttgtgatttgaaaatgtctacagtagtcgtaataaaaatggtaattgtacatacaaatagataaaccttagtattactacttttcaaatgtaaatattacttaaatgtttcaaacattaatattactactttaaaaaatcatatagtagcaattttatatgtgcacttaccattgttctaaaactttttaaaatataaaaaactgtaaatgttaccctacaaatggtaattgcacataaaaattagtacaaactaatatgcaaaatgttgagtgcaattgttcgtcaatttgcgatatgatcacacatcaccttacataccaccattacataactactaacttattagatgcttacatgcgactcaacaatcattaccctttaacattttttcccacaccgtccgtgcgcatgtaaggcttcacggtcttccgagtagatgtctcgacattcttaatcttctgtacaaactgactataaagtggcatactatcgtattgactgtaatcttcgacatcttcaaccccagacttcgtttgagggtaatctttaattccacaaaagatttttgggtttttggtcttccctaccattcacccctcctctggtaggtttgtttggtcttgtgcgatcccctccacacatttgaatttgacaatgaattcatatgtcatcgtgttatcgttccatgttggagtgaattttctttagtgcacaccctgtacatgatattctttggattgctaatactcttctttctggatcagcatctgtaggcagtactacgtgccacgatacttatatgttggagtattttgcaatcaacaattaatattatttcattttttgcattcctgtccaaactttcatgtatagttcctactacacttctaaggtaccaaattctgaaataaagctcattgtacttttatgatatgttcactgatcaaaactactattgcaagtctgatatgttcaactgtacttctgatgtaccaacacattagctttgtttattgattgaaatttatttttgttctattagtaccgctgtccaagtgtgcagatcaattcgtaatcgatcagcaggcctgggtgttgcttcaaggtataagtggacttgattgaaccatatctatttgtttgatccttatttgcatataaacagttgataggtactccctactatggtatgttgcggggtatattttaattaatttccttttgagatttattattttataagatggggattgttcaactgcaactgatttcgtagtctattgttcagacatttcatttaagcccatccatatagtttgtgaaatataacagttgggccattaagagtgtgtaaagaactcgctgagtcattctatcaaatgtagagcaagatcgatgacatgcgctcccagtattacctgacatactattatctggcttctttggtaaattcatctgaatcacatactagaatgttaaaacgacactgtatatagtgcatcattgtttgaatgagttatcatcaaaagcatcatgctgctagttataatcaatgtagaaaggcctgaatttattcttgtgatttatgctgcatttcacatgtgattagcatattagacaattatacacttttgtcctgaatggttaagtttgccatttgcaaaacgaagtatgcatttcagttagccagggtattattccagattaccattgggtttgttttttggctttgcggtgaataagtatagtgcatagttgtgtaattgtacctgctgatgcattagattagtacggacatttcacattcaaactggtatcaaaggagtttttagaaatcatggtttacatacatctggaatctttcccctcagtaatgaataatgaagtcactaagatataatgtacactgattggattatactgtacacaatgtggagttcaattttctttctattgcgcattttagccatacttctattgtattttagtatgtggattgggatgggtggttttagtctttaatatgcgcctttagtttgaacccaggcttggagaaatcctggttccgccactcatataagcaaatgtatatattgtgtgacacaaatttttttcagtttgaaacttattttactcaacctccatcctctctctctctctctctctctctctcacaagagaattgtcatcaaatgtattgattcttatgcatgctatctgaaaattaatgttatgttctcaggttctgaccattaaccagtggtacacattctcatgttttggaaagagcacacaaataaactacaatctcattgcacacaacacagtgtcctttattggttgtctccagttgcgtttacttggttcctagatctgccattcttttcttgcatccacaaccatggaaaattttcgtatactggatttgcaacctacctgctttatgctatatatagttaaattgtatatggcttgattaatttacgatattttaagtggctgagaattgggtgaatttcttctatattgtaagcaccttgtggtctagggtctcttatatatagtactactgatgcagaggcttccctgtgcattcaacgagttcaatgctcgcagatatatcttctggttgtgattgctgtctttatgcatctctattgttccttggccattgaaatgattttcgatacataggcatcatataatcatttgagtatactgttggagtaattagtaaagttggagctgaatttacatcagatgcatctgtactaagcaccaatgttcttgattttattttatgacttgtaattgcctacttttttgtgacctggagctcaaattagaaaatgatgttaggaaagcttgtgattcctttcggcccaatctgtagttatttcttttctgttaattctgaaaagttgaaaattgtttttcatattctaacaaaaaaatatgcatacatctatgattgctaagcacataatgccatgcatacttccatatgatatgctttagatggtagaaaaagttattgacttaactaaaaattgattctgaattttttttctttatattcctatgatatgctgacaatagctaatcttgactcatttgggcccttcatcctcttctcctccatcgtcatcaacagagctagacaattcaagtcagtttttttcacaaatttctttggctatatggattatatacaacctatgtgaacttattttgatgttagtagcatacacatttctatcaactgattcttctgataaatggaaatcaaaccgacagaaacaaattactaacttcttctgataaatggaaatcaaaccgacataaacaaattactaacttgaaaggattatctttagaaaaccttggaggaaaatgtactgtggtagagaaacatgacctaacctccattgcaaacgtcaatgctaggtagaaattgttgacggtcgttatagaccaatttcgaccgtcaatataactaaaataacggagaactagctatgcttacaatgcatatttgttttagaataatctattttcacttgtacttggattctatttgcttgtagagattgatacataatacgaaggagaatcgacaacaaaacaatcgaacaatcaatcagccactgttgggaactcagaaatgacatgatcaaataagcccaaaattcactgttctagattaaggagcaaacgaggagtcatcctgccaaaaatgggccaggttggcccagcccatggttcggccgaacccactgcagcgccatttgatccagggttttgattggatggctcagatggacttctaatgacggttggagggtgttaccgacctttccaaccgtcataaccgtcattaatcagctataaaaggagctccccttgttaattctcccacacactcaagcaagctcaacatttctctctatactttagtttagtattctagtgctaagtggagtacaatagcatagctctcggagtcctcggagtcttcgggggaattcgagtatggctctagtagtttttctttattctttcgtaagagtttcagaattaatgaaatattattctttatatactctccgtactttagtttatctgagtatcagctttactttatatttgtattggtatagttgtgtagttagcctaccagagaggtgcaatggtgtgggtttagtctccgattactcggctgctctatgtcatctcggaggatatagagtagtatttaataatgtagatgtggtgtttagattattaagtatcattatctgggcatatatgctacgggtcagtcgaggtgggccgctaatggtgacagctcggtatgggtattcctcgacgctagtatgtgtttctaagaaactttcctgggaaggatactcctccgtatttggccccggttagaggccatgacacgttgtcgtaagaaactcggcaacccggggtggtctctcgaaacaccaggagggcacttttaggggctattggctactgttggcggctgttaaatgctgattctgtaccgccaacatctgcataaagttcagataataaaacatttaacatagcgataggtgcttaatctcacatattccacagggttggtgtatatttatatgcagataataaaccatgatgttgggaggaaatatagactaaagtgaggataaatatgtatccatacaaggatgggttgtgaacttcatagaaacactagagaatcagcccataacaccgaagaatggatagaggaggaccataagaggagccaggccaaaggccaggccagggggggccaacccaggttcgtggttcggccgaaccctggtgagcgccgttggatctaggtttttggcatggacgctccatatttctccctgatggcggttgcgggacagttcgaacatttctccttcgccaaccgtcatacctacctctacataaagacttcacttcactcacttcaacacacacttccaagtttgagctgaattataagaggctctattgtaatatattgtatactagaaaggaagagagtaaagtagaagaagtcggaagaattccagagttgttggtaatcttctcctatttcttttattctgtttattactctgaattcaatataatattcttcctgaataatttagatttatcctgtgagaattatttcttggttagttcgtaagttgcatacgggattattgttcactataatcaactaaaatatagtgatcgctttggtgagttataaacactaaagtagatattaattgcttagacgtggtgttttggtaattattatccagtaattgctgcgtatcccacagtatgtttgaggtaggtgtagaggtggtgacagccttcgagatcacttaagtcctgcctgtctgggtacgtagtagagcgacatctagaaacagcgggttgctagtgcctgaagtattgaattaggattaaagttaagctttccctgacactgtttctcactagaaaatcctctctatcctggcctatcatttgcttggtgtccttaaataaaccggaggaagatctgaccacacacgttcccttgaattcgatacccttgtaatactctgtaggggaagtgctacagcggtatatccgtgcgcttgcgaattttatctgtaatcgtaagaagtaccaacagctacatagttgtatactagcagatgtaaactaaaattgactttatactagaagtataggaattgattgcttttctatttcttcttccacatagtgtaggattgattaatgagagatatgagttctttgcttcgtgtcactctactcttataaatatattaacccctacttagaccctaatcatataagtggtgtgcatacattattagcatagttctctcttacagtcttcccctgggattaaataaatacgataacttggaatactcccaggtgaaatgctacaatggtatatccgtgcgcttgcggattcttgtaaccatatatataccaggaccatttctagtgccattgttgggatgcatgcctggtatgatatgatttggtaagattgtgatatcgtaatcctgcacacgcatgagatcaatgcattgactctgcaccctaaacactgaccagtttaaaaatccattctatccaattaagcatttatggtaaaaatagaatggatgcgaaaattataactagccaatataggatcggttcaatatatatatttggagaaaagtaaagcattacattatctagtaattaacaggaacccaaaatagtagaccaattattttctacttaattggatgagtttacctatcatagatgaactcaaatgatggggattcaatggaataataaatcacaattaattcatagatgaaatgcttgctatctgttgcctgtagcctccgtgtatatattggcttagcctagatgaaatgcttgctatcttatatgaattgataaacaggatcaatggaagagaagagcattcggaacattgttccaatacagtccatgaacacgacaagtgaagcgccggctattttcccttatccgttacaagagagtgtgattcatgcacttgctgcaagggaagcaactgctttgcatcgtcatgctgctacgagtcaatatgtaaccagatgcaaccaccaaaccattgcataaatcggcggatctcgtattgcggttgtggttctagtagtatctaatcatcttatttctgcaataataaatggatggctgtcgaggagtaatcctctctagcgggagaacgtgagacccccctttgtgagttcggccaggggataaggtgcgatgatcaagagcctatctccgccggggatctagctaacgaggtggttcgcaagcgagtaagagacaagggattatacaggttcgggccgctaggaagcgtaacaccctactcctatgtgtggaattaagcttgtgctgttacaagggaaatccaaccctagactcaagcttctcaagtgttgtcccttttctcggtgggtaaggtcctccttttatagttcaaggggataccacatgcaccgtctgtatatatttcatcattggagggggggggggcacacaacctggctcaagccaccgtccatgccttcaaccggaagcaaggcggtcgttcgcccccaggtgggtcccagcggggacatccctgtcattccctcttaatttcatggagacttttgtggattcatctcttaatttcatggagacttttgtggattcatgcacagggggcacgcttggctgcatgccgatgggacggggcatacctgcccccactccgcctaacacagggcgggacgtgggtgcgctgccacctgtcccatccgcctgcgactggtcataggccggtcaaggccgattgatgcacgtcaatcgggcggcgccacacgcctacccacgccgcataaaacgcggcgagggacggttggggcgccgctcattaaagcgcttggcagcaccccttcctccgcctactcggccgccatgtggcagccgagtgagggcctcggggcggcgcactccaagggcccgaggggtgcgacggggcaccccgaggccccttggccacttgacgactgcccgacctcccccgagggggagggaagcaggctgcgcgaccacgtggccagatgaaaggattctttccctctattgtgcgtacccccgagcccatatcaccgatagtagcccccggcactacgtctgaccgtgacccctccagggctgtgtggttcgatgcctcataacttctgtcttgtgatggtgggtcccgtgaggagttcaaatagccgtcatcggtatacttagttcaagcgcccaccatgatgatgactcgactgctaataactgcgccacgcatgggggcgcgtagggcgggaagaccggggggtctgccaggtcgtgcctagaataattatctgccgtcgcgttgactacctgactatcaggtgtgcgaggaaacgagactatcggtgggcccgcccagccacaaccgtaatcatagcgcgccccgcgtcgattatgccgctgacaggcgcattaaacgcggggtgtggatttagtggggcgagtgggatgagcgggcgcgaaaaatgaggaggcagctgtggttatgggaaacgaggaggcgggcgctagcgaggcgagaataaaaatgaaggaaggaagagagctcgtatccttcctttcgccattatcactctcgcacacacgctcctctgcccccagcgttccacccttgaccaccgcgcttcactcgcccaacttctcgctcatcctcgccgattgccatggcccaagacaccggcaacgccgttctcctggcttcgcgcatcacggcgcagaaacatttgaacctcatccgcaggttcatgccgaagggcgccgtcgtgagggtgggggagtcatggcgctagactcggaagcccggacaccccgtgaccgccattctcttctttttccttgctttcttttttgtgcttttgtaatggacgcggttgactgcaggctttcgtgccgcccctgttggatgtacataagtcttcctcttcgcatttccgcactctttttatccgtgaatgcctgcgacaagggaggatagggaaaaacgcgcagtcaatttccttgcgggtgaatcgctgttttcgttccttcgctcccccccctcgggctcgttcggatatgggaagagggttcgcgcttaacccccggcaccaaagtggcgaggggcagagccgtcaccttgggagaaccgctcagtggggctggccagaccggagctaggtgaccgggggtcggggatgaccgtgtgtaggtccgtccgagcccccagggttcaccgcagttcggggcgcggcccacgtccgggcttccctttggcacttttcaggttgcccgacaccacctaggggccacggtaaggacgaaccacccctaagccggaacgagacttgaggaagggaacgaaaaagtacacaacaactttgattaaacaaaaggatttcttgctggggagaaatggtaagatacaaatattgacaaaggcagcccccggccaagcccgcatggcccgaggggcgtgcggggttggcctgataccaaaaacggaaaaacaatcaacatcacgggtagaagcggcgaaggtgctcgatgttccaagggttaagcagctctgtgccgtcttccgtggccaatcgaaccaagcccggccggtggacaccgatcactttgtacggtcgttcccacattggtgaaagcttgctcaatcctaagcgcgactggacgcggcgtaggatgaggtcatgggacctatagtgaccgggcccggacgtggcgctgatgatagcgccataggctctgttggtagcgcgccgcccgaacggccgcacgccttcttcgctcttcgaaatagtcgaggtcattgcggcagagctcgtcctggtccgcctcattgtacagcgcaacgcgaggcgagcccagggagagctctgacggtaggaccgcctcggtgccgtataccatgaagaaaggggtttctccagttgcacagctcggggtcgtccgattggcccacagcaccgtgtgcagttcccctacctggcgcgctagctgtcgaggagtaatcctctctagcgggagggcgtgagaccccccctttgtgagttcggccgtaggataaggtgcgatgatcaagagcgtatctccaccggggatctagctaacgaggtgagcgtatctcactagtggagataggcacatctatgacaatctacttttgtcacggaagacgcgcaaatcgtcataaagtaacttctatgacgaatttatgacgaaatgggattcgtcatagaagtcgcgtcacatatgtttttctatgactaaacagtagatttcgtcatagaaatgcttatatccatgacgaaggtgctcgtcatagaactgctttccagctggctaggacagacgtcgtccatgccacgtggctatcacacgtggagtccatgttggctgtgatgtggcggatgacgtgtacgccacgctggatcatcatctcccgtacgctagagccaagtggcagtcgtatttaacgccacgtgttggcatttggtatgtccacgtggtggtgcaagctgatgccacgtggtcgaacgtggtggcgccacgtggcagccatattaatgccacgtgttggcatttcttatgtccacgtggtggagcgcgctgatgccacgtggccaaaggtggagacaccacgtggcagtcatatttaacgccacattgccgaaggtggaggcaccacgtgctctcattttgaagcgccacgtgtacatatctgatttgtgacacacgtctttacctgatgttgccacgtgttgatttgtttggatgacacgttagcacagtagggatgacggcccgctcattttttttttcttagcccagcccatttggccacatacttcacatattgttgtggcccatcccactatgagatctaggaaatttttagcattcacccatttcaagcaacaattaatcagaacttcgcagcacataagaaaataggcccaacatcaagattgatcacatggacaaacaatcagaacttcacagcacattacaaataggcccaacatcaacatatatcacatataccaacttcacatagcaccatattacaaaaaagttcacagaacctagcacacatatgttcacattaagtccacaaaagtttgccataggatgacattaagtccaccatagcaccaaacatcatttcacataatcaagtccaccacatgacaataagttcacagaaccatcaaacaactaatataagtagatggagttcatcacagtgcagaagatcataaaggagactaggacagatttaagttaccctgggaaaggctcaagatacatcgaaggagcaaattgttctcttcctgctgctgcttgaactctgccaactccttttgagtctttgccagtgcttcatttgcaagatttgcttgttcttttagtgcgacaacttctgcatggagaatggctgaactttgcttttcagctgcaagttcttcctgaagtgctgcttctgtcggtgtcactgatttcttggagctcatctgcagaccagcatttttcaaaaacgtggtattggagttgtcccgagagagaaccttggacacaacttctgcactagttcttggtgtctcaccatcaggtacaggttcttccataatagctttcatacttgactgcagcaatgattgaacattagctatgaaattagatacatgaaaaactggcagctgcataacacattcaaaatactggcagctgcacaacacattcaaaaagtcactgaaaactgatggaaagctaccaggaagcacaaactagaggtaaggaaacttgtatagaatgcaaatttaaccaaatttgttttccataagccaaaacagaaacaaattatatgagtaagccaagcattcccatatttagaaatattgcattgccctcttaactgtgaaagagaccagaaacattttgagctctaactatggtagaatgtaattattttctatctagcctctagcaacaatgcaggccaaatgtttcttgacagaatctaggatactgttttagcatatatcagaaggctgactttagactatatttgattagctttcatggcagcttttgattgatggaacaccctggtagctataaaagaacaaggttttcccctcaactactttcataaaatttggagggggtgcaatgttacttagcgttggttattttctattcctcctatgatgcctaaatattttccctagaaaccactaatgtttagaaagaaaatactagtgtggagtacataatccctcataattaagtttacttttccaagttacaatgaaataagttttgaagtagtaaaggctgaaatatattcagtcttatgttcatatgattcaaaacctcaatacatgcaaacaccactacagcagcttaggtaaaaatgagttttcatgaatcacaccctcaaacccgggatattgataaaaatacaaactgcaaccaggatcaattgatgaaaaaatgtttatgtagcttatttggcattttaacccaatctcaacttatgttgtatatggtaagttgtctagcgacaagtttccagcagctacaaatttagtttggtatgtattctaacattgttagagtctataaattccattaagtctgtaatgatcttagctgcaaatatctctgcacactaaggacagaaattatcctatggatgtaaatataaaatgagctgaattaataatatgttggcataggtaacaaggaattgagttcaatgttgtaagaatatattgagtgacttacaattgcatctttggcagcatcacttagacctttttccctactggtatggcagtcctcaaaggcatccacagcatcaagctctacaaccttgttattctccttctatttcagtacagaaaatgcagatcaattattttatatatctattacattagataagtggttcttaactacaattaatgctaaaagataatgggaacttacgtaagcgtgcaagtgtgcagcatagctgcgagatcccgtagcctgatggaacctaacattaagccggttttgcttgttctgttcagagatttgctacaaaagatgtatgtgttagacatagtcgcaggtataaaatgaaacaaatatgtcattagagatgacataccatattctttggatttgaccactttgcaacaagttccagccactgttcatcagtcatgctacttatgggagaggtagttctaatctcgttagcaggtactccattgaagtaggccttcttcaaattataccgtgtttgtcgtatccctttctgcaatacatcagcacaagcatcccttgttggctggtgtttttggttaatggccaacctgacctgatggtttgaattgcaatcattaaggagtaacactaggtcatataatagatgaaatataaaagaatatagataggctcttacagataacttgcccatgaagttgttaatatagccttcatcatccttgtactgcttccaatgagggaagacaggaactttagtcctaatgataacaccagcctctgatgcaaacttggcagcttgcaccggttcatctggccttttcttcccttcggcaacagcaatgggcattcttcccatagctttggtcatcttgtcaagcattattcctgcagttggtggccttgattttcttgtgcctcttcgtataggtactacagagtattcaattacaatgttagcattcatcaaatagttaaaaataataaatttctcttcgttgaactaacttgccttcaacatcagaattggtttgctgtgcaggttgctcttcatggttggcatcatgtccatatgaccagtccatcaccgggctcgggggcctgttcacatcattatcttgaagcaaatgtccactgcccacatcttcatcaccattgttttctgtttctggaggcagttcttcatggccattacctttaccttgttctgctatgagttgccttttcgctgaccttgttgagactccaggaggcatttcggttggagcacccgccctcactctctttgatatccttactcctggtggcatcttgagggtaggtttcttcttcgtcgcacacttctttcgtctagtttgtcgagggtactacaataataaacacaaaagttgtaagcatgtgaataaattggcaacaatcattaaaaaaataatcaaatgctgcacaaattaaatgcggaaaaattattgcagatatcctagccccccccccacagccaagatagaagaagcacctcaatcattatggggacgggctgctccgcttctaaatatgaatcatcatcacactgaaccccttgttcatcatcttcagggagaaactctgatgtgtcagaaccttctccatgacttttcttggtgcctgagttttttgtctttgaagatgcatgttgtgtttcgatatgtttaatagtggcagctatgtctttgatgccaagttcatccatccttcttatattctgcaagattttctcttgccgcgttctttcatattcgttttgtgcaggttcttacatgaatacacatattttaatggtcagaatactagatggcattttgatggcatttcctaagcatataagcattttcagaaacagaaacaataaagtatctaggcatttgggatgaaaaaaaaagagaccatgctcatcaacattggggatttaatgatcaatggtgaaaaacaactttacttcaatatctagtaaaaacaacagggtgattcacttttccattttaaaagacaattttgatgagaactctggaaacacttttacagtgaacaacattggtcatataaatgatatagccattatatcattctctttcacctaataaactgtatctatttatacgacctcaatcggattgcacacagaaaattcttaatagaagttggacggcaaatcaatccacatgatgtataacatctaatagcttgagacagtacacataaacatctgagcttgagacgacaagataattttgcgtacctcgtgctactggacgtcgacgtcttcccatcggctaggtacggcgacggtgcagggaccttgtcgatggggtacccggctccggtgcggcagtaggcgtcgacggtgttgtgggagatggcttcggtgcggcagtagtcgtcgacggggtaccggctccgatgcagcggaagtcgtcgacggcgtagtgggggaaggatctggtgcagcggtcgtcgtcgacggggttgcagcggaaggcgtcgttgcggcggctgtcgacgacgaggaagtaggggacggatctggtgcagcggtcgtcgttgatcggtttgcacgggaaggctccggcgcagcggtcgtcgttgatggggttgcagggtaaggctccggtgcggcggtagtcggcggcggctctggtagagcggcgccccgatggtgtggcggctggatttggggattagggtttggtgggtgagaggctttgtaaatatatagtggttgcacaaatgcccctgggtgttgttttgctcttcgttagatggaggataaaagtgacatttcccattctgatttgggcaaatgggcggcaatggaatcttttggggctgtcattggcggtaggtttaggcgccgaacgaaaaatcctccatccatgagtaattaacattatccataaatcgaaaacattcaaattatactaatctatctggattaacaatttgactttaaaaatatactccctccgttcaatattatataacttgaaaatttggattaagggggtgtttagttccagggtgtaaagtttttaaagtatacggacacacatttaaagtattaaacgtaaactaataacaaaactaattatagattatgcccgtaaactacgacacaaatttattaagcctaatccattagcaaatgtttactgcagcaccacatagtcaaatcatggcgcaattaggctcaaaatattggtctcacaatttacacgcaaactgtgtaattggttattttgtctacatttagcactcaatgcatgtatgtaaacattcgatgtgacatttttggaaaaaaaaatgtgggaactaaacaccccctaatattatttttttaaagcaactttcctataaaaactttttggaaaacacagacaatttagcagtttaagaagcattcaccgattaatcggaatacggttgtcagacggaatacggttttccacaacactgctttaagcatgactgaatttatttttagaaactagcacctataatatattataggcgtctttttttaattaattggcacctatgacaaattaaaggtgttggtttttttttaaaaaaaaagaaaaccaacacctatagtattggtgtcagctcttctatgtcgcgttttccatctactccctatccacgtcgcgaaatttgccgacgctttccctttcccgtgcgtgggagccgccgccgctgcactcgatggatatgatcagtgatagggaagggtgctactaaccgggactcgtctctgctgtggacgtctaccacaggggcgcggtcgtcgtctcccatgtcatcgagacctccatgtcatcctcgtggttgctcacctcgccattcaccatcgacaccgtggaatgcaagaacctggttccagcctcggtggcgttgccagtggatctaaagccaagctggaggatgatcggcgacggaggatttgagccaggcaggtgataaaatcgtctcagtttaccattcatggatactccctccgtcccataaaaaaatcaacttctggctatgaacctggacacatgttgcgtccagatttatagtcagaagttggttttttatgggacggagggagtatataggtccaattgaaaattgaattttaaaaattttatgttcactttaaactgggtgaaccggtcagtgtttgtaggaaaaatgttggaccggccggttttaatagaatggaccgggtggtttggaccgacttacccctcattcttatcggtagaactgacatataacgagggtacaatcgtaaatcaacacacatataacaacggattcagatccaaaccaaaccaaatcgtaacaaaaaaaaaagagcttcctcctccatggcggtgagaattagcaggaagcgcaggagcccgccgacgcgtgggctggggacctccacgacggcgtgctggagcgcgtcctggcacgcctcccgccggacacattcttccgcctccacgccatctgctgccgatggagcgcggccgccgcgtcaccacacctgcggccgcatcccgtctccgactccgaccgcatcgccacagtagtagctggtccaggtgccgcatctccaaggccgatgctcccagcgctgctggtgaagaggacctggtgctggccatgatcgagtagcaagcttctggtgcttatgctgcttgcttcctggatgtgggcgacaacagtagcttgagaagaaatgatacttctttgtacagcttggtgaattcagattgagatcgtgaatgtgaataaacttatggctgattattgtgttattttgaaaatgtgatgtcgcgtcccaaaatgactctaaaatacatcctcgaaattatgcctagaataattaaaatccttttgaaagcctcccacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaatcctaaaaagtcttttccccccctccccctcttgggccggctcggcccatctccttccctctctctcctcctccccgcggcccattcggcctcctccccgcgcgcgcgccgctgacgggcgggcccgcccgccaccctcgctgacgggtggggcccacccgtcatccccttcctcccgccgctcccgccgcctcgcccgtgccctagcgacgccgccgccgcaaatcccgccgctcccgtccgccccgcgtgcaatcaagaggggggaaatattccccgtgattccctccctctttccccccattttttccctccctctctccctcggattcgttcggaatctttccccctaaacctcgccggcgcatcaatggcggccggatcttccgcgcccgttcccccctcatccggccgacctctctcactcccaaccctatataaacactccccgtgcctccctccaccgtttccgccactcgccgctctctatctccgccggaatcaagctcgcgcc

SEQ ID NO: 60552 - DNA, 1128 bp, Oryza sativa
ctcctgacttgggaagccaagcacacgtcgtcttgatgatggggcctgtcaaatcttgccgcctgacacggggggtgcccctgtcagtcaccatttaatgggtgaagacttctgagctcctattacaccgggaaacgggagccttgctttgaccagagcgggaggaccgactccggttgggataagaggatgagaacctctcaccatcattatttgatgggatatgtcgggctgcacgtcgcctgacacacgcgatggtgcgcctgacatcttgggtcccatcagtcattcgaccggtcacagaccggttgagtgcactgcacaccgcattaaatgcggtgtggcgcgaccgctcaggacgccataaatgcgggtaggtgggcacctggaggcggacacctaacccactgtacgtggtgacctagagagggggtcgggggagcccgaaccctagtcacgggagggggcggtcgccgcccgaactcgggcccgatcccccctctggggggagccacgtggcacctggggcggccttctcccctagtctcggccagggagtggccgccgccctacctcgggcccgacccccctcgggggaggaccacgtggcattggagggcagcctcctccatccagtctctgggaaggagtgcccgccaccctacctcgggcctgactcccctcgggggagggccacgtggcatcgggggggcagcctcctccgactagtctttggggaaggagtggccacgtggaatcggggggcagcctcctccgactagtctttgaggaaggagtggccgccaccccaccttgggcctgactcccctcgggggagggccacgtggtatcggggggcggcctcctccctctaaacctgatacccccgggcccatatcatcgacaggtaacatgcaacaattagctaaatgtatatttttgttgctatgatttgtaggacaaatcacaatgagttgaaattagttgttagagttgggtcgtttttcagcttgctagatgaagggtcaaagacctatatggagggtaaaacatcgccaacccaacttgttgacatgcataactatggcttgctagaattagtaaatttcatagctgaacacttcatat

SEQ ID NO: 60553 - DNA, 777 bp, Oryza sativa
ggcaaaaccccataccaacattcttattgccaactacaaaaggattgtagtctttgcagcgatcactagacaaattggaccattcctggtacagctgatggtctctgttctagtagatcatgcggtaacctgtacacgggttgaacagatagtctttcatctcaatgctcaccagattcaacccatggcaaggcttggagcaaaccacctttttgtccagaaacattgtgcctagatttgcctcttggagccatttactcaagggaataaagttgaaaactgatttttcagagcccttacccacaagcatgatctttggcctcctgtccatgttcttatgctcaaagtatgcatgaacaaaaccttcattctttatcaatccacgccattgcttacaaacaagttccaatttcaagattgattcagctggtaatcggagtaggatctccttagtagccttagacaagggagtagagaaccctatctctttcctcgtcctatgcactggggtaaaactctttgtaaatgaactgaatctaatatcagatttctcgttttgataggcactgcaggtcaccatgattgagacaatggtttcaagagttctagaaactggatcataggcacacaccttgtgcttagatgtagcgatgattatcttcttgcttgatctgtagctaccaaaggaaccaataactttcacaattcgtggctcaagtaaatctcttggcaaattccctgtcaaaccaattcggtaatcaagcgaccaatcaccag

SEQ ID NO: 60554 - DNA, 9789 bp, Oryza sativa
tagcagcaacacgaaacttgcagacatgcagcatttgtggagcaaatgggcacagcgcccagatctgccatgtgggtgcagatatggatatgcaggaaacatcagccggtggaagctccatgggtaactacaactccatcgctggcaacggcagctcggagtgttacaaatgtaaacagcccgggcactatgctagagactgtccagggcagtccactggtggcttggagtgtttcaaatgtaaacagcctgggcacttttctagagactgtccagtgcagtctactggtggctcggagtgtttcaaatgtaaacagcctgggcacttcgctagagattgtccagggcagtctactggcgcccagcaccagacatatgggaataatgttgcagcatcaaggggttacaataggcaatcctttgttggtggctactgaagtattttgcaagggaagaagcagcagcagcagcagcatcttgattttgttcatcttggatggcatcggtgtatcgtgtatagttgttaaacctgccttatgtttatgcctttattacctccaatgtccactgggcagggaaccttgtgatctggactttgtatcgctaccttaaaaagtatattgtccttgtctgcaatcttgtaaatttcaatgcctgcttactgcttgatcggcaactatttatagttcgcctaaagtgctcgctctgtaataatatttgggctttgctagtgtgctttcccccccttttggctgggaatctagataatcagataatggcaattgatctgcttggttcatgcatttcccaagtactggattgtatcatatgggactgaaaattttcatgacctggagatattttcattataaattttagaggaaaaaaaaacatagccttgtgtaacagcaaggttttcttctgtagtactacctctttccaaatgtttattttgagctaaccaacgcaagtgcttttgcggtcagtggcattgcattgtcaaatgtggaagtcatgtttatcctctctgcagagtgttgcttgtctgatgattctataattttgttttagcgcctggaccttctatatctggcactggcatgatttacgggtatggctgcataatctggagagagatttgcattataaagatgagaggaagaaatgcgtacacttgtgttacagcatggtttgtgtttttacggccagttgcattgcattgtcaaatgttagtagtagtatgatgcttttatatgtttttctttggcaatctaatttcgcctatgccttggttccgggttctgagttctgacaagtgacaattctcgaactcattaagcacaagcctatttcacccttacaacaattcggaagaatatagatgggttttaaacatttgataatatttgctccccactcagatttggttactcgaaattgtacaagacctgacattcgtcatctggacactctagtagataaacgtgctggctgatgctagataaacagatgtaaagatgaccacttcaccatcaaccgtaaaaccggacgaagatcaccaaaaattgatactttggagcaacgataggcagcttcgattcagatagcacaatacttaaaagaccacatactagcatcgaattgatacatctcccctccaaatgaggctccaaaaactatccattgtttgatacagcaagcaataggatgtgagaaactgagattggcatttgtatttcactactctcatctgatgagacatgactaggctgtaactgaagctgaatctaaagaggaagattagtgtgggattgcagacaaaactgctactacttccttcctgcactgcaagaagaagaaatctgtatccagtctgtgttgaaccccattaaagcacacacagcagcttcgattcagacagcaaaagaaacattctgatagatagcatcaaattgatactagtatttcgtttgtgtcaaaaaaactctcgatatgtcgtaatcaaagctcgaaaatcccatttgtttgatacagcagcaacagcaagaaaggaacccctactccgatccagccactgaaacagtactaatgaatccggattcgcgcattcatcctatctgatgtgatgaaaagaagctagagtataagaatctaatctgggagaaggttgaggtcagtcgtcgaaggcggatgaggggtcggcgaggtgggcgaagcgggcggcggaggcggaggagaggaggaggaacttgcggacgcaggacctgacgcagtcctcctccttcttgccgagggttcgccggtagaaggtggtgacgcagtcggagaagcaccggtgcgacacccagttgtacagccgtatcctgcgtgcacaaaaatccatccatcgctactccactctctctgcgaggaggaagggaaggaaagtaagagattaaacgtacgcgtctcgggtctggagcttgtcggcgacggcctccatgcgcgccttgtcctcctcctcctccccgccgccggcggccatggcggcggcggcgtccatgctcttcttcagtagcagcacaagaagaagaagaagaaggagaaggagaaggagaagcgtagcccaagccctaaggccctttagtatagttgaagtggtgagatgggccgtggtgggccttcggtaattgagcccatgggctcaaccccgaaaatgccagtgggctaggtgaggtaaaccgtgcacgtgacgctttcagtttcttttcttttctttccttattatatcatcaaaaaaagaaaagaaaaagagaaaaaaaggtatggaagatactgtatagtatacgctagcagcataagctccgtccgtataattatttcttgtacgcatatgatgtacagtatgtattttacgagctgtatactaccattgcgttggatttatgctggagctatttgcctatgtagtggagtattctagaaggatgcttgtgcgccgtccattgcctgcagaaacggacggcgcgggtgggtgggccccacagggcggtgactgacgcgtgggccaccacattgggatttggctttgctttgctttcgtgccttgtcagccgctgcccccggccccttcttctccttcttcttcttcttcttcttcttctccctcaccatcaccaacaagagagaggaggagtggattcatcgatcgagaagtcgaggtagtacatacgttggattggattggaggaggagaatgcctcgcggtgggttctcggggtcgataagctcgcccaggatcgacgtcgccatcgacatggggaaccccttcctcaaccgcaccgtcgacggcttcctcaagatcggcgccgtaagtaaccatcttaatctatcccattccccctctctcctcttaatcacaaactcctaatcctcctaaatgcatttcttgttttgttttgcaggtcggggcgtgcaaggtcgccgccgaggacacattcgactgcctccacagaggtgagatatcgtcagtctttctaccctttcacctcctctcctttcttccccaactccgccctatcttgcacagttgcattatacttcactatacaaagtttctttctttttttttcacctttggggctagggctgcctgagcctcacaccaccaaaataaattaaattgcacgcatcccaaagtggagtactctggtggagtggagattgggaaattgaaagtggcttccaatctttgggtcaaaggattatataatcgaatgaaggcaacacatctatggccaacaagtcatggcttgtcgatttatcctcaccaccagagtacaatctgtatccattcattcacttcactgtcggctgaaaggcatattccttttttttttttcttttttgggttgatggagcttggctcacttgatattgacaaatcaaattcagtttgtcgataacaaacaatttaataattctattttatccaaggctcacttgatggagcaaggcttttcttatgtatcggcatggtacctgcctggcactatatagtatatactgcaaaaatatagcactagcatgatgaatacatgacaataaaatgggagtatttccatatatacaataaaatgtgaccgtgtcctgtttctatatacatgtacacagtgtaacataaattcattctgtttcctttccaggggatgtttcaaagcacaagcttgagcatatggtcagtatttccatggacttccttatctataaaattttcatggagtctgttcaacatggttttaagacctgaacccatgttttcaattgatgagtattttatacatgcagcacacacatctttgcacctatctgaaagtgaatccagtacaaatccaaaattagtgcaccacaatttcctgaatattttgaataaattgatatagggatgcccttgaattaccccacaaaatggataaaaggcgctatgcaaatcaggatttctatcttagtatcaatccaacatgttgacatgttttcatcttaagaaattcgatatgcaaaaccatcaccctgcacctccatagcgtagttgcactgtaactgtggaattcttcttaaaatgtagttgtttctttagtattaaggttccatctatggttcactaatatcctatgatgaatgcttttgcagctgaagaaaatgtgcaaggagggtgcctattggggtacatttttgttgacttgcaaatggatgaatgaattggcatatatgcatttattcattttttttcttatgtcacctttttgccgggtcgttttcttatgttacctgagaaaccatttttctctgacaatatgcaggtactgttgctggggtgtatgtgggcatggagtacggagtggagaggattcgtggtcgccatgactgggtactccctccatttctttttattttttaccattggttattttttaaactctaatgaattctgaaaactatgcaacattatcatagtatgttgtgtcataatataactatacaactttcactcaccataactaattgatgtaaaagttattaatggtcaaagtttgaatagtaccagccaacataacaagtattttgaaatgaaggtagtatagtaaatatctataatggatctctctcattttctgtatttgattgaatctttagttatgttgaagggaaaaataaatatgccttaccttgaaaaatattgtcaacccacttcaaatttgaccggtcctgtcacatataagtactactattattttttgacattgacaatgcctaggctaaatatcacttcgaccaccaatttatatattaatatataccaaaagctcataagttgtagtaataatctattcttttagatgaatccagccacatcattttcatgtgccaaatattcgtaaaggtactgctaaacgaagttgcaatagcttaactgcataaatgaaactcttactggaggagaaagccttattaagtttctttttgggggagaatagtactaaacttggaggagtaagccttaaactgattttccatggatagtttgttttagtcaatatttagatttatgaactccagtgtttattactctgtactgtataatttatgcttggtgctattatttgatcttgattcattattttccgtttcctcctgggatttttgcagaagaatgctatgattggaggtgctttaagtggtgctctgatctctgctgccagcaacaaccacaaagacaagatcatcaaggacgccatcaccggaggcgctgttgcaacagctgtcgagttcatcaactacctcacttagtcatgtaactgcgtttttgcagtggcttttgttggacagcaagaataagagcttcttcactgaagccatgttcagtttaataaaatgttaccttgttcatccctgcttcgttccctgcacttgtgatctcagtacttattctgagtaattattctcctgatattcgtggcttgcagtcgtcagtatgaccttgtgatgatttgttttaagttgagaaaagccatatttgcaagttgcagcaactgagattgaagcttgtatgcaataattacttgatgatattggcgactcatgacaggaaagttgtctaaatttccccccaagtggtgccctcactagaaagaagatggtaatgatcaggtgtcttggcttgttctggtgattggtggttgcataatctagataatcatatctctatttgtcccttatttgcaagattctttcaccatgaccttgatctgctagttgagcttggaagcttccagtttcagatgaaaatcacttgtttttttccaaggccattaatcccctttttttcagtttcagtttcagagtaataatcttatactagagagaaactgaaccgacaagagatattattcgtcctcgtcggtttactgcagtccagtactgttggaaataactttaccttttcacgtgatgctccagtgccaataattgatgtgctacagtagtcaaatgttttttttttccttgtagttccaatgatattctcatttttttccccttgtttcaggtaacaagaagaagtcgattgttcgtccgtgagctgtcgttttcgttatctttattcacgaatttgctgcaccgatcaaacctgatggtattttgattcgagaggtaaccggccaaatggcagcgatttgtgaacaggaagcaatatctccatcgattgatcggtcatgtccctcctcatataccgcacaagatactcccaattaagaaaagagatgctaatcaagtctctctgatgctaagaacacacagctaatcaatcaccattagattccagaccaacaacagtttgtcagctggttataactcgacacaaccatataatccctctgctaagaataacattttgttgcatcagaaatactgcaattagcaggatttgaacaaaccagcagacaacatgtttgtcagccgcgacgtttcgtcagtaaactgtactgttggacctgacctgactgcaggctattactctgaaattgttcttcactcaggccagcactatcattgccattgggaatcaactctgcacagttaatctgtttcttctccctccttaagagtagtagttttattgatccttttgcgaggagagaaaaaggtcactgctttcatgattaagctgattgtggagatgtctcttttttcaaccatggtggttagtgttatgcttcgttaaagagaaggctagtagtagttgtacgctgccgcccactgtcagctagagtccaacacggtcgaaaagatcatcgagccactgatgattatacttgctatttctttaaacttcagtatcttttctgatcaagagtaatttcagttagctttatcatgatcattattgtcgtaacgtttttagctctgcagctaaaagcatgctagtcggtttggttgaggctttttctttcttaatgaaaagccgtggggcggtaattccctagtgcgtcgagttcttgtttttatttcggccaacacttttatgccgtgcggaggattatcccctcgtttattcaaaaatcatctgtatagttatgaaaaaaaaatcgaaaacaaaatggacaacattcatacaacatacatatacaagtccacaaaattttactaaactcaactcacacatcaagaaataaaaagaaaaaaaaaatccaacgtatgaacaatgctggtgatattcacacttaaaatttgtctttctttcccctctcaatttgtaggtcaggtttgaatttatttttttagtagatgcttaccatactctagactattaaaaagatttagaattcttttaaaaccatttgtactgaatttaagagaaaaatgtatcacgagggaatatcctggagggattataattcatctccttattatttagcacttttttttatctacagagttgaaaggacatggcatcacaattactttcatctttcatgctcagcctcagacgtctaattggctagtatactagcttgttaggtgcaaagtcaagcaagagaatttcaactgtggcggtgtttaattctctttaaacttctaaaaattccgtcacatcaaatgtttaaatgtggacaaaaaaaaaataattgcacagtttgtatgtaaattgcgaaacgaatcttgtgagtctaattacgccatgatttgacaatgttgtgctacagtaaacatgtgctaatgatgtattaattagatttaatagattcatctcgcagtttatatgtggaatctatatattttgttattaatctatatttaatacttaatacttttgtccgtgtatgtaaaaaaattttgaccaaacaactgaacacggcctgtatatgtaaccaaagaaagatcaaaggagaggaggtagctactcctacaaagaaagaagaaacgatgagatttgattgcctactactccagctagctagtatacagtactcatacgtgtctatccatattcctgctcccaatgcaaaaatgcaatggcgagattgcaaggttgtgtgggtggtggaccctggatcgatcacctccattctttctccgcatctcgccacagtacgcttcgctgctctcccgcctatatataccacctcctcctcgatcatcagttcatcagcaaccaaagcaagaagcaattcttgagctcaatcagcaacaacatctatctccttcttgcttagttaagtccttcgccctcccaagaagaagaagatgtcttgctgcggcggcaactgcggctgcggcagcggctgccagtgcggcggcggctgcggcgggtaattaactaactaactaaccaactgctaattaattcactcaagaaaccattgtgacacgcacagatcgataactgatcaatattaacattaatatgcatggatgcagatgcaagatgttccctgatgtggaggccacagccaccaccaagaccttcgtcctcgctgctccatccaacaaggcgtaagtttcatcattaatgctaattaattgatctgtcattcctgtgtgtgttcatcattagtgttaattaattgattgatctgccattccgaaacaaaattgtgctggattacaggagctctggaggaatggagatggcggtggagagcggcgagaacggcggctgcggctgcaacacctgcaagtgtggcaccagctgcagcggctgctcctgctgctcctgcaactgaatctatcgtcgtcgtcgcccggctgcatgaggatttatcgtatggatgctgctactgtcgatcagagctttgatcgaggccttaatttgcttgcattagtacccagcttatatgtaggcaggccttgccttttgctctgacgcctaaataaaaccgtcgtcgtcgttgtcagtgtgtgcgtgtgtcgatcaatgttggatggatccctagctagcttggatggatcatctatcatcatggtgatctcatcatgtactcctgctccatctcctcatgcgtgccaggcttcttaatataatctacctctgctttcatcccatttctcttactgcttactgcccttgtttaatttccctttggttctaattaccacgaggaaattgttgttttttcactaatgaaaactctgcaaagttaaactgaccacaaactagttaacacagagactgcatcagctgaaagacctgaaaattcaggacggtaagtcggtaactcttataactaatgtccaaactgacaagaaaacggt

SEQ ID NO: 60555 - DNA, 7877 bp, Oryza sativa
cgatatactgaagtagagggagtaatcttacttcgttttcagttactttttttcttgtgacgtcgaccggagtatggaaactatatatatggacaacaaaaacgaaggttcagaaaattattatacctcccaggtgctgacagacaccacatttcttgcaagggtcgaactaaccatacaaagcaataatcgtgctagaaatgttctttccgatcgaccagacgagcaagcttagaattgatcatgcataactttattccgtatggaacaataatgttccaggcgtccacacaatacttcagctggttccgaacccaacatctaaattaaccgtgcagtaataagcagcagttaactggaaataatttattcgtgtaacatgtaacagcactgtactggtaacatgtagagtaccttggtgcttaatttattcgtgtgctggccgatttcacacgttaattgcgtggcatcgcgcggagcagcatggtttccacggtgagtccagggccgaaggccatgagcatcccccactcaaggccttcccccgccgtcgccatccctcgctcctccgacctccttcgcatctcctccatcgccaagaagatggtggtgctacgcgtgttgccgtactgcctcatcacctccctcgtcaccgccagcttcccctctccgaggcccagcctctcctccacgccgtccactaccgcccttccgccggcgtgcaacaaccagaacgcctcgtcgtagctggtgaccgtcgtgcctaccccgcggaacgcgctctcgaccacgccgccgatggcgttggagacgtggagcggcaggtcgcggtgcagggtgatcaccaccccttcctgctgcaccttcaccaccacagcgtcgtccgtgccgggtatcacgtcctgcgacgcccggaccagctggaacacggggcgctcgccggtggacgacgggtggcggcagcaacccaccacggcggcgccagcggcgtcgccgaacactgcctgggcaacgaggttgccaacgtgggactcagagggcccacggatgatcagcgacatcacctcggatgtcaccacgagcaccctggcgtcccggttgctctcggcgatgtccttggccacgcgcagcgccgtggtgccgccgaagcagccggactggtagagcatgacgcgcttggtcgacagcgggaggccgaggagcttgatgagcgtgacgtcagcgctgggcaggcaaccggtgctggtggtggcgaacacgacgtgcgtgatgctcgacgccggcttcccccagttaccgatggcgttgcacgccgcctctgcgccgagccgaggtatgccctcctcagcaacctgctgccgtacgttgagcgaggtggacatgtacgccgtcaccgacgggttggccctcagccactcgtcggagatgtacatgtgccgcttctccgtcgttgtcttcttgcctacattgcaatgcaatcacattattactatataattacttgggcaccatgaaaatctagcttatctctctcatatatatgtgtgtgtgtgtgtgtttgatgattttatggcagttaagtttatggatcgatcgtgacagatacagaatggtagtttcgcatgcacttacagatgtttgcaaacttggcttttagatcgaccaagtgattgctattggtaatctcaaagtaataatcagggaatgacttctgctcatacacatgcaccggcacagccgtgccgattcccaagattgttggcttgttgctctcccgccggcacgaggattgttgctcaattcatgtgtcaactccggtgcccccgaggatcccatcaggcagtattggagtggacggcaactactctaagaggaaatgatgtagctatagctttgagatctctggctaccaaagctcggtcttatataggcattctttgatgatgacgggctactgtatatcttttttacaactagctaggacctcgatgctacaagaaaccatctataattaaatcgttttgattaagacgctttagagcaagtttaatactatagctaactactaactctaaattatctatatttaatttaatagccaatttatccaatagttacctataacatatagtacacaattaatacctagtcccacgtgtcatacatatatttatcttagagcacatgttgcacagctggctgtaacccactacttttctctctcatcatttatcttctcaaaatatgtttatagctggcttatagtctgctattgtacctgctgttatatattccccctccatctaaaaaatttgttagaaatattatttcagtcgctaaaacaaaaaaaaataaattaattaacttactatgtggccatattcttttctgattaattaagatttagattttatctcgactttcgttagcacgttttttaaattattaaacggtgtgttatgtgcgaagactttttatatagaagttgttttaaaagaattaaatatatcaatttgtcaagtttgtaatagttaaaacttaattaatcgtgggctaattgctttctattttgcctatactaattgcatacgcgtcaatcaaccgatccgacacaaaatataaaatcttaacaaaaacgaaaacaacccgataaagaaataaagtaaagactatctccgataagtaaagactagtatctccgataagtaaagactaactccaataccacgcgcgccgctgcatgcgcccaccatatatacaggtctcagctcttccatgcaactagcaaactagtaccaaatccattgtctaatcacatcctgcacatggctcagagagtatctccaccaagcaagagctcgagtaccaaaactctgcacagcaagcttctttatcacagctacaaccacatcgagactgcatatgcatcatctttctttttaacgacccgtacgaaactgtgcgaagttatattgatagagcagaaaaaaattataagattacaaccctgtaaggtcgtaaccaggaaaaaggaaaaaaatataccaccacccacacaccgatatcgccaacacaccagcccagaagaaggctagcatcggaccggctgtcactaagcatgactgaccgccactagaccaataaagggacacagaggagatcgccccctaggggatgccaaaatgacgtcttcaagaagaaaggcgacggaaaaaccgccgccgccgtccgtcgggactcaaaggagctaagactgggctttcgcctggcaatcacccttaaggggtgagatagcacgacaacgccctcaggagggggatgacatcgttgtcggtccggccaaggccggactaggttttcactcgccgctcaccacctgcgaatccacgtctgacacaccgatgctccaccaccacacaagctctgccgacatgtgggacccctacactggcgtcccccgccggctagccttcgggcaccgaagaccgcaccacacctaccgccagctcctcctcacacctaggtagccttctccactgtcagccgcgcctctcgtgctaagccggcctcctccaccggacgcgcctatcgcgccaatctggccttcctccatcggccgcgcctctcacgccaagccggcctcgatctccgccgcccgcgcctctcgcgccgagccgggctccgctgccatcggctgcgcctctctgtgccaagccggtctccgacctctccactaaacgatgccacgctggctgttgacggtcgttatcgatcaattttgatcgttaatattaccaaaatagaggagaactagtgatgcttgcaatgcatatacatgtaagaataataatattccactagtattaggtttactaaccttttgcagagaataacaatgaagtcagacgaattggacgatgtcgatgatcagacgataaatcaactcagacgataaatcaatcggacgatgtcgacgatcagacttatgtatgaatgggccaagaactcagaattgacacgatgaattgggccaaaattcacaagtctacgaagtgaagcaacggaggaggccactagcaaaaacttgggctggttggtccggcccctggttcggccgaaccagtgggtttgacctaacctcccgtggcgctgatggatgcagggttttgatggacagctgggattgatcaccaatgacggttgcaggatattaccgaccattccaaccatcataaccgtcattacctgcctataaaaggagttgccattcttacatcacacacacacctcaagcaagagctctctcatattctctcaagttagtttagtgttattaagctagtggaatagaaatagagtagaaatcgggagtccgaaagcctttggaagagttcgggaatggctctagtatctttccttttctcttttgtaagctttgtactattattagaatactcttctttatacatttatgatattgaaatactttccaagtatattaatgcctactttaaattatgttcatgttatactgaatatgttgctagcttatatgggagatgctttggtgcgggtataatgtttgcttacgcaattactctatgtcatgacgatgatattagagtagtatctggtagtttagacgtcgcgtctggattacgggatattattatttggagttatatgctgcggatgagaggtgggccactgatggtgatagctcagtacgggtattcctccgcgcgcgtatataatcctaagttaattccctggggagggtactcctccgtatttagccccggttgtatggtcatgacgggctgtcgtaaggaactcggcagtcaggggcggcttctctccacatgatcttcccacgggataaaataaatacgatacccttggaaaactctcgggtgaaatgctacaatggtatatccgtgcgcttgcggatgaactctgtaaccataatataccaggagtaattctgcgccattgctgggaattatatttctagtaatatcattaagaaatactaacaagcttttctggcgctgttgccagggaagattcataatagagattacctgacctaatactttctaattacctttgtataatcatttccctttgcaagctaaccttggttgtttttacttttgttgtgaaagcagggtagtacatgactgatttcaacttgccggaaaatttcaaagaaaatccagaagctttcttccagagcgtcaggccgtgagccactgctctgcagaaaactctactgacaaagaaaccagccgtaccagcgccaccgactttcaagactatagctgacaagactctccatgagttcgctgctccctctgctgagaatgtggccattggaccacagatcaacatgggagacatggatttcgacttgaagtccagcctcatcactatggcgtaggctagcccgttctgcggcaagcctaacgaggatgccaatgctcatctacagcagttcctggagaactgtaacacgtacgccataaagggcgtcagtccagacaccgtcaggctaaggctgttcccggtttccctcctcaggagagcgaagcagtggttctacgctaaccgtgctgctgtcaacacctgggacaagtgttctacggtattcctctcgaagttcttcccgatgggcaaaaccaagagttcttccagcagacaagggacgaggccattcctgaagcatgggaacgacttcaagagtatgtggccgcctgtcctcatcatgggattgacaactggctaatcatgcagaacttctacaatggactcccatgtcccgcgatcacctggacgtggcagctggaggagctatcttctctaaattggttcgaggagccgctgatttaatagagaagatggtctccaatatgggttggagcgaggaacgactccagacccgtcagcgaggcatgcacaccgtcaaggagacggaattacttgctgccaagctggaccttctcatgaagcgattggacgaccacgacaaacggcctcaaggcaccatcaaggccttggactcacacgttacgtgtgaggtctgcggcaacatgggtcattctgggaatgattgcccagaaacctatgaggaggcgatgtacatgggcaacaacaacaacggttaccatccacaaggcggtcaagggtggaactagccacgcccgtattatctaggaggtaataacaacggtaacttttctaaccaatcctccttgaaggatctagtttttgcgcaagctaaaactaccgatgctctaagtaaaaagctcactgccaatgacaagatctgtcacaccctaaaaatcccaaatttataaattcttgtttaagtggaatttttagaaatgatttaaaagcctagaagaaaagatctaattttaagtaataaattccaatataaaagtgggctagataaaattttattaaatacttctcttgattctatagttcctagatttttctgggatttatttgagccaagaaagtatttttaataaatggaattgcatttcatgaataatttaaaaggaaaaaggttttaaaatccttcttttgaatttgggtcgaaagtcagcccaagtctctcattcttcccggcctgtgcgcgctggcctagtccgccctctctccctcctctctcccgctgacaggtggggggggggggtcgtctgcctcctcccgccgccaggcgcgccctagccgcgcgcaagccgccaccgccccttccaaattcggttgcatctttcccgatccgatcaaattgataggggggaaatgatcccttcgatctcctctatcttttctcctatagaaactttatctaattttgcttggaaatcatcggattcgagctcgattcggatttgatttctctcctctaaccctaaaccttccatcgccgacgccgaacgtcttgggcctagccgctgccccctagcccctataaaatgacccccgagacctccttcgtccgccgccaccttcgccttagccctccaccgctggtagagctctagccgcgttagcccgtgcgccgccgcaagtccagccgtgcgctgctgctgctctggtcgtcatcgtcgctcgggaaggtcgctgtcgtgttcaccaagtcgtcgctgtcctcgtcccgttctccgtttccgccgaagatcgccggagcatcgccgtcgccgtcgacccgaatgtcttcgccgcttcgacctcgctgccgtcgccgtcggttgccgtctgtcgtcgttcgagccctcggtgagttcgccgtgtcgccctctacccgtaggtgtggtccgtttgcgccgccgcgccgtcattcgccggcgagcacgaggtgtcgagccaccgccggtgatgacgtcttcgtcgacatcagctccacatcagccgtagacccgtggtagatccgatcgatctcggccgtccgttttgtttagattagatcttagccgttcgttccataggccgcttccgtgcaacctgtccaccgtgaacccgagcccactgacactataaatccttttttcttttcaaaaataattcgttattgcgtcataatccaattaaaatctatataaatgatttaatccggtttaatatttaaaacttcataactaattcatcttagctcggatttagttggttcaagtctctaaatttttctaaaattgggatctacatgttaaaaatatccacatgtgctgtttatgattgtttatgtactgttttggtgattttgctcttttatgtttagattccgacgttcccggagagtccgattttgcaggagaagattttgaagagttctaaggccagcaaggcaagtcacacacacctca

SEQ ID NO: 60556 - DNA, 3429 bp, Oryza sativa
ctagttagagatgatggtggcatccctgcatgaagccatggacaagcttagaccctcatgtacatgggctggatgattgatctccttttgacacgtggcccggggagtttggcccatgttctggtaggggaggtaatgaggattattctttagaacaattcagattatattaactgttaggtgctttacttatgttattttgttatgttaagctggtaatcccaacagaaaatcatgggtacctatgtcgcttttctataaaagctgggtcattcggcctttggtctaggagaaaaaagaagagtgggttgttatacacatacaactccaccctagctagaaatgatttcatgaataattaacaattatgtacttgtgtgcaatattaaattaaagaaaactaatgaatgtgtcatagatgatggatcaagatcaataacgtacgtaccttggctattaagattcaccgatgcctaccaaagaaaaaaaatcaccaaatatatgccaaatcgggtatgacttgcaagaaacaaccagtaacaatgtgatatacatcctcccacttgatgtataaaatatataaaataaccacacgcagaaactaaatcctatttatgaaagcactaggatatacgattctccaatccaactcaacatcataggaaagtatattacaactagcaatttatatagatgatgcatgttacagactaagatccataggatattcgtcgtcttctcacccatgatgctttcaactcatagtacatatatttcattcattgtacacagctgcacatataaatataaaactaaatgcacattgtataaggaaaaaccacttgctatgtagtattttatgtgtgcaagtagcaaccaatatacaactccaacctgggggttgcattgacttggatccatctcccatccaattgatcaccccaggctgcttaattaatttgtttagtgtgttcactgttactactggtcaatatattgattaatctgtgtaagttaagccttctcttactttgcaggttgtctttgattggctatactctaatcttagtcttgaaccttccattaattgattataaagtcagatgtgtttactctagatgatgatgatgcatgcatgccttgcaaatgtcggcatggcgtaccagcaaggcaatcttaaataaagtgtgtatatacattacattcttgtaacctttctatcatatcctatcttactataaaattaatcccaactaatttttgaaacttaacacgtaagtatatcacattatcacccaccaacaattattatcaagagtattttaaatcacataaaagtgtgccacatcaaatactacgtacatacatcaatacttaattatcttttacttagtatatgcatgtttgatcgtgaagtgttggaatttacctttcattgtctacaaacgcatcaatcgctccagggcgatgcgggcggcgaaacctcaccgtcgcctcctcactctcctcctctcccccacctcgctgccgcctgagcagccgccggcaaagccgggcggctgcgaagacggcggtggcgggccggggctcccttctccctcactcccggtcagccgattgggacgccgacgacaccagagagcgagagcgcggccccggcgacgacggccaaatccggcgccgttgggtttggatccggccccttggccggatcttggctgggacgcgcgggtcggcgacggcgtggcgcgtgggccgcgcggaggcggcggagggcacggaggcggcggccgcggcagcggcgtgggaggcgcccgtgcgaaggtggtggggcagaggtccgcggctccggcgacgggcaggcgccagatccggtcgccccgcttggccggggtgaccggcgatgggctcggtcgatgccggcgccgctccacggacctggcaggggggtggctggtggcggcgatggtggcggatgtggcggcgacgaagttggcgacgaaggcggcggactgcggcgcgtgccgcgacgccagccctcgtcaagaacctcgccgccacgagggaggcgcgtctcccgtcaattgtatgccgtgcccgtgacgccttcctccatggcgccggcgacccgcactgcgcgctgcaccttcaggtctgcgccacccggccggtctggacggctggcagctggcgacgatggcggctggacgggggtggtggtggcggtggcgatggcgatggtggctggcggtggcggctggcgacggtggtggctgtggcgctggcggtggcggctgtcgacggtggtgcaaggccatcatccggggctgacggtgcgttgtcgtcggcagcggcatgtggaggcggggaaggaggagttcgggtgcgggcgcgctgtcgagaactgtgggcggtggccttggccgaatttctgaagggacaatgttgttgaccgacaaagatccttcttgtgtggattggtggtgtggttttggacagggaatcgcgggcgaaagccttgtcgagccgtttggccggctaacgacggcgacgccgtttggcgtcgttcccctccttggaggcgtcgttttagattacccctctcctttcctaaccatattttccgggtgaaaaccttgcttcgttccgaacgagcggtggcggcgatccacatctcatcctccttgggggcaccgctttggagaaacctcttcgtgcaaggattgtctaagggtctatgtattggcttcgaacttcagtcttaggctttgacgaggcattctagctccacattttgttttgcttttcttagtttgggtcctctcttttcctgtttagtgtgttcaacttgtcttgaactacactctcttctggagtggaactttgtaataattggctgtagctctttttgagcaaagaccgagatattatattccattatctagaaaacaaacgcatcaatacttctcttttacttggtatatgtttgatcttgaagtgttggaatttacctttcattgtctacaaacgccgtaaaatctatctattatatactaaaagtccattaaactccctacaaacgctcttaagctgccacgtgtctccctcaaaacactctcaacttgccacgtggcgtaacgagaggaattcagcacctcgtagggcccgcacattatttccataaatatatgtacgtgtacacaaggcaagatttgaaatctatctaaaagcaaaacatgtacttgtcgtgaacgaacatagattagttacatatttgtgtgtgagaggcaatattccaaatctctcaaagcaaaacattccaaatctcaaaaagcaaaatttagatcactaggaaagattattaattgcaacaaggattagttccatatacatgagacaatattcgtaaggcttgcatgcatatatata

SEQ ID NO: 60557 - DNA, 29245 bp, Oryza sativa
  unsure (1)..(29245): unsure at all n locations
aactgctcctgctatcccagtaagttttcctttgtctcaacaattagatcggctacattttacccagctcttactctttccgaaattgtctctacaggttctagccgatcttttctcttttgacatcagaaattatctcgatgaggcagaagaagacacttcaagcaaagctctagctcccctatctgacgatgtgagaagaacacttgaagatatctctcatcggctagaagcctcttctttagatagtttggtagttgactgtggatcaattaggacacggctgcatgaagttcaagctctgattcccgaagatttggccgatgtcctaactccagccgcttatctcgagcaacatcagttcaagctggaaaaagccaagctaagactagtcgaacaccgtgagcgcaaagagattgaggccgcaatccaagctaatcggcagcttgtgcatgaagagaagaccaaacttgatcagctatctgaaggtccgatcaaatccaatattgatcggctcgaagctcgcaagatcgatctcttggcacagcttgaagaatgcaatgctgaactagatatggagcacaaaaagctagccgatctctcaaaatctatcgaagaacaaaaggtaaggctcaaatcggctatcaagaatgttgctgacctaagcaagtccctgaaggtcatctttggaactgatgctcaagatgcccaagctattgaagaagtagaacaaattaggcaaagggctattttggctatccagcgatacttgtctcaataacttttgtgtaataggacttagaaatctttgtaatcggctaagatactctagtactttactgtcttgacaatcctttgtgccgattaatatgactttgaaattcgctcaaaaattttttgcattttgatatatatgtgcccccctaattttacaatgtcaaaagcattgataaaattataaaaacaactaagggagatataacaatatcggccattgtacatcggcaaaccacaaccgattacaacatgaaaaaacaactaagggcgatataaccatattggccatctcaaggcgatgtaaacacatcggctgtcatgcatcggcaacactagccgatcatgcgttaacccaaacacttgggtaatatttcttcaagtacttgccattgagcgctcgtccatagacttcaccatcaagcccttgcaacatatatgctcccttagacacaaccttataaatttggaacggtccttcccaattcggcgaccacttgccgaatttactatcacgagtcccaatcggcaaaatcaatttccatacaagttcaccttccgaaaaatctttgggtaccactttcttattgtaataccgagcaacacgttccttatccttggtaacctttgcaagggctcgcaatcgtgactgaaccagatcctccctctcatcggccataaggttgtaatactcatcagctgttaaatcattttgtaattccgttcttcgagagccgattctaacttcccatggcaaaatagcctcatgcccataaacaagtttgtaaggagggacttggatcgatccatgacaagccatcctataagaccacaacgcttcagccaaccgagtatgccattgccgaggataatcagaaattttctgcttaatcaatttggtcaaagttttattagatgcctcggcttgcctattagcttgtgcataataaggtgaagaattcaataatttgatacctatactatcggcaaactaaacaaactcgtcggacacgaaaattgaaccccgatcagttgtaatagtttgaggaataccaaatcggtagattatatgttcttgaacaaattgaattgcatccccagaatcaactttcttcaaaggaatcgcctatacccacttggtgaaataatcagtcgccactaatataaacttgtgtcctttacttgatggtgggtttatcataccgatcatatcaattccccaacctctgaatggccatagcttaataataggattcatagccgacgccggcgctcgctgaattgccccaaacttctgacaatcttgacaccccttataatatctgaaacaatcctccagcattgtcggccaaaaataccctgcatgccgaagtaaccacttcatcttatgagctgattgatgagtgccacaaattccttcatgaacttcgccgattgcaactttagcctgatcggtactcaaacacttaagtaacactccaacaatcgtctaataataaagctcatcatcccacagtgtatactttaatgccttatatcttaatttcctagaagccgattgagatggattatgcaaatattgatgcacatcatacctccaatcatcggctgtcattgctgcaatttcaaccttaacatctttgatcatcaacttataccccgatgccccttgggccaaatcattagcttcaatattttgttcttgagacacatgcttcaaagtaaccagccgaaattcattcatcaattcttagcatttctcattataaaccattaacgtatcattcttacattcatattctcctgccaattgattgattaccagcaaagaatcccccatgatttcaatagcatcggcttcaacttccttgagtaattgcaaccctttgagcactgcctcatactcagcttgattattagttgcatacggtttaatagtataagccaactcgaaacatgcccccctaggggaaattataactaggccgataccacaaccatgagtacacaccgatccatcaaagaataaagtccatggcactatttcaaccgagccgattgaatcatcacgatgttccacaataaaatcggctatagcttgtcccttaatcgccttcggtgactcataccgaagatcaaactcggttaaggaaaatatccactttccaacccttcctttcaatattggagccgataacatgtatttgacaacgtcggccttgcatataacagtacactcgttggatagtagataatgcctcaaccttgtacacgaaaaatatagacacaagcataacttctccacaggggaatatctagtttcagcatccaagagccgacgactgagataaaatacaactcgttcttttccatccaactcctgaatcaagactgagccaattgacttctcaccggccgacagatacaatctaaaagatatccctttctgtggaggaatcaaaataggaggagagctaagatattctttgatattatctaaagctttttgttgctctgccccccaagtaaattgctgatcggccttcaatctcaacaatggtgtaaaaggttctaactttctagacaaattagaaataaaccttcgaacaaaattaatcttgtcgatcatctcctgcaattcggtcttgttttccgggggctgaatcttcttgatcgcattaacactcctttgagtcacctcaatccccctctcatgaacaagaaatcccaaaagctagccagccgatacaccaaaagcatattttgtcggattcatcttcaggccatattatctggttctctcgaaaaccttcctcaaatcggctatatggtcctctatttccttagacataacaaccacatcatcgatgtagacttcaaccaaccagccgattagatcatgatatatgtaattcatggctctttgatatgtagctccagcactcttcaagccgaaagtcatgacaacccattcaaataagccgattgcaccagggcctctaaaagctgtcttatggatatcttctttagccataaagatttgattatatcctgcgtttccatccataaaactcaaaattttgttccctgacgcagcatcaaccagctgatcggctactggcattgggtattcatccttcggtgtggctttattcagatctcggaaatcaatacacaccctgaccttgccattcttcttgataactggaactatactagaaacccattcagcgtatcggcaaggacgaataaaaccagcatcatacaatcgtttaattttagctttgacaggttcaagcatatcggctttacatctcctcggaggttgctggtgtggcctaacctctggtttgataggtagccgatgttctacaatcgatcggttgagtcctggtatctcgtaatactcccaagcgaatcaatctctaaactctttcaagagctctatcagcttggttctaaattctggagataagttcttactaataaatgtcggccttggccgatcgcctggacctatatctatttcttccaaatcatcagccgacatgaaaccttgaccttgcttgtcatcgagatcatataccgtgtcctaagtgtagacatttgaaccctccacgacgccctcaaaataatagcttgggttctccatcttcaattggctgtatatcagaatcgaacaattttagaaaatctccatcccaaacttttccagataaacaatcaaggccatccatctcccaaagagctaaatcggcactgacaacattaactgacctgtcggctggcacgatctctatcttgtcgccttgccactgaatcaaacattgatgcatagttgaaggaatgcaacaattggcgtgaatccaatcccttccaagcaacaagctgtaagaacccttcccatcgatgacaaaaaaacgtggtaggaatagtcttactgccgactgtcagctccacatttagaacacctttggtttccgatggattaccaccaaagtctatgagcaccatatttgtcttgatgagatcctcggcatttctacccaacttcttgaacgtagcaaaaggcatcaaatttaccgcggccccactatcaaccatcattttagacatcggcttcccattgacatagccgtttatatacaatggtttaagatgccgattctctgtcccctcaggtttctcgaacactgcctgttctggtgatagaaccaacttagctgattcctcttccacctcgtcgatatcggcttgatcgatcccgaattcggctggcaaggtaaagaccatgttaaccggtgccgtcacaacactcttcccctttgccaacctctttgcctcatcggctgcaacatcatcggctataggaacctgattcttaacacgccactcctgcctcggctttgctttcttcagccgatgattaatttcttgttcgacctcctgaaggcgctccctgttcctcaatctttgaacccttctcttctgattcttcgtgaaaataccagaaggacaccattgattctttctgattacattgtcctcttggccatgatcttgattcactggacccaatctttgatgaacaaaaactcttgtctgccatagccgattgcccttattatatgatcagcttgagctctcgatgatgtcactgcacccagggcagtttttaatagatggcagcctcataccttcattccagcagaatctaaagaactcacaaccccaatgaggatcaaaaccaccatcgtattcttcatgatgcttctcctgctgcttgtcatacttcctctgatatttgttaataaccttagctgaattcacctgaaaacctcttgcacggaccctatcggctgtttggccagctgtatgcaccatattaacaggaaaatggttaccattgaccttcattggctttttggaatcatcaaacctaatcttgcctccctcaatggccacctgaatctgctgtctaaaaaccttgcaatcgttagtagagtgggatccagaattatgccatttgcaatacctctttttgcctaattcctcagccgatggaattgtatgaccagcagggagttgaatttgcttctctcggagtagtagatcaaagatcttgtcaactttagtaatatcaaaattatacttctcttcttttctagaactctttacccattagcacggtatgacctttttactcctcacccattcggctgcagctatttcagaattgtcctcatcgtcatccaacccatacatgtaacgacaaacatgattaaccttcttagagtttttcctaacttccgcagacctatgctcatgcaaggttaccttctgtatcagatatgacaagctatcaaagtcttcagacgagaatttctccctaatcggagcaatcataccctgaaaggccagatcggctaactgggcatcagttaaactcaagctgaagcatttgttcctcatcttcctgaatctctgaatatactcgtgcacaggttcatcatgccactgcttaatcgccgtcaagtcagataatttcatctcatgaaccccactgtagaaatagctgtggaattgcttctccaaatcggcccaactattgattgacccatacggcaaagaggaaaaccaagtaaaagccgatccagacaaagataaccggaataaccaaaccttcaaagtgtctacagccgatgcttcaccacactgagctaaaaatcggctaatgtgctcataagttgacacaccatcttgtcccgaaaatttggagaagtctggaactttgaattgattgggaagaggaactctctcaaaccactcagggtaaggctgccgatacaagcttccagtctcttttggtttaagcccaaactgttcccttattacgtcagcaatcacatcggcccacggtcgttgctgagctgctccctgtgcctgttgttgcatgggctcgaactgaccatattgagacgcaaactggggttgagccagtccccctagttgatattgggcttgcggggaaggaggctgatattgataattcaagttgccctcttagtaattatgaaggttcggctagatattacgtgctaagtgctcaggaacaacttgaggcattactgtgccatccggctgtatgtggtgaaccaagtgttctgggacaacttgatttaaaaattgttgtacaggctgaccaccaggcgttgcaaacccggccaatgcgcttattgaaccttggtgctgaatcggctgaacgatttgctgtcttaacggcgtctactgaatcggctccataggctgctgccttggtggtgtttgctgaactggttgcacaacctgttgctggattggttgtacaacctgttgaactgggagtgtctgttgaatcggttgctgctgtattggatcgacagcaggttgaggttgcagaaacgtggcaacaacctgatattgggtcagccgattcgcaacctgcccactatgctatggctgctctctcattaacaaccgagggttcaccagctggcctggtgccatcgctgacggagcaggcaagggagtcgatgccggcgccatcggctgagctgatggtgcaatggagggaaccgcctgaatagatggctgaacatcggtgatcaaagaccaataatttggaaagacacctccttgcaaataaactgggcctgcagcctgatgctcagctattgaaccatcggctattgacttcatcatgtttgataaggtattgactaactccccaaactgattgatcaaagcatgatgcacagcgttgtcaacccagtcttggaaattattgaaaaatcttgtgccacatcactattctgattaagatttcctccttgctacccctgagcactatcaccttgaactccatgcactccgtcaccttgaactccatggactccttgagaattgtcaccttgatttcctatagaaccatcggtagcacctttgtcactcggttgagccgagccgtctggagcttgtttcccatctccatccttagaagaactggtcccaggatcatcagcaaccacttttattttgtacttctaaacaagtgtccccttgcgggtctacatgaatgagttcaagaactgatcccgtgcttgctgcaacattgcttcaaaatctttcttctgctcaggtgtgaatttttcctgatcaatgggcacgacgtttccttcattgacgtcagtcaatcccaacttctggatcatttccttaatagtgcctggactagccgaggatggcgacagcggtggtttctcggccatgaggaagaattgcttgctgacttcttatcggtcctactggacgtgccaaaagcgtgttgacagaaaacacgaggcctgggagatctgctaaactccagtgcaggtccaaagctcgccttcgagtgtgttagcgtgccagttgatttgatcctgcaatcaacaagaaatagaaacaaagagaccgcgattaaatctataaatgataaccgatcggctaggtgccgatgacatatcatttatctttgagccgatgtcatatgtgaatcgatcggtggttgtaaatagacaataaagaactaaatctattcgatcggctgtagatattaacaatgtatagttcttatatcgatatatatttaaatcaagtgactgggatagatcggtcgccatgccgagacagtataaatcacttagatcgaaatatatattaataacagcattatatatgtttatagcatagccgatcagatagatctagcatgtatcggctaatactccgatactactctatatcaagatatcaaaacaagtataatgtatcaaacaaaagactaatatacttaaatgcaataagatcttgacgtaaagggcggatttaacatgtcaatgaagcatatagaacgaatatggttaaatcagataagatcggctaaaactctgatactactctaatcggcaaccagaaggcaggctagagattgaaattctaaggacgacttaatagatcaaactcaactgatgcagcattaagtatgaaaagaagaacaatatctagacaatcaagccgctggatgtttcataaagtggtagatatcttatataatctaggtcaacatcgctatttaacctaatcggctgccttctgtcgacatatgttagccgattgtaggttagatgacgatattgtcgaagattatgtaagatatatgataacttgacgaattacatagacaagattagagtgtcgtaaagatggaagcactaatcccgagaacacaatccatcataacaagttttacctcttgttgaagatcgaaaccgatgcagctcaacccgaaagcaagaactcgtcgaaataaaactaaagcaaaaaggtggcgatgcgctgagattgtattgaacgtgtgtagattccaaattacatagggctcgggtctatttttacctaagaattacaagatatatccataccggacacgactactatctctaacaaactctaagataccataagtctttgcggcagacttttgcccaagcatatctctaaggaaattacataaaatatcctaattaatagatacaattgccttctcaggactctatccatgtgcggcaatcatcttaaagcacctcaattcaacccgatgtcatacaccaagttgtattgtcggaatcggctgcatcggcttacctagtccgactcagacccagccaatcctaatcgtagccgatctggactccagccgattcctgctctgttctcgaattcgatctccgcctttgacttcacttcgatctaatcttctttcccgatgtcgatattaccaaatttggttgttaacaaaaccattagattaaattgatcttagaacaaactaaatactacgaggtcccacctctcaccttcagtacgcacctacgtacgtgggtacctactcttcccctcctcattttcatttttccctttatttttttctccatgtatatgcttccctccctttcttattatgtcatgcgtcttcatgagatgatttaatcacaagaattttgagtatcttgctcccgtatttttcatttgtaaccatactacaagcaataatttattatttactcgagaaagaaaacatgattcaaaagtcgtaagtacttaatccatcttctattcaaaagtttgtgaatggatttttaagataccttaaaaaaatagaacccttaaattattaaaaaaatattgcaaaataacagtatccgaactttagtttaatattgcaaaataacagtatctgaactttagttttcccttaatttatgagacaaaatttttgaacaaacaataaaaatcttaccttttaataatataagtgcgcgcatgcgcggaccaccttcctagttttagaaaaaatccatatctacttcctcctctctagtggccagtcattgttgggcttggcactaggcgctgttcattgccaccaacggcctgcagtccattgccatcgtgccatgctgccattgaggaaagtcaagtttgaccgatgaaaggccgccactgtcatggatgatataggggagagagaggagataatgaccggggaaagagaaagcaaggtaagctctacagaataaggcaggaggtagtgtggtgaagaaatgtgtgggatgatgcttttgatattttaccttactttgaatgcttgatttgaagcatctccgtcctgaaatattttggagtagttattcccttcatcccataatatagggaattttagagggatgtgacagatcctagcacgtactacgaatctatacagaaaacctatccagagtcataatactaggacatatgttatatccctctaaaatctcttatattttgagacggatgaagtatttattattctgaattttaattgtttttcgatcgcaatgctagacaaaaatggtttggacagaccatgttaaataggctaatcaaactttcaccttgttgaaattaggcaaaacataatctaagtaacttgtcgtaaaagccatagagtgaaacaagaaagctgtagtaagtataacacccatgtatgtaatgagtgtgtcgggcttgcgatgacgcaattaataatctcatctcatgatgaatgaccgcgcggagagtagaggttgatggaggagacaccgaggtaggcggcgagtaggtcctcgtcatcgtcctcctgcctcgccagcgcctccttcattgctggccaccactcgggtaagtcaccgctgccaccgtcgtcgtcgtcattgcacattgcattggtcgttgccagcggtgaggacactacttctgctaatcccgtcgattgactgccgtcggcagcatcgccggtggtggagttgcgggcgaaacggcccttcaccctaggccggctgtcggcgagcgtcttccggcaagcatactgcatgcatatgcaatccaataatatccaatattagtatatgtgtgtagtagttagatagagaggtacttaaaaaaaagaaaatagcaatgcagacaatatgggcttgtgggttttgagaccctcttagggttttcattatcggtagcaaaaagtattggagggtagtggtaaacaagataattggaattatcggaattctaccgtggatagataatttttttttgcaaaatttgttaagaaaatcacacagactctatccaaccaatttggcataaaaaataacaaaaatatatatactccacacacccaatacatgattcaaaaaattacattttttttaccgatacacaatacaaactctaaatcacgattgttgttatatacttttgtatctaacttttgttgcgaaacacaatacaaacataaataagtgtgtaaaagataaattaattagcaagtgggcttttatgcgagattgtgtattatattcttataaggaaactgaatatgtaatccacgtacggtgatcttcctttcgaagttgcggtggtttcgcttgctccggtacttctcaatgcgctcctgccgctcctccgcactgtaccttcccaccgccgccgtcgccctcggaagctcctccttcgtcggtgagtggtcgctggacggcggcggttgacgagacgagactggtaagacggcaccatccatcctgacactattgaatggacgagatgaggaagacgaggaggtgctactgccactgccactgctactgccattgctaccccagctgtgatacatattttctaggttcaagctaccggcctccttgtaaatgtataccctacatatgactcttgaggatctctccatagctgccattatatacgatattggatttcatgtatggacgttcgtgtagctagagcctccacttgaattgtacatggagcatgcaaggaggaattgctgtttgctgatcttgctcctgcagggagtcaactcttggctctacaatgatttgacacgacttactagcttagtgattgtgttgtgccatcgtggatcaattgccaatcatgatatatgccaccaaatcttgagattcttctcgtgcatgctatgtctttcatgtcccatgacatccccctctctctctgttttctttttcttgttgagatcgtctcatgacatggtggtggatctcagactctcagagccacatacatatggcattattgttatttgttaaccatgcgtatgtcatgcagaaatcaaatgtgtttggcacatttcttaaataaggccctgcttagttcccatacaaaaattttacgccctctcacatcgaatgtttgaacacccacaagaagtattaaatataggctacaaaaataactaattacatagattgtgactaatttgcgagattaatattttaagcctaattgctccatgatttgacaatgtggtgttacagtaatatgctaatgacagattaattaggcttaataaattcatctcgcggtttactggctgattctgtaattagtttttttattagtgctcgaacaccatatacgacaccctatataatacccgatgtcgatgtgacacgccaaaactttacacccctggatctaaataccccctaagaaacaaggaaaagggttcgttttcactgacacaatcaagtttagtcacgcgttcaaggattattttctttttccccgaaagatgcatatccatcatatatactccttccatttcagattataagttgttttggctttgtcaaagtcaaactacttgaagtttgactacgtttgtagataaatatagtattatttacaacacgaagttagcttcattaaattgataattgaatatattttcctaatatatttatcttgaatttaaaatattactctttttttttataaacttggttaattttaaagtaatttaactttgaccaaagtcaaaacaacttataatctgaaacagagggattatcaaacaatgcatgtattgatgtgtataaaactcagacacagagtgagagctgccacagacacacatagcacaaagcatgtggtagaccaacgaaggaggcaccaatagcagtatatacaaggctgtttaagatagcaagtatctcattcgactatgtaataaacagcacaagtagaaaaagatgtgtagcaacacgggctaatagcaacgatagtgcagtgagacgattcagggaggcataagcaagttgaccacaaaagcatacgcaccgtaggctggctgtaccctgctatgcctttattctgcacctctacatcgcattacgcccaccttgcagttgaccacaaaagcaacaacaggctctaccactttgctccatcatgtgtacacaggattctaggtcggattgagatcctctaatatactgtcctctatgtgggtcattgacatatgggttcaacgggcctatataatggtgactcaaagttagaggaaaacaagtcagagaatcttcttccatgggtctaataaaccaagtgtttggctgactccaaggtattcaatattcctaagttaagcattaataacaggatactcggttgcagcgataaatgaaaaagaaggagctcctgcagttcttttatttatatctaaaatgggaaaacaaaaacaaaaaatgcacaagaaacccaccaagtatgatgaattgatgatcatgacccatgatgagacagtccctccagagtccaccatgaccctatgattagcttcaaaaaattgacatctcccaagattttagtggggaagaatgttgtccccttttaacacttgcagccgaaaatgtatagctcccaacaggtatatccatgttgtttcgagcatctattggacagaggttagaattttgttctagccgtagatccaaggtgctgcttttagttggaaattggttgttggcaaaataacttgaagtgacctagctagaccaaccgcattattccattctcctgttatgataattcagcgttttctgataaatccttaccgtagcccacttaagaatgcggtatatcatgaactcaccgaccttcaagtgggcttagccaaccaacaggatgaaatcaaagggcaccaagcattaacattgtagaaaatgcttggattgcttgctctaacagttgttacagttttcttttggaagcaacctgcatagattttaagatgccccaggcatgcctatttgtaaactagcactgtcagacagtgaaaataggtgggactattaggatagtggtgtagttctcttagattttcttttccttctagtaagtcaactataaaaacagttcgaccactatagcacgatcggaatgcaataattgctaacagagtaacagttgaagtatgcaaagaatttacagaaatgaggaacatataaactagtcatgcgcggttgtacaagaattggaaacgaagagacaaaagttggctatctgtctaatttacagcaagaagtctattatggcaggtcacagttttatgtagggtgaagtttgattaagattgggacacatgttagtgtagaataaagtgtgtttgatttttaggccccctttgaataacaggaatgaaaaaacggaagaataggaaaaacataggattctcataggaatacaagtgtaaaacagaggattacaaaacacaggaaaaatataggaatgaccgtttgattgagctgtaggaaaaacacaggaatttgaggagagataaagactcaaacgattcttaacatgaggttctacctcatgctaaatttcctccaaaacttgcatgggaagaggcattccatagaaatttttgtgatgaacaattgacatataagagtattggttttgatatttggagattattggtgaagtggttttggagataattggatttgcaggtgatgaacagagactgctgtattataggaaccggttagacctggcaagtgctgctggtcaaaccgaaggtgtgcgagcggtcagacaggctagcccgcggtctgaccggttcactttttgtcggttttggtttcgggttgtttcgttggatatccgtaggtaatttgtgtttatgacttctagatggatactatgcgtatgtaatactgttctttttttttgctaacaatgagtcaagttggagatagcttgtccttggaatatagtttcttggttaattcatgtgtaggtaatcttgacgtcgcgggagagtattgccggtgatagatcgggagtcaacttggagataaggtgacgtccaaacggtcagatatcatgcgggacacttaggctaaagattgatgtgcgtggttggaaaagattccatatggcatatgatggagatattgtgtacgtatgggatgcagagttgaatttgtaagaagtccaaatttggtacaattggagtttgtaaagttggtttcttgtacgggaaggtttcctagagagatttggacttcgtgtatgagtttggttcgtagctttaggatgcctatctcatgtataaatagagagggagggtgtggcctcccggtatcgctttatagagcactgagtcgagagaatagttagggtttcgagtttagtcgagatttttgtgaggagtgcttttgttgcactttgtaacacacatagagaagtaataaagttatcgtctactttgagagtttttcgatttgtgtttgctcaggttcggcggttcaaccggtgggacaccggcggtcagactgacggcgtcgcaccgatcagaccggcggcaactacaggcgacgacagcagatttcggctgtcagaccggcggcttccaggcgcaacttctccgatcataccacgtttcatcgattcgagggtaacttttaattctgctaaaagttttggtttttggatattacaaccattcaccccgcctctggttgacttagttattgttgttcgatcctacagttagctttggtaaaatgacaacatagtaacgacgaatgataagactatacaatatctagtgacatgcatgaaattttgaaaaccaatttccattagctccccacatctttcttttgtctacgctactggagaactgatctttcgtcgtggtacccaaaatcacaaatatctcggttagattaaaaaccgatactaaagatgctttagtatattactagttctaaaagtccaagtcactgaaaacatttttagtcagtactaaaccgattgaaataaccattactaaaggagggttttcaactggtgttaaagatcgttacttcactagaggtatgccaaatcgtatggatcaccttttccacatcaaatccattgtaacttgcacagtaaatcttgcttctatttatttgtggctctcattacaatttatatttcctaagcaaatcctgataagaattgtagtggcttaaaatgtagtaatgttctcttacatgaggtactgatacgtgcatttaatttgacaatttaaccctttccgaaaactaatctcgcaaatgaatcatggccaaaactttttttaaaaatgacccttttgttcagcgccaaaattgtatagcgctgaacttagacacctcagcgccacgtcaactggtgctgaatgctgtgccaccgcgaatgggaggctaagtcggcgtgccaatgtgcattcaacgccgtgctatttgatgctgatatatctaagttcaataccatacttgacattgaacaaaagggtcatttttaaataagttttggctgcggttcatttgcgaaattagttttcggaaagcgtcaaattgtcaaattaaatgctgatatgtgggctggctgattctagggcccacatgtcagatccgtctccggtggcttggtgggtaagaaccaggtcgctcgcaatgattcaggagcaccacggtctcacttgttggtaggtaggataggaaaggaggtgcagagagtgggatcacactggaagagagaaaaggaggaacttgtaggaaccacacacgatatggtatttatttaaactctccacataatatgtaaaaactctgatatgtccaactgtgtcacaatatatagctgatgatttattccttcttggtatatagggctgtaaaagaaaacgtaggacttgacagggataggagctgttggcttaaggtcataaatatgagctcaacactaaacgagggatcagatccttatgagcgaagctcatccatgctttgattaggccctaaatccccaacacatctatatctatctatctatttatctatacctagctaattaagataacatgatgaccatgttttactctatatatatacataatacatggatctagtctacctcctaatgaaatatataggttgtatgggtactcggtatctatatcatccacacaagtgcaccctaccgtccatcccaatctcatccacagcagcgccatggcaagcttcactacctccacatcaatctccagggctacctgcctcgctgtgcaagagttccacttccaggaagcatgttctggtggtctgacaactaagcagggggaacgagggcagcacgatgacagaggtggtcgtcatgggacgaagatggctgatgaggagttaggtcccgatcttccgataggtattgataaacagttgagttgggcggagtcgtgacacaactcgatccggcttctgaacaaacacgctactgaaccccgcaatcacagcaccacgtctcctctggttatcaaccgtgccgaaacccggttgacctcaccgagaaggctaatccctgcatgcgaatcgaagaacacaagcgagaataagatagattgcaaccaaattgcatatgaatgattaagcactcgaatttggggttccacaaaccgatctagcggcgaaactgttcttgacagaataatctaagcaaaacccgactctaaatggtgacggctactgaataaatatgattaaggatgtcctagggttgccctagggcgcacacccccttgagctaagcccacgacacaattacaaggcccaaaacacaaatcagattcggactggatgagatacgtggcttgttttgcagtttcccggcaacttagtaggaattttgatgtggaaccaaatccatcagaaagtagactccataagctttccaacaagtactcatgggccctgaaattccttctagaacagcggctaggtccgtttgaagttgatgctatcaggaggcctgaatccgaatccaaaacgtgtataacttgatctcttgtcttctatgggccaaaagtgacatggtgaggtagaagtagacttgtagaaggtcttgatttggtacccaatcaacttctttaatcatctatgcattagttatgctcggtctcttttccttcgcccaagcaagtacctctgtaaacaaaaacacacaaaactcattgtttagcaacgtttgttcaaatatataacaagtaaatctaatgtagaacacatacacctttatttgattaatatataaggtagtcatggttatatccgagctagttgtgtcctcatcgatggctgtgtcgatggtcgatgagatgagcatggcgattgagaggccagctaagcagatcgagatgcgatggcaccgggtaagatcgatctacccgctatgcaccttcgtcacttgatccatttgtgctctgtgccattctcttggcggagtcattacgcaacgcttccttttctctgactcatctgcaactccaccttgaccacaagttacctggatgctgccttgaggtggtcatccctgatggcaccaaacaaaactgcagccgccaccaaggacgactgctacttcccacatgtgaggttgatgagagatacaccagatgagaccactgcctcgcgccaatggcggtggttggaaacaaagctgagggtgagatgggggagagagcaggggtagaggaggaagaagagaggttgatgtcactaacatgttggtcctagttatttttatttaactaggaaggtagcccgcgcattgcacgggaatgtattttagattgtgtttaaaaaacttatataggcggaatatcaaccggatgacacctgccatgtttcaaaagtattgttactccgtaatttttcttcatcggtattgcttagataatttttccaagctatttgttagcttcaaaatatataatatttaattcatcggtataaacaattatgtatgatacgcatgaacacatgccatgtttcaaaagtatttatttagtttgtttggaaaatgtgcctaacaaattaagcgtaaattaaaagtaaaatggtttgtcttgtttaattgaatgtttagtggccttttttaagaaaatcctaaagaactactattattagtaaatgtggtttatttgtgtcatcaagttagtcctctttttagttggttcaatatgcaagttgttacatgcttacatataaattaatgaaaacatatcatagatcatcacttccttttaatttgtgtaatctatagtgtggtttctaaaagaaaatatagtcgacatgagtctataaatttaaatataatagtaacaaatataaccaactgtatagtctggcttaatatgcaaacaaactcataatactatggtattggatagatgcaagatgtgacatcccggcctagcgcttaataggattaatagaatactcatatcaacaagttgcaacttcttttctagaagccgatctcgaaagaactctgaggttaagcgtgctttgcctggagcaattttgagatgggtgtcataatttctatggcctataaaagctgccaaatataagcgggcctggcctgggagaggcgggatgttacaaaatggtatcagagtcgactctcgcggtttcacaggcgcgtgtgtcgcagttgcgcagtgtcacgcccgaaaattcactagtaatttctgaactaatttgtgcataaaaatcctcgtccaggaatcagccgagatacacaaaatgacaatttaatatacaaatccatcataaaaataacggtacatacttacaaaagaaaagaaaacagcagcggaaataacggtttagcgatggcttcagctctactcccacaggcagctcaactggggtataagccaaacgtcttctccttctggatccttttacttcaactaaggttgattgattattgcaagaatgagcatatgacatacttaacaagccacacagcaaatatgcaagtgcacaaggataccaaaggatggcataatataggctcatttgcaaaagcagcatttagcaaacatttaagagtaataaaacagtagagtactttaatcattaattttaataaacactgaacaacacgcccatgctgctcaggcccaaccatacctaaacaaccaaccctggctatacagatctaactccaaaccaggagctaagcaaattattaccaattatagcatcaataattattgtgagaggtgtgactaatcacgaaaaatattgcttaactcgcccataaccgcgggcacggctattcgaatagttttactctggctagaggtgtaccactgtacccacaagacacagcctcaacatcatgtctaccatgcgtcgcgatactggaaagtacccgaatagaggctgtgacaataccccctgcacaacacaactcaccacagtgcaccattcctggatcataatcaccccctctataaatataaccagaggcatggactacccagcgacccccacggacttctcgccgcttctcagtctggcaccccgtaatgaaccatgctatacaaaaggtaaagccgttgcccacgctggcttgtggttggcacggttaatgtttcacaacagtagctcgtgaaccggtccttaattgtcatgagcacgaccttcaaaaccatgtgctcacaacccaccattgtcaagttttagttatcaattaattatcataacacgattaaccatcgtgagctaccattaaatataaccataattaataatatagtatgattcatccctttaatgagctattgtttctaagcatggctaagcaactataaataacatctagctgaaccaatccaatatataaggtccatgctagtcaaattataacccataggaaaataaagtcatattcggccattaattaatcgggaaaggctcacctcccgatgacattcgaaaataatgcataagttgaaataaaacattagctttaaacgggttcaacatgctcaaagggttgtttgagatctgtgtgacttgccttgatcttccgcaaacacttctgaaccttcctcaacgaaaacgctctcctcggaacatcggaaactaaagcgaaagaacaaaatcaacaaaatagtacaaaaacaagcaaaaacagtacatgtggatatttttaacatgtagatcttgattttagatgaatttagcaacttgaaccactcgaatccgagttacgatgatttagttatgaatttcggaagtttaatcgattttcatctaatagagaaaactaaggaaaagggattaatgacgtcatcgctgacgtcatcgccggcaacggcggcggctagagcaaggcggcggcggccctacgggcgatgggggagctcgggagttggagcaaacgaaagaggacgactaggggatgctatttataggcttggattgaagagaccggactcgaaccgagaggaattgagccggaaaaaccgagggttagttggagagataaacttgaaaacgaattcgattccgcgttgatttcttcgggataaagtccgactcttgggggaaaggatagaggaggataagaggaatatttcccctcaactaatttttcaaacggagcacgggatgcggccgatttggtggaggaagcggcgtcggctagagcacaggacggcagctcgggcttctgtccaagcttgaagatgaacagtacacggggaggcaaactagactttcgtcttgagctggctgaaaaacaaaggaaagaaagaaagaaaagagggagctcggctgggccgacttgggctgcacagcactcgcgcgagggagagagatgttgggctgaaatcagcccaacggcttaggagaggatttaaaaactttttctaattaaaataatcactgaaatgatctttgaattgttaaaaatacttccaatgctcaaatagtttcaagaaaaatcttgaaaatacttggacactcaaagtaattaaaaaaattataatcagaccattcaatgaataatttaatatgtggataattactgaaatgttctttgtatgattaaaattaggaattgagctccgaaaaatctgagaaaattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacgaaaatcaggatgtgacacgcaggcatggtgtgcatggctggtgtggacccggagtggtcacacagcatggcacatgcgctggcactagacacatggacgtggccaagaggggacgttcctggcctggggttgatcgacgggggcgtcgatctctcttaatggggtgaggatatgacatcccggcctaaggcttaataggattaatagaatactcatatcaataagttgcaacttcttttccggaagccgatctcgaaagaactatgaggttaagtgtgcttggcctggagcaatttcgagatgggttaccgacaaggaaattcttcccgagtgcacaagaatgaggataaagtgtgcaaaaaagacttgtgttggtctgtgagggcagtctatggcctataaaagcattcttcccgagtgcacaagagtgaggacaaagtgtgcaaaaaagacttgtgttggtctgtgagggcagtctatggcctataaaagctaccaggtgtaagcgggtccggcctctcctcttcccgagtgcacaagagtgaggacaaagtgtgcaaaaaagacttcgcgagtgcacaatagtgaggacaaagtgtgcaaaaaagacttgtgttggtctgtgagggcagtctatggcctataaaagctaccaggtgtaagcgggtccggcctgggagaggcgagacgttacacaagaacaccattatttgattttctccaaatagttcaatgcagcttaaaaaatatgcatgttttaatattattgattatttttcggtaaaaaaaaagggataggtagaggagagagtggagagttcaagctgagacgagaggggacgggtagtgttgttgtgcacatgtggggggatggcgaaatggatggggtgtttttttgctaaatgattaaagtgaaaaccgatgatttttttgtcaaaatttctaatatccttttttttctaaattttaagatgtagcacatggcagcttaagattttatctaaagttatatctattggtaaaaataatggatccacttattaagtcaaaacgatggtcggatgtcttttctaaccgtttctaagattttatttttaattaagacgtaacacgtgacacctacagaggatgtacaatgatttgaggtgatataatacttattgtcattttttatttataatactctatattttttctatttggttaccatgcaaaggataggtgtgtatgctcaaatggttttttttttatacagtaaagtatgagtaatgtggatcttgaattatttatttaattagaaataaaataaaaattcaaataaaatagaaattatatataacataagaatcataattattttgctttgtaattattgatctttttatatcatgttgttaattagttagaaattataagacggagttgagtgagagagaagagaataagagaaagtcgaaggggacaaagtacacacacatagaattctatttttttttacatttgtagtgttttcaggtattcttactttatttactaaaaatagtataaaagttttattgattgattaagatctatcttttttactcgtcttttcctatataggaggaacactatagattaactaatgttattttggatttattataatatcaaaatgggagttgtaattttttggaacaatactcagtacttttgtcattactggtctaattgaattattgtgaacttatatacgatgacgaaatatatatcattatttttcataattttatagttgcttgaatggcacacaaaagccagaaaatatagccccaaatatgggtctttaaatgtataataatcaaaatacataagcaaaagtattactaatttgatttagggaacctatgatttagatgttatagttgctaatttctttagcataactcttgctttctaactaatatattttgggaacattactcataattatgcttattttacctttatgactgtaggtataatttaattattatgaagttatgcagaatgatggattctattatattattattatttcatatttcttataattgcttgaatggcacgcaaaagtctgaaaatataatccaaaataacatttttttctcaaagttgaattatagtgaaaatttggtcttttagccgtaaatttagtcataaaaaattttgaagatatatctggatcaaaaattagttgtatatatttagatgttatagttgttgaattgtttaacaccaaacttttgcttttctaactaataaagtatgaataggagaagaaatacgtgcataaatatgaagagattgagagaagaaggggtggaagtacattacaaaagtacaaacttactacctctagaaagaaaatgtacgtacgtactactgtatgtctgtctgtatgtgtaggcccaggtggaccctggtttggggttagagtggtttttttctttcgataaatctaatggtggtaaataatggatctatctaatttaatgaaaatcaatggctagatgttttgtttatttcttagaacttttagaattttctgtaatttaggatgctacgtggcggcttaggagcatttgaaggaagtttaatgaatttttagtatataatagaagatatattatatattaaaagtctactcctaagaacgctcctaagctgccacgtgtcatcctacaaacgctcataggccgttacgtggcattctacaatcccatcgtcgattttcatttaaactgttgcacccattagattatatctattttaaaagttcatcatcgatatttatttaaattgatggacctgttattttagaacgtaagattatatcgattttacaaagttatttttaataagataaccgatgttatcatcacaggttacatattgtgttagaaagattatatatataattaaaattatgctcatcatatactacattaaaatccataaactttagactacattaaaattactcatcagattatacatgtcacattatgcctgttacaaagatctcatacaattgacagctcatgccatcgtcatatttcaaatatgttatttggttgcccataaaatatgatacccttgaaaagatttttttatttacagtagcatcgctaaaactctatggaaaaacagatctaatcattaatcatttatggtaacaaattatggtgtgcatcttttgactaccttaattaggaaagaaaagaagagattgatggggaggaatttgtacgtacatacacatgtgggtctggccaggaggaaaaaatgaaggggattaagttttgatctaatggttaatagtatcgagtccaccgttttaaatgaaaattgacgggtagatgtttttcttttttcatatttttctgtaaattattaaagcgtcacgtggtggattaggagcgtttgtagggtaccacatggtggtttaggagcgtttgtaggaagtttaatagacttttagtatataatagatatatagattttgccttaatgccatgtaagcggtacttaagataaaaccaccatgaaaaccgctcggggttttgacagtggagagaattatctttgtatctggttttgtggtcgatacaggttatagactttctcccttggtcaaacaaaatatagactctttccttattgaaaaggaatgctttgtattacccacattatcacttgcattttctccaattatatcataataaccatttaacttaaacaaaaccatatcatttcatagccatttattttaacttatatccatactttagaatcacccatagatacaactccagtaaccaggagcacattatatacaaatactatcggtatccccaaggtatacctaggtttactgcacaacaactctagttggcaagctaaaaatgctaaaacaagtatctctcccttctgcatagtataaaatgcatgctcaggttattgctcggaagtatttggttcaaggtgtgccccaacctacttttacatccacattgtaacattgttactcaatgggaagtcttgggcccatcgatgccacaggtgtaattagctatcctgtgaaaaggtgtattggatcatgcttgaagaatgatgactataagaacttattgtaactaggtcaatccgaaacactttattaggacaattatagaatactggatctgccactatattttctattaatttagaatttgatacaaaattagttaacggtaattatgcatacaacttgcattgtttctttgatgttccatttgggatgcaaccatcaacttcctctgttgttacttagaattccaactataaattcttgcgaaaatgctagtgattgtatgacatgccttcaatatggccaatgctttcttgtaaaaaaatgtatatggccaatgctccaaatttagtatgaccttactatggaaggtaatgtaaactaaacttaggttaatttcatcctcaaccacacattcaagatcttgcacatgcacaaaaggaacaccacgcaaagatgacttctcattatattgaaaaactatcctttttattcagtaactaatgatcttcgattgttctattaaaaaaatattggtccttggccatttcctaatctgagttgcataaaactacatatgttcccatggtcttccattgagagaaaatggcagatgatggtttcaaatatcatgaggttagttcgtttccagttgccatttttttcttgtgatacatcttgtgtgttacaattgatatcgatcttgtattatgctgaataagagaattttgaaaaacaccatcaccattttattttgtttttatcaagggatgtgagattcaaattttatgttggttgtaggaatatgttacaaataaacgagggatgaagctctttgcatgccaatggagtcctttagaccatgaaccgaaagctctaatcttcctatgccatggtaacattatctattgatactcttatacatttgaacttcaaatacaattattccaacatataagcaatttgtttccttacaccatctaatttaattacaatttcatatctttcaatgtttaggatatgccatggaatgcagcatttcaatgagaggtaaatcacacaatgttgttaaacaactttaaataaacaatccacaagagtatgcctatatgtcatgttgaaaaataataataccatgtcgtacttgtttagcattcagtttcttttagctacttgaaaacaccattttaatgacaatatgttgatgatttgctactctcaggaacaggtgttcggttggcaaaggctggatttacagtgcacggattggactatcagggccatgggaagtccgaaggacttcaaggctatatcaatagttttgatgatgttgttgttgattgctcgaactactttgcaagtgtttgtggtatgttcagcataatttaatcaactagctagctagctcattatttgatttaggaaacaaataatttgctatcctgatgaagtttcataaagtttgtaaaactagacataactaaacttaaaaacaatgcactatttaaccataagctatcaaanccntgcactttttgtcaacctcggcttagatgcgaaatcattttcggtggttctctcacttatatggtgatggtgtcaaggttgaaattgtttttgaattttaaattttgaaaatgacttcacaattgcacattgtgtcattgtaaaatttattaattagtccttgagtgtatcgttgtaaaaaaattaattagtccttgagtgcatcattgtttagtctctatcactctgcggtcatcctgtaaggcataaaaaagatctattacaatttgtgtgcgcaaaaaaatgatatggttctttgttcatgtaaattgtagaattacaagagaacactaagtactccatccatatcatattgtgttgttttgattttttttcttagtcaaatttatttaactttgtccaaatttgtgggaaattgtagtaatatctacaataccaaattagtttcatcagaactaacatttaatatattttgaatatgtttatgttggaatggttgatatatttctttataaacttggtcaaacttaacaaagtttgattaagaaaaaagtcaaaacgacttataataaaaaatggagagagtatttgatttctcaaatgcttggtcactcaaaatatgtattttgagaaagaaaatcaaccatgctacaatgctcatgtatattttaattaatgtatttataaaagtggatttaattaaatttagacatatgttgtttcaaaaaaaatgtaaacatatatatataaattagcaacaaaatgttatctcaaattacttgtcagttgtcac

SEQ ID NO: 60558 - DNA, 5617 bp, Oryza sativa
ctcaccattgtcgtttctctctgtcgggaccatgttgttgtcggccgcgtttccattattcttgttttcttcgtagccaaccgccaccatcaatggatgagtcataatgtggaacacgtccggccaccttacttaccgccgttggtcgctggagcactgtcgcccatcttctctcatcttttgtttcttgtgttggctagggaagacgacgaatagtattagtcgttttttcctatgtgtttaaggaaaaaagaatcctctcgtccgggaacgtgttttgacacgcctgcatccagtcgtgttcaccactaaagctcgtcgttgtcgtttctctttctatcgggaccacatacacgtcctaccactttcctcaccatcgtttggtcactggagcactggcgcccatcttccctcctcttttatttctcgccttgagttagggaagacaatgaacaatgtctgttgggcattattccttcttagtctagcccaaccatgctactgaaccactcacataatattaagaccatatgagaatgaatagaacatgaaaaattctaatttatatcaattaaacaagcgaaaggaacaccatagaagatccaatattgaagacaatatcgatgcacgttatttgttaataaggttcagccgaagcctacatccccagagcagtggtcctccccaatcaagcatattacaacgtatccgaattacaattaatgattctcggccagacgccgccgacagccgatacctctcacctatgctaagtcatcattgtcgtcatcatgtttggatctcatatgacgtttctttcgcgtttggtttccgatgtattatcggggtcggttttataacaaaatcatttctcattatttattaaaaaacatcacacttgcatcagttatatttttcagtggttagcttgacatatatacagtccatcaatcctattgtttggggtccacgtggcagtggtagtgggtgtctggtggaaccgtgactagcagaaccaccacatcactaccatactagtgtttgggaaagagggacttcagtccctctcataaaagtacaagtccctactagtatgtatggtgttgtttgggaatgagggacaccaccaaagtaatatagatattagtgcgatttctgataaatatttcatgttttcaaatatgctagctcaacgtaaattatgacattatattacagaatatggaatcatgcatgtagctataataccaacgagcttaattatctagacaggataaggttgacgaaaaggatattgttattatttattttgttctctatatatgaactggatattaagtccagcatgtgtggttcagttaagtcatcgatcatgttaggacttaggagttaggaacaacaatacacactccgtaaagtcttgtcgattggttgcttgaaataagcgttcttcagacatacgttaattataacgattaatggatcgatggcaactacagatagaagtcttttttatctttatctttataagttggtattttgagtagttttattgttttttaattaaaccttgtttttagttcatagttgtttctatagtaccattttgtagcaaagaccgaaatattttttatcatcttaaaaagaaataatcgatgacgaataaatgctgtgcgtaggaatgagatcatctgacacgaaccatactaaagtgtgatccatatgtcacttttttttcgcgaacgcgtaaaaagattgcacgtcaatatgatccatatgtcagtgactgaactacgtgtctttacctattataaaagtttaaggtgtttttgccagaattttggtacgtcatctgtctttgaaacggttttagttttatgtttcggttttaatctatatgtctactacaataaattcttcttaaaaaaaagtaaaagaagtccgactaaaaaaaggtaaataaaggaagaaaaaaagtccgacttaacgagtgattaaaaaaaaagttccgtcgtcacttaaagagcgattaaaaaaaaagcttccgtcgtcgtcagtaaaaaaaaaaaaatctcttgtccgactatgtagaaaaaggaaaaaaatcttccagtaaaaaaaagtccgtttggttttttttggcaccgatatttttttcccttttttctttgcacgcaaaagagttttttatgcgcacacgctaaagcttttggttttttcttttttttaatccgatctattcaccgcgcacctctcgggtgcttttagttttttcgtcaatgttttttgtcacctgtttttttctcccgtatgctttttgtttttctcttccggttttataatcccatctgtttaccgcacgcctcccgaggtgaaccctagcgccgcgccgctgccataccgatttgtgtattttctcctccaatttaattgcaaaaatggattccccactcctcttatcattttctccatgattttcccttcgattcggctttaattgccagttttaatctctgttctatagttgccgatgatgacggcgatcttcctcggttatttttatcccgagttttatgctctgattttggggaaaacggaaagagtagatcgagtggattaaaaaccctcgaccaattttggtttaccaagaaagattcggccggatttgatggggagatttgctctagcaaacgtatgggcacgggattatcttcgggaggttgaagatgtagtcatattcgggaagttgaagatggtagggtcgaagagaagcagaccaaatggagggaggtagcggactagcctagggctgaaaaggaaggaaggctttcggtcaaaacccagaaaatattttcattaactttttttaattataatctatagcgattccaatattaagatttttattaactttttcaattataatgtatagtgatcccaatattttaatttattacttagctctcaatatattactgaaaaatgtttacccgttgtaacgtacggacatcttttctagtatataattaggtgagaggatctacttccgcacgcatacaacgaagggagattaatttttcatattcggcaatacgtacatgctcttttaaaattaattatgtgcttattaattaattttttttgccgcggggtttctttcatatacatgatgtgagcctatacatcatgcttattaattactaataacattgtttaagtagttaattgttctttagaagaagttgaaggtgcgtggctcgtgacataatcacaagcttaacgcaaagcatcatatatatcttcaacgttctttaaacgtttcttgtggtgggggtggtgaggcaaatagaccccacataactactccgtagtacatacaacatacatatatgtatgtaggaataggatggtatgagcatatataggatttgattaacaaaagaccgagagctagcacatatagcagggatggtaactaaagatttgttgtactaatttttttttggcagtaagtttttttttttaaaaaagaaagtagtagcataaaaacgattcgaactaccctgcgtaggcatgcacatacatacgtgcatacgtcacgattttgtatatagacatacataacagatgcaatgtcaacgttaattaattagatttatttacaaagatttggaagcagtaaaatttattttgatactcctacatgggttttacgcttgatattggttaatcaatcaatcaattaattaattgatgaggtccgacgcggtcagagacggttggtagagtcgtcgtctccctccttgtccttggactgcgtcgcgtgtttccaaggcaattttttctcctctcctctcctcagataattaattaattaaagaaagaaattgaataaaaatagtacttgtgtgtgaaaaagaaaaagagaagagaagatagtttgtgcgtgggctccacgaggagcgtagaccggagacgatttgccgagttggagtggagggagactcatcatcatcagaggataatactctacttactagtagtaggagagaaagaacaccaacattcaactactagtacaaattcaacaacaatggaatacactagagtcgggaaacagctttactagtcgtaaatttttctttctttctttcttgctttctccaccacgccaagtccacagccacctccattttctcctcctccattcttctcttctccacctctcctatcttcttcttcttcttcttcccaattgcttgccagattcaattgtagtggtcggtattgtgcaacaaacgcgggcggcggcggagatctgagcgaatacagactgaccccttccctgccttgccactttggctgatgtatagatccaacatctctcgcaagctgtttccttttcttgcttcactgggaaatttgagatttttgatcccccgatgaaactgactgggggttgcaattggattttccggggatccaaagtcgatgatttggaatgaaaaattatcggtttttgatgtgaaatgttcgtcctgtgtcattttttgcgatggtgcgtggttcgtagccgtcaattgattccccaatgcgtgccagccgctgacttggaccatcccgacgcgccccttgtgttgttgtgtctcttcttttttaaaatttccttctttccgtgtttatttaaattattattattattatatagttgttgtattggatgtagtcgggatggccagcctggactctcggttgtttttccccccaattgctgcaagtttcctctttgtcttcttcttcttcttcctcctccggattcaagttcaatctcctcccctcttttcacattgccacttatcatctgtgtcaaatttgttttgcaaattctcttttgtagctctctacttgtgagcaccgatcgatcgtctctttctttccctcgatttgttggatgtggtaatggaggtttgactgactgactgcctgcttctgcttggtcgtggtcaggtcgtcgattcggagcggtggccgccggcggaggtgctcggagtcggaggggtagcgtatatgtgacgcctgctttgcccttgccttgcagattgcaggccatgtcatgtgcccagcaagacatggatccaccaacaaggtattcccccacctctgtttgtggatctccctttctttttacgcatagatatactactactaattgcttaaccttcaatctatccatgtttcatcactcattacattttgacagtcatagcaatatatcttagaagccatatatagaccacttctttgattttcggtcttgcacacatgtagcctgggtcaatcaatttcttccaccatcaacatctgtagctttgagtcaccattcaccatacagacagaatttttattacttaggagtatttctgtaggtttaattcccgacaacctagctagctagttcgcctccaggtaagatggattacccttgaggaaagggaactccgttgcaacacatgtcatgccctgcaagttgctattaatttgctattgtttcactttgccaaaaccctgtatttattgtcttcctatgacctatgtgtctatttgcattgtgacccgg

SEQ ID NO: 60559 - DNA, 5813 bp, Oryza sativa
ctttccaaacaacacctaatcggataccgtttgacctctcaaactgacacttgactaactactgcataatctgtaactgcagtaactcgagttgacaaaccaccactcaaatccggcgctctactcaaccaatcctcatacaaactaaccagactaaagtgcttaaagtgagaaacaaactcatcaagtttagtgccaatccaaccacgtttgagcctccaatgaatgacttgatgaagatcgggtaagaatgcaggctagggtttttcttcccatcataaagagataaggcaatatccaccattgatcaacatatgaattaatggctcatatttgttggactttttcggctgcaataagctgatagtaaaggcttcatatggagagaaatttggcccaaccgtcagcggaaatgctaatgggcgatcgatctcctggagatgggggcagcgatcgatcccctccccctccctcccttcacctgttttccctttttggcaccgcattactttcctattttagtaaatttatgcacctaaaatttatacacatcaagtttacacatctaaagtttagagacccaatatctaaagtttagagacccaaagtttataagtcaaaagtttatatatccgattcaagtttgaatttgaattcaaatattttttatatatagtatttctatacacctaaagtttatagacccaaagtttataagtcaaaagtttacatagccgtttcaaatttgaatttgaattatatctaattcaaatttgaatttgaattcaaatattttctatatatagtatttttatgcatctaaagtttatacacctaaagtttatagacccaaagtttataagttaaaagtttacattcccgtttcaaatttgaatttgaattatatctgatttaaatttgaatttgaattcaaatattttccatatatagtatttatatacatctaaagtttatatatctaaagtttatagactcaaagtttataagtcaaaagtttacatacccgattcaaatttgaatttaaattcaaactttttatatatatagtatttctatacataaatttttctaacttttgttttttttaaaaaaatttttgtggtgtagtgtagtaggaaaagaagaagggggagaaaaaagggggagaagtgagaggaagtattacctatagggggagggggggccggatctaatcgcttgggtgatcgatcgcccattaggacccttcgaaccgtcagctcttcggttaggtacacgagacaacgcagcagaaagaaattaagggatggatatagaaacgtccacgtggccgcaggagattgggcgtcttatccaagctctgggctaccaggatcacacaataatacgtacatctctgagtcttctcttttttcattatacaaagtacctacaaagtatgatccgtattaatttcataccaagtaactttaatatctggcgcttctgctcccttagcttctttgtgtggatagatatatgaccgttttagcgattttaatgggattaattttgacctcgatcggcatatatacatccattcatacacgaacagttaattcagtacgaaacacatggagtagacacaagagtagaactaggatatatagcttattaattaactgttctttcaaatacatggagtacgtatttgacagtagtatatatgacacagtaatgcatgcatatatgacaccaaaatgtgatatggatatgattaagcaggtgcagcaaaacgtacattaattaaacaacaacaattaaccctcgggcacgcctgtgttttgttatctcgctcaacatatacgtacgtaatactttgcttgcatagcatagggacgacgacattatattcttaattgataaactcaagaacgcatggagatggatcgagagatttataaatatggagcttgcttgattgattagatgaggtcgtcctccttgtgggtctcgatgacgacgtcggacttggggtaggcgtggcaggtgaggacccagccggcggcaacctggtcgtcgtcgaggaagctctggtcggactggtcgatctcgccggagaccaccttgccggcgcaggaggagcaggagcccgcgcggcaggagtaaggcaggtcgatcccttcctcctccgcctggtccaggatgtacacgtcgtccggcacctgcagctccacctcgccgtccggtgtgatcagcttcacgttgtacgtcgcctgcatccgcagcctgtctcccagcttgttgctcgccggcagcaccgacacgcgcgccggcgccggcgccgtcgccacccgcagggacatcggcaaccggacctggctgctcagtgccgtcgccgccatggctgctatagctaattaagctagctagctgctgctgctaggtaaggtagacgaggaggagaggagtgagctagcaagaatgtgagcgtgaggttgaaggaggctgaggcaataagaagggaggtggagggtgccacgtggcgagcggcgactggttggcttatctgcgggggagtggatggggcaacgaccaccacacgatgcacatcgccgatgctgtccggccgtcttgcgtgtggtcgcctcgcttttcttttttgttttcttcttcacaccttaacttcttttgagcttttttttttaaaaaaaataatttgtgagccaatcacatgtacctccaggattcagatctggtatctctttttcccatggccgtccattgattttgtttttcacgagaaaaataattgaacaagatgtatgtgtggtcacacacattttctttaatttcttttgctatgtatatatgttgtccacacatacgttgaatcacaattgttagattgggatttgatggtcacgagtcttgcacaagatagagtgcgatgtgcagcctctaataattttgaactgctgcatgtgccttcttccttcctgttcctggctaggaactttctccaaactaacctaacctctctgtttttcttctctcttttttgagggccaggccaaaacttttgctttgtacgatcacatgcacgcttatatgatattccatgtaaatgggccggcccaatccgcatagccgacccgattccaagatacggcccatagaacactggatgcgatgaccagcccatcttgtctcttattgggcttgtttgttgacaggaacatccatctcatctacttctaggacacgatggaacctgcagcaggcagcaggtacatacaggagtgattgagtataaaaatatgagtggatgtataacaagagagtagttcatgtgctgatcgaattcgatcgatccaactctatatgcatgcaggaatatatacgcatgatcgatgattgtacatgatattttcaactctttaagttctactctatatatatatattgctactggccggccggccacgtgttggttacgtggtccttttgatcctcacacgacactatcagtgaacaaacacgttgtacacacacatatatacgtgtatgtgtaagcggaacaataattgattgatcaattagtagatcgagataactggagtagtatcaactgctgcacatatatgcatgtcaagcatccatcacatgttcacatatatataccccgatatgaatattgatcatccgcatgcaatcgaatcgcccttcatgtggtaggactaaaagacaattttacctcattcaattttatattacattctatttaagtcaaacaacaaaccaatttaaatattttgaatcatttatactgatagtatatgtgtgtgtaactagtacattgtatcgtaacaaaagaaaaactctccacagctagctgactcacatgcatgccttggccctagcttgttgggacgtaatacatatccgtgcattattagcaaattaatagcaattgattaagaaaatgactagctacacagattccctagggaggaaaaaaacacacatatctaacaattaatagacagattgatatatggagtgagagaaaaaaaaagatttacaaccgaaaagaaagaaaacatcgggaaagcaccactggtattgacgtatagtaatgtgatgataaagtcgtggatgcatatctttagcaaatatgtccatgaatacttagcaaatatgcaagtgaagcttgtaccatgatttgagtgagatcagatcgagatgtgctattggtttctgtctttttagtacatgttaggggatgcattctcgggtgtacgagtgtggtgttgcatgtatggtggtgtatgtacgtttattgcacaattgaaaaaaaaaagaaaaatcaaacatggattatatttcattagtgaaattaaattgtagctgggtgtgtttagttcacgctaaaattataagtttaattgaaattgtaatgatgtgactgaaaagttgaaagtttatgtatgtagaaaagttttgatgtgataaaaaagttaaaattttgaagaaaaaattaggaactaaaccaggcctaggtacggtcgcgtgaagattgctcggatccgatcgacatccaaacgtaccgacacggtcaaaccagggatgcgcgaatgtttcctatctatagtttgaccagcatgcatgttctaatgttttctattcttccggtagccactactgttctattttcctatttcattaatcaatatactaataatgactaagcatatgcttcccacccggccctatccaaattccaatctcaaccaataattaagcaattaaccaatgagctatatatgagatttttttattgtactagccaaactgattaattttaattgttgcttttaatcatttcactttgcttgtaagcaattcatcgatcagttcgtgctttgcctgcggcctaccctttttgttgcccggcactactcccaggatatatacggagtatatgccaacacgtaccatgcacgtttcttcgttttgtattctctctcttcgcgtgtgtgatccagttgccttcttttatccgacaagattaatcttcatcacttttaaagaagaaaccacgtttaaaattgctgattttttttgttgaaaattctctctgtgtctctagtatttcaagtgctgatctcgtggtttttttactcccctttgtcacaaaacatgcatgtactctgaatgccgcatctatattgtttgaaaatataacattgactactactacctccgaggacaaagggagtaatttgtacctaattaaaagcaaaacattttaaaaccaacaatattataatactatcaaagtatttttcatgacatatttaccacatgcaactttctaatattggaaaaataaacatgtttagagtttttagagtttaacttgagacatcaattatgataaatttatattacacggggtatatataagactacccacctacaacatatgcgaaatatgtaacttttttttaataatggatatataaagttggtcattgtttcaactgaagctacaaccacctattacaaagttttagttcgaaggccaagcacggtacaataaaaccatgatagatgaaaagactggtacaacaacaccaaccaaagaaaataagcaacttatttaaagtttaagtttattccttaatctccatttaaaggtaatgaagatatgtatgatgattgatcctaaatttcgaccgcagcaatgcgaaatagctagcttgttttgacagggatttgtatatatgctatgcatcttctggattcctagttgccatcgtttgtcatga

SEQ ID NO: 60560 - DNA, 2480 bp, Oryza sativa
ctattcgaatagccgtgcccgcgggttatgggcgagttgagcaatgtttttcgtgattagtcccacacctctcacaataattatggatgttatacctgataataatttgcttagctcctggtttggagattagatctgtacagccgggtatggttgttcaggatggttgggcctgtgcagcatgggtgtgctgttcagtgttgattaaaattcctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttatatcccagttgagctgcctgtgggagtggagccggagcttcgctagattttatttttccgctgcagttttcttcttgatgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgggcgtgacaagttggtatcagagccatctcgactgtaggataagccaaatggtcaaaccttaaggacaaattttccgaaaacatgatttgtgaaaattttcctttcttccttctctagaattctctataaatcattttatcatcctctcccctcctgctttcaacttgagtagttctaaaactagttgttgaaactagaagatgttaatgaggtctacttatggaggtcagtcaagtggatcgagaaagaaccgaagtgccaagtggtcaagatggaatgaagtttggatcctaccttagaacctatgccgccaaactatccttgaagaatagttagtagggtagaacgtttgttgcttgcttgtgtgtaggtatggttgcattcccgtcattggtgtggttcaatgatgagtgtgtaactatactaggttgcttgcttaatcaacttgaacaatataatggtctacacacaccagatcagtggtaacatggttaaggtcttaactttagcgtaacccctctccttctatcttctctaatctgcaacggatggtgaacactcgcgccaataaaagtggaaataataacaatgaagggaacccaactcttgctcaagttctggctcaacagactcagttaatgaacatgatgatacggatggagatggacgaagtcgggggtcgatggacatctctaggacaaatgaaggctacacgagctgcggcccggtagtcgagatgtcatggcacagggccggtgtcctgctgctcggggctcagtcctgcctacctgtcccgggggtcccggctgtaggtggggttgggtcggtactcttgtctatggctaggatgggttggaagctatgtcacgtcttccgtccatataccgtggtggtatgtggcacgtggttacacgtgaggaagaggtgtcttgtgggtaaagatgtacaccctctgatcagagtataatctattcgaatagccgcgccctcggttatgggcaagccgagcaatgtacccaagttagtgttttaattcttaaaacatgcttaacaactaaaatgtggaatggttggcctgggttagcttgggacgagctgggacccagggtcgggttgctagttcggtctgaatcatcgtaggccttgggttaaggcaggttcgtgtgggttcacggccttgattaataatattgtatagctctagaatcgtgtttacaaaatagctttgagcaattaagtgtcttttaatgctgtttactgcaaaccctaaccctttatattataacccccttgtactcccttgcatttattctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctatggtcgtcgccctagtcttctgctgtttcccgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaagaaacgcccgttgggttaattccggtcgtgacaggtcatgcaacaaatcataaaattatacatcttagtgaatcacaaattgaaaaaaaaaaaaagatgccggcagcggctgccgcctgccgccgctcgccactgggcccgtgcgcggcccagccggccgcctgctgcgtgggaagggaggagggggaggagagggcaggggatgggtggggaagggga

SEQ ID NO: 60561 - DNA, 23583 bp, Oryza sativa
  unsure (1)..(23583): unsure at all n locations
tgaaacaggtgtagtatgcatatagccagcagttcatcacagacacaagtacacaagtaacaatcaggtatcttgtatgacagttcacatcccatctggagtgtatatattagatcagaaaacaaaagtacaagactaatagtgatagcagcctctgcagcatgggccctacatgtcagcctctcacacaaagggggcactgttcttgtcggcgaattctgcatatctagcatctattctgaaaccctgttcctactgatcaatatctacagtcatagaatcctgttggacttggatcagccacctccatcatcctcgcaatctcttccaagtacccatccttgtagaaatccgcggcggcggcggggaagccatggtcgttttgatggaaggcgatcgtcatcgccggcgagctcagaggcttctgctccggctccggcttcggctccggcggcgccatttgtagggagccccattgactatgaagcttgtggtggctgtggctgtgatggatgccgtcgttgaagaagtagccgccgttgcagctcatcgtgctcatcatctgatgacggccgccgtgctgctgctgctgggagatggccggagtcaggccgcagttcatgaactcgtcgccgccgccgtccgactcgaagctgccggtgttggagctcgagtcccccggcggtggggccttgacggtcaccgtcgccggcggcctccaggcctgctgctgctgctgcttcctgtaggtgatgcttctcttgaagattctgcagatggtccagacctcctgcatttttttcagtcagaagtgcacaagttagaggtcaatgctattaggaggctgtactcttatcggttagaaatggcaatcggtagaatactagaaacacgtcagaacgtgagaggatgtccagtactcctttaaaacgtgggaatttcagtaggactttcacatggattagttcaatttttgtagaattttcgcaaaatttcttcgttcaaaaggaggcctgtaatctcgaaagaactgctgaacttagcttgaaaaaaaatattaagacgatttggtgatgtaaagtattgcagatgatattgtactccacactatcaaattgtacgtagttgtgatctgtcacagatgaggagaaccggatatggatatggtgtgtttggttgctcgtatccctctagtctgacccatctctctcgtccaggttgagtctgggtaattctccatctctctccaggctgagtttgggtaattctcccattacgaatgcacttcttacgtacatgggatcgagtacacgaggccttgacgacgatggagaaggagaacgaacgagcatgagagcatgggagtgcgtgcttacagcttcttgcatgcacggggaggcgtcggcggcggcgatcgccggcgggaggcggaactcgtgcatcatccagtcggtcttggtgcccttgccggcgctgccgcggtagtagacgagcgacttcttcagcccgatcgactcgccggagttgctgttgacggcggcggagtagatcggccggtcgatccccgtcgccttccagaacccggatcccgtcaccctgttgggcctgatgctgttcctgtacttcctccctctcaggcagaagaagtaccactccttctctccacctaccgtgctcgcatctgcacaaaatcattccattcattcaaacacaaacacagaatttagctcaattattttgaaaatgatttgtgtttgaggttatttgtcaaattaattggggatgcacttactggggagatcccatggatcgtgcttgtagatgtccatctccttgatgatctctatactgagagacttcctcgccaccttccgccggaggtagaacgtgacgagctcctcgtcggtcgggtggaacctgaaccccgggagcaccacgtccccgtcttcttcctcgtctccggcgagcaccacctcgccgacgtcgctcttgatcttctgatccatggccgcctgatcccttgcaaactccttgctggtcaccatctccacgatcgattataattgaacctacgtgttttcttgtgttcttgctccaacaattatctatgaagatatcttctctgatgcaatcttgtaatggttgtaaatggagctctagctagctctcttgagatattggcctttctttgcaaggagcaaagctagctatatatatatgagtgtgaaggagtccatggagcaattaaaagggtattcttctatggctttataaatgcatgagagcttggtccaagtcatgcactgatcgatcgatggggtttgaatcctcttgctgtcttgacgaatcttcagagcaacatcatgccttttaatttgtacaaagctaagctatagtttgttactatacgctatccttttatgccttttaatttgtctgcgagaaaaagcagctcaaagttgtacttgcatctagctaattaagctacatgtcacctcaacagtggccatccgctggtgcctgactacctggtgatcatgccacgtccatgtcgttgggtgtaagggtgccaagaaatcaaagagccgatcgatgatatctcttcttttgactgagatactgttcaggggaaaggagttttttccccctaaaaagacaagggatttgctagttttcaggcggctaaaaaattataattttagtcgtattttaaccgcaattttgttgttggttttattttaattttacataatttgaattttttgcatgtaactttgtacacttttatgggttaatgtttttcatgtagttttgtaaatttttgtatgttagaacggtttattgttcaatcattgagagtgataagtaataagtagttggtgagtaatgataaccattggattttcatcatccaagtggtagaaaaagtgatggaaatttttgaaaaattcagtcgcctgaagtgtatagacactcctaaaaacaaattattgtggaattcgatgtgtttttggtctgaattttttggttaagataccttttgttattttgagatgtagtttaaggcactttcagatatattaaataaggctgaatttttttcattcaattttgtcctttgagttaggggagggaattcgtatgtaatggacgactaacgacttctttttttgtaatgacagaagcgattattaatttacaaggttaaggacagtcagtactgtaattgacttatttgttttaatctgcaaaacatcgagttagtaattaagaaccagaaaagtgtgtaaccggagaaaaaaagaaacctcttaagtgacgacattgtaattaatattgcacactaatgtggtgagtcgctattgttgccagataaaaaaacattatggagtatagcaggcagctgcattgtcatcgttgacagtagagcaagcgaccaataatcagaaagcacgcataattcttcgagaagcccttgattattagcagatgaatatgaaacggggcatcatgaaccatatgttctaattgtctatagtgtactgtggatgttcttgcactacggcccttgaaaagacaggaccaatatgtagttttttcatgtgtttgttccatctgcactgtactcatcggagcctatacagaccgtaggactgtaatatactcctgcataacccatttgattattttcacaatacatatatatagctctatttatgagcatcagaatttatacttggtgagttaagtcatgtgccaatcaaagactctaccatcacacgaatggtactttcctgaatgtggttatgttatatcgttttcaagggagcaatcggctcactaaataatttggccattcaaaactaaaatatttttaaaggtattttagttgaatttaggttttgatcagatataaatgtgccaataaaagattcaactcttgtatatctaaaggtttggcgtcagcttgaaaatgatcagcaccatagccgcagctagagcacaaattttagttaataccgctagtataaaaaattcaattgcaataatgagtaaaaataagttcaatgttttatagcattttcttcagcagcaactattttgacactctctatggcatttgatcttccatatagcaactattttgacactctctatggcggcggggaaggaggagtccaggtgcggacgcgccgtcgacggtgggaacaattatgggcggtggccttggccgaatcgctgaagggacaatgttgttgaccgacgacgatccttcttgtgcggattggtggtgtgggtttggacagggaatcgcgggcgaaagccttgccgagccatttggccggctgacaacggcgacgccgtttggcgtcgttcccctccttggaggcgttgttttagcatacccctttcctttccctaccatattctccgggtgaaaaccttgcttcggttccgaacgagcggtggcggcgatccacgtcgcatcctccttgggggcaccgctttggagaaacctcttcgtgcaaggatattgtcattggtttatgcattggcttcgaactttagtcataggcctggacgaggccttctagctccacattttgttttgcatttttcaatttgggtcctctcttctcttgtttggtgtgttcaacttgtcttgaactacactctcttctggagtggatctttgtaataataggctgtagttctttttaagcaaaggccggaatattatattccattatctaaaaaaaaatatagcactaggcttatgggtggtgatactcacatatcagtgatcacattcctttaacttcacgccaaaggatctcaatcctacgatcagaactttgataatcttatgttgacaagtggagacacaatttactaaaaggcactccctccgtttcaggttataagacgttttgactttggtcaaaatcaaactactctaagtttgactaactctatagaaaaaatagtacacaaccccagcatagtttcattaaatctataattgagtaaattttcataatatactagtcttgggttaaaaatattactacttttttctacaaaattagtcaatcttaaagtaatttgactttggccaaactcaaagcgtcttataacctgaaacggagagagtattaaagaatgtggcatttgttgaagacacagtaaaaaaccgtggtactgttacacaactctttaaatttgtttttactctactatatattatattggtttctattaaagtaatatatttggtttttaggagagacaaaactaaaaaagaaatggcctctacaccactcttatgtagtcttcccctattttaaatagaaaattggtcactacttagacaatcagagacataactcatgtaattttttttttctggttgcattgcatagagtcattcaaataataacaattaataacatgaattcaccttctttaatttctaaatcagtttaaaatcacctataagtataaccagtagctagcaaaatctggctttgtctacaggagagaaaacagacaagaagggaccaaaacaccaaccataggctgtaggctgtgttgaagaatgttcagtgtttttgaaagggactccttttcaagcctttgaaagggactaccattatgaatttcaaaaaaaaaaaagtatgaacctcatatttttctatggcccatcgggccaggtcaaccgccgcactgtccgcctcctcattgtggtgggccccactgccacgtatgcacagttcttcctagtttcaaccttcaatgcacgtgcggaagactctgggtgttgtagccactgaatcacatccttgcaaatccctagctagccttccttcctggaagctagtgttgggctcatagttatttcaagtttttttttaacaagttcaaagtgactttattgttggaaaatttgatgacataactagccgaggtgatatcaatagtacttctattattattattattattattattattattattattattattattattattattattattattattattattattattattattattattattattattattattattattattattattattattattattattattattattattattattattattattattattattattattattattattattattattattattattattattattattattattattattattattattatcttcttgataagtgtggagattatggataccccatatctacatgacggttgtaatttagtcggatatacagtaccaaatatagatggaatatctctatgaagactcgggttaggttctaaacttgtatgtcaaggaaatacccgggatcttagtcggttacgattgtattttatctataattccatattccgttaggatatggactgtattttgtaaagcggactccttcccctatataaggagggtccgtgtgcctcttggggggcgattcttttttccagtttatacaatcaataacatactcggcggaatcatccccggacaggagtagtgtattacttcttgaacgagaaggcctgaacctgtataaaattccttgtctccaaacccatccactttcctagcttgatagccacccccttttattattgccgaaatcttgtttcgacagttggcgcgccaggtaggggtagcgtcaagtttttgccgactaagtgcgatgggttctgtttctggcatcgacgacttcgccttccctcccgggcaggcgttccggttcggcagcctcaacttcatcaccaacgacttcggcaagatctctctccatgactcggactcaaaccagtcggggagaaaccaggtccccgtgccattcggtattctgaactcggccgaggcctactctaagatcatctctcccgagtcggctccaaaccactcggacgagatccaatctactcttccgcggccggatcaagacgacgggtcctatccctcaatcctgatgaaacttcctgatgatttggccgctgtcttcatcgccaagacatctcccacttgaagatctaggcgagctccggcttcggccccaatccaatctagatccagagaggttggcgttatactccaacctcttgggacagtctcgacggaagatttggatggctacctcagctcccccggcgtcagttctcgaccaaccgagatcctcgactacgacgatttaggctaccactacaaccacggcgacctcgacaacttcgacgacagctatgaggataactacacacccctcttctttggcgtattcatggctgacaacgaaacggaggaacagcgtcaagcccgagaagcggaccaagatcgcgcacggcaagaagctgaacgtcgccgactggaggaagagcgacagtgacaggagcgagaacgactacagcgtgaacaacaagaccgcgaacggattgcaaaggaggctgaagatcgacgggaacgcgccttggaatctgggcgccgagcgagagagctcattgggcaacaagacgtcgatggaacagcggtctttcgcaccccccagcagaacgcggttgcagcaatcactctcctcgataccctcctcaaggaagacgcactcaaccaagccgatcatgttgtcaacatcttgaaccagatgaagaccatgatcgctgcctcggttccagccaactccgcaagcacccgcaccccgactggtagccgagtccctcacttccgatctcatgattatcatcagccaagcctcagcatcatcggcacaggatctagtcgcaggagcaggggtcacgacgaacgatctgttcactcgcctctcgaacgtcacagggagcgccgagtcgaacggcctcgctctccacctcaccagcgtcccgtcgaccttcgcgacacgatcaactagcgccgtgcagcacgaggtcaccgccattcaccaaatctctacgacgacgacgtggatggagtagctgccttcactaatgacctgcgtcgagtagattggccagccggctttaagtcgactggaatcgagaagtatgacagcaccactaatccggagtcttggctcaccgtctacggactcgcaatccgcgcagcaggaggagacagcaaagccatggcaaactatctacctgtggccctagcggactccgcccgatcctggctccacggactacctcgtggcacgatcggatcatgggcggaacttcgtgatcacttcatcgccaacttccagggcacctttgaacgccccggcacacagttcgatctctacaacgtcgttcagaagtctggagaatcccttcgagattacatccgacgcttctctgaactacgcaacaagatctccgacatcaccgacgacgtcatcatcgccgccttaactaaaggcattcgccacgaggacctagttggcaagttcggacgtaaacctcccaggacggttaagcagatgttcaaaaaagccaacgagtatgccaaagccgaagatgctattaccgcgtccaaacagtcgggcaccacttggaagccaaagaaggacacgccgaccgcaggagggagtggaagtaacaaccacaaggatcgcaagcgtaagcctgaagaacttgtggcgaccacctctccaccttcccgacaacgttcccgcgtcaacaccttcgacaagataatgaactcccaatgtccgcatcatcccaactccaaccacgtggccaaagattgcttcgtctacaaacagtttgcggagcaatatgtcaagaacgcgcgtaagccctcagacggagatcaaggcacatcaaataagaacgatgatgaagacgatgccccgactggttttcaagatcatcgcaaagaacttaatcacatcttcggcggacccctggcttatgagtctaagagaaaacagaagctaacagaacgggagatcaatgcggttcagcctaacacgccccaatatcttcggtggtcagagactgcaatcaagttcgaccgctcggatcatcccgaccgagtggtccacccggggcggtaccccctggtactagacccagtggttcgcaatgtcaagctccgacggactctcatcgatggtggcagtgcactcaacatccttttcgctaataccctggacgatatgcagattcctcgcacggaattaaagccgagtaatgcacccttccacggtgtcatcccaggattgtcagctacaccactcggccagatcacgcttccagtcacctttggcactcaggagaattttcgcacagaaaatgtctgtttcgaagtcgctgatttcgagacagcatatcatgctatacttggacgaccggctttagctgaatttatggctgtcccacactacacctacatgatgatgaagatgcctggtcctcgaggagtcatatcactacagagtgacatcaagcaggccgtcacatgtgacaaagaaagttgcgagatggcccaaacccacgagattactctcgcccgtgaagagatccaactggctgcgaccacggcaagcgagggagaagtgcctgcaaccaagctgacgaagaccgatgaaagtgatgccaagacgaaaaagattaccttagatccctccgatcctgataagactgctgtaataggcgctgagttagattgtaaataggaaagcgcgctcatcacctttcttcagaataataaagatatttttgcgtggaaaccatccgatatgcctggtatccccagagaggtgattgagcactctttacatgtcaaggaagacgccaaacccatcaagcaacgactccgccgttttgcgcagaacaggaaggatgcgatcaaggaggaattaaccaagctgttagcagtaggcttcattaaggaagtccttcatcccgactggctggctaacccagtcctggttcggaaaaagacggagcaatggcgcatgtgtgtcgattataccgacctcaacaaatcttgtcccaaagacccttttgggttacctcgcattgaccaggtggttgactcaacggctggctgcgagttactcagcttcttggactgttattcgggatatcatcagatccgactaaaagaatccgactgcttgaagacctcgtttatcacgccctttggggcctactgctacatcaccatgccctttggattgaagaatgcaggagcaacctatcaacgcatgattcaaagatgtttttcaactcagatcggtcgtaatgttgaagcttatgttgatgatgtagtcgtcaagaccaagcataaggatgacctgatcgcggatttggaagaaacttttgcaagcattcgtgctttcaggatgaaactaaaccctgaaaagtgcatctacggagtaccgtcagggaaattgctcggatttatggtatctcaaagaggcatacaggccaacccggagaaaatcaacgcaatcctcaacatgaaaccgccaagctcccaaaaagacgtccaaaagctgactggttgcatggcggcgctcagccggttcgtttcacaactcggcgagcgggggatgcctttcttcaagctgctgaagaagactgacaatttccagtggggacccgaagcacagaaagcctttgaagacttcaagaaacttctcaccactccgccagttttggcctcgccacatccgcaagagccgctgctgttgtatgtgtcggcgacctcccaggttgtgagcatggtcctggttgttgagcgagaagaggaaggccatatccaaaaagtccaacgaccaatttactttgttagcgaggttttggccgactccaagacaagatatcctcaggttcaaaagttattatatggtgtcttaattaccgtcaggaaattatctcactactttcaaagtcactcggtcacggtggtcacatcgtttccacttggggatatacttcataaccgcgaagcgaacggacggattgcgaagtgggccttagaattgatgtctttggacatatcgttcaagccacgaacttcgatcaagtcacaagctttagctgatttccttgccgagtggaccgagtgccaggaagacatgcaagaggaaaagatggaatattggactatgcattttgatgggtcgaagaggattacaggcactggagctggggtcgtcttaatttcccggactggagaaagattgagctacgtattgtggatacatttttctgcgtcccataacgtggcggaatatgaggcgctactccatggattaaagattgcaatctctttaggcatttgccgtttaatcgtccgtggagactcttagttggttgttaatcaagtcatgaaagagtggtcaggtctagatgataatatgaccgcttaccgataagaggtacgcaagttcgaagataaattcgacagactcgagctcacccatgtccttcgacataacaatgaggcggccgatagacctggccaattttggttcaaaacaggaagcagccccttctgatgtgttcgttgagcatctttatgaaccaaccgtgcccagaaaagaaacaattgaagccatggatactcaaggcgtaagcatgattgaagccgactagagagaacctctcataaaattttttactaaacaagaactccctcaagacaaaaatgaagccgagcggatctccaggcgcagcagactttacattattcatgaagctgaactatacaagagaagtccatcaggaatactacagcgctgtgtatctttggaggatgggagacaattgctgaaggatatacattctggtatttgtggtaatcatgctgctgcacggaccattgtcggcaaagcttaccggcaaggttttttctggcctacagctgtgtctgatgcggacaagattgtgcggacatgcgaaggttgtcaattttttgccagacaaactcatttgccagcccaagagttgcaaaccatcccgttgtccaggccgtttgcggtctgggggcttgacatggtcggcccgtttaaaaggggcagtcggcggttacacgcatctctttgtggctatcgacaaattctccaagtggattgaggctaaaccggtcatcacgatcacagcagataaagctagagattttttcatcaacattgtgcatcggtttggggtacctaatcggatcatcactgataatggcactcaattcactggcggagcatttaaagacttttgtgaagacttctgcattaaaatttgttacgcctccgtggcacaccctatgagtaacggacaagtcgagcacgctaacggcatgatacttcaagggatcaaagccgagtttttgaccgactacgtccctatgctggtaagtgggtagatcagctgccgtccgtgctttggtctttacgcactactcctagtcgggctaccggccagtcgccgttctttttggtttacggcgcagaagcaatgttgccgagtgaagtggaatttgaatcactacgatttcggaacttcaacgaggagggctatgaagagggccgagtagacgacatcaaccgactagaagaagcccgagaagcagctttaattcagtcgactcgatatttgcaagggttgcgccgttatcataatcggaatgttcgatcgcgagcctttttagtcggcgacctggttctgaggaaaattcaaacaacacaggatcggcataaattatctcccttatgggaaggaccgttcataattgctgaagttactcagcctggttcttatcgactcaagcgcgaagacggtactctcatcaacaattcttggaatattgaacaccttcgtcgattttatgcttaggcatcttgcttgtatctttcctatttgactgctaacttcaagtttttccttgaagttttcagtcagggggctattatgataataatggagtgtgatttttatcaattcaatttgcttacttgatgtatcattgccctgtttgatttcttggcttagtcaatgaggactgaaagttttttaacaacttttgtgggttttaggctcaacaaggtttgacaaaaacttataagaaatcaggagctaagttaagatatcaagcacagcataaattcatcagtattgtacaaattgtgcctccatcatcattaatcatcaaaatcattggtacattaatcagtataagttttttcatcatcagacttatcagacccagtcggccgaaggtcgacatcttggaatctctcaactacatcagcagcaattttgtcagccgctttctgcgcatcactgatgaggtcaagagcagcatcttcgctcgtcccgtctgcaaagccatcaatggcatcaatatcaactcttggataaagggatttggtcatcgccaacgccagacttgctcccatacttccagcttctttgatgttcttgaaataagtatctggagtgactctcagcttgtcgaagatttcggcagcatcaagtgtactcgaaccagcgttattgaaaaacatcgcttgaacaattggggcaacagcgttagcaacctcatcccgggctccttcaagttttttgatcttgccaactaggatgtcaaattgagcttgagatttgatcttgcggtctgcatcaacagattcacattaataagtcagtatatggaggataatggctnttgaggtattgattgttgataccttcaacttcctttaaagccatttctctttgtctcgccagttctgccttgtcattttccagaatttgaatctgcttctccaactgagatatcttggcagcttgcactacattgattacggttaatcaagattgcaaagataacagtatgagtcagttgagcagagtttgtgcgtaccttttgatgagccactcagttcaaaatttgattcctgcagctcagcgatccgatccctcagatcatgttcattcttcctggcaagttctttcgcttcgtgcagttgattcctggtggcttcgagggttccgagatgagggactaacctctctaaggttaccgttttggcttcgttcctaagatgaatcctctgcaagacagtttaattagcgcatgaattaaatggcaaacaagatggttgagatcaggtaccagagggcttacatttacaatacgggttgcctgaccaagtgccttcttcagtaggcataactcttcgtcctctttttgcttatttatcacgatcccttgaggctgcatgttgtcatcccaccacttgaccagaatcggagggcgtgaatcctcagctgcttgtatccggaggatttcttcttcatcaccaattattggccctagtgtatccatgaatgaagatgaagcagctaaataaagtctattggatcaaaatgatttcagatagcgtgtctacctgtgatgattcccggtcggggacgagtggactttggtgtcttcacaggagatctgggttctgattcactgtcagcatccttcccgagaggactgttcgtttgagcttcaacctcgggaaccttttggcttggccctgcatccgactggtttccagtcgggggctcctggttagcgccgacttcagcttcggccgactggttcccagtcgggggttcgttgctgggttctacattgttggttgccgactgcttgtcactcggatgatcctcaacagatggcccggtttctttggaagagcttgtgtctatgttggtcgggtcagagtctttcccagacggatctatatcagatggtttcctgcaaatttgattatcagtattattaccgcaatgggtgcgcatcaatgcaaggaagatcattatatgagttgcacctggaagacttcctgatctttggcacagggcgactagatgttttcttccttggagtagcttgttttggtagtttcttggttgtctctcggtctccaggcctcctggtggtatcatcggcttcgtcgtcacttagaaccagcttcctctttcgagaatctggatggccgactggatcagaagcacttggttgagttttagaccgaattcttggtcctccgctcccttgcccagtttggtggcggggagatcggcgttgagcgattgggggatccgacttcattaaagcaaattcctgggtgtaatatccttcattgttaactggttcaacaagaaaacaagatcatattttgagaaaggttgaagtgtatgaatacgtaccggtggaggaggattgaatgcattgaacggtacgactggcagcacgtgtgagtagctgacaacgatggcgtttgagaagatcttatacattctctccttcatgaccttgaagtcaagagaatctggatcttcacggtttgggtcatgcttgccgtcaaattcgaaggctgtgcgagatctttctttgattggagctaaccgacacttgataaagtgccgggtgatttgttctccttgaaggccctgttctttcagctttatcatcctctccatcaattccactgcctgagtagcttcatctcccataggcaatgagttccatgtgtcctggtaaaccggaggaagatagcagtactcggggagtgcgggctcaggattttgaacatagaaccagcttgcatgccagcctttgtttgaggttttgaagggcatggagaagtatttttggcttagtgttcccctgagttggaaaccagcacccccaacaacgcacggtttgcttttgtttggctggggcttgaggaagaagatgcggcggaacaaggcgaaatgaggcctaatgcctagaaaagcttcgcaggcatgaataaaattggcaatgtgcactatggagtttggattcagatgatgcaagctaatcccgtagaagttcagaatgccccggaaaaatcttgaggttggaagagaaaatccgccatagaagaaatgagcaaataccacgatttcgtgtgtgtcgggggtcgggaatgcctcaccaaatgccggtcgccacccgatgatttcttttgctggaagaacgccgtgcgccaccatctccttcaaattatcttccgtcacatcggagggcgcccactgactctcgaagctttctctttcttccgccatgaatgtgaactggatggtctgatttagttcgagatacggctgggaaaagatggggaatcggagcggtggatgcagggataaatttcgtgaagtttttgagggtggattggagcggattggtgaaccctagtttgcccggcgcagttttgcactgtagcaagaaatggggaaaatggcgagagtctcagcagggaagacgaagagacgtttttcacttcggtgttattagggtatcgggagtactaatgggcctgggcctgtacagtactttagcccagtcttatttccagcgtggcccgttgtgatccttagggacttaggcactttttgctttggcaatttgtgttcacaatgatgtggctcaatgctgttaaaatcctttttagtgtggtttgataattctttaagaattaacacgatgcaaacaaaaggtgcccgacagaaaggtgttataccgtttttgaaagctttattaggctgcaaaggctgtctgggttgatttgagatgactggtttattaatagtcattcttttagcatgttatatgcttattttggttatggtaagggtcacagcctaggctattggactcattaattaccatgattttctatcctgtttggtgggttattttatgagattttttactcggattcctatcaaacatgtctatttttggaccttttgagtgtttatcactcggcccttcttgtattttttgtccttgatatactcaagttgagaagcagtcggctgggtatcttactaagtaccatacgtgcttcgctataaaaccactcggttcttgactatatgtttagtttttcaactaatcacatagtcgggggctacacctaattaggtgcatctactcgatgcaccatgttttattttcgcccttcacagtttttgatttttagtactcggcaagctggagcaagttgaattgaagcactcggactactgttttttgtttcgagaaggctattttgtcaactgcgaaggtctcgggggctactgtggagattatggataccccatatctacatgacggttgtaatttagtcggatatacggtaccaaatatagatggaatatctctatgaagactcgggttaggttctaaacttgtatgtcaaggaaatacccgggatcttagtcggttacgattgtattttatctataattccatattccgttaggatatggactgtattttgtaaagcggactccttcccctatataaggagggtccgtgtgcctctggggggcgattcttttttccagtttatacaatcaataatatactcggcggaatcatccccggacaggagtagggtattacttcttgaatgagaaggcctgaacctgtataaaattccttgtctccaaacccgtccactttcctagcttgatagccacccccttttattattgccgaaatcttgtttcgacgataaggtaagtgtgatgtgctcatgtgcacacatcatatacaagtctatccatcagccatataatagaggtgaaaaattcacgttagacgatattgatagaacctcattcttttctgcttatttattggattattttcgctgattatttccttcgtacttcttaaaaacaagatttcttaaaagaaattgctctactagattccttgaatctcttgttcaagttcataatatataatatttagttcttacctataaccaagtactagataatgtaccagcttttatccacggaaaaaaaataaaaagaatactagtatttcaccacataaataacttgtgatcaatatagtatcttttttaaaatatgtatatatatatataattaggtgtattcttgtgtgcttaattagggggaccacactctagtttattggtttatactattactatacattgtgcacaccaaaacagtataaaccatcaatgcatgtttatagtactcataaattccgtggaaaatctaccggctcaaaaaatctcaaatgcactgtaatatgaccttgctacatagtaataacttgttggttgttgcaaataaattcttggtcgctccaaaacagcttactgtcttcctaaactcaccatagtttaattcttatggtactgtcatgaataaacatgatttcagatgtcaaagagaaaaaaaattgaggcctggtacaaactatagaatggtttttagcaaaatctggagaattgtaaaccatatgtgttgcagtggaaatggactttcatggtaccgaagcatgcatatataaataagttactttgtaacatcatatcaatattttctagttgaaattatggatctgaataagtttagcatttattaactaggaaccattccatcttctggcccactttatcccattatcttaaccatgcgaatgttgaaatagagatatatacactactcgtgcaacttgactagcagaggccactttgacaatttttggatatgtttatattttatctagattaaagcttttacagtttgctcttttcccgttttccccaaagttttcatagtaaaatttaaaaaaatctctaattaataactatttggtctccaatgttcttcttccctttggatattcttggtcaacaaaagcaaccatgttagtgttgtgtgacacacaaaaggaactgtgagggtggcatacataaataataggtctgaggagtggtgaatcgtgtggtacatgatatagatactcgatacatgatagcgtgaaatttctttggtaaagtttttaccagcgccagcggcatattttttgggttgtcctcaaagtttttcgttataacctttataaatcaattgtactagatcttagatgtccattcacttcagatattttttttcaataaaatcgaacatattttctttagtgaaccggcacttagaggtgccaataaaatcaaatgtattagtgctccacgacataaagaatatcgttgttacggaagtgtcatacacataaagagtggcggattgcggatacatgataaagacatacgattccataatggtctagaacttttttatgtgatagatgtggttagggatttccaagtcgaccatcatcaccatacgtgataagtagaaaagataagtttacgaatcattagatcgagagaatatttatctcattctcaatgcgcacgcttctcgaattattaacaatccgttgtttgtaaacaaaaataaatagaaattgcttttaaaaaatatattaatctattttcaaatttaaaataattaatactcaaataatcctacgctaatgactcactcttatatatcttctcaatctcactcttctcctctaacactcccccgagtaaaaccgtacaatcaaggtcagtaaaaaccacaaagaaaatcccatgattgacttatatacacgcacgcacgaacacatgatgtgcgtaataccctatagtactactccctccgttccaaaaaaagacaaaccctgttttccgtgtccaacatttgaccgtccgtcttatttgaaaaaaatatgaaaaaattaacaagacaagtcacgcataaaatattaatcatgttttatcatctaacaacaatgaaaatacgaattataaaaaaattttatataagatggacagtcaaagttggacacgaaaattcagggtttgctttttttttttttttttgacggagggagtagccgacaattgcttaatatccgtttgcttcttggaaggtgcaacacaaaaaacgagactttgggatctctacgttcccatgtactagtacaaactacacactagctatgcaaagattggcttcatgtccttatcaccatgctgctagtaaccattagccaatgtagcatcaggaataaaaaaagttttttttttttgaagacagaataaatcgctttgttgcaacatgactgaagaaaagacctttcttcgtcctctgatctttcttctttctgtcttcagaggcctcatccttttgaacctttggaggaaatattgcacctaaatgcgactttgaatgcctcttgtttcctatagtcaagaaatgacattggatgctctctacttcccaagagaaattaagaaaatagcacaggagaaaaggcagacttatggtgatccatatatgttttgagtggacacaagtctcaggtttatgcatggttataagtctctgagtacaatttttgcttcggcatgcttgatgctaacatctgtcgaatgtaatttcgcgagctccttgtgccttcaaaagaaacaagcaatggagattttttttctgaatacttggagaagattggttgaatctctcatgtgtatgcatgccccctgataagaagaaatcttgttcgattaattcgtcttctgttgatcattgctagtgtaaaatggaagnagcnccccccacctccgctccccagganagcaaaattgtactgtgtttttaaccatattttcttttgacaaatgatggataaatgtgaggtttcttcaatattgcatactttgtacacagaggcatttcagaatttcccgctatggcggctaattgctgaattcagccttaagattcaatgttacctcaaatgcatacagctgttttatatctagttattttggaatatcaacatgattatacctgagaaacgtatgaaatcttgattccaagtgagagaaaaagtcaggataggagcattttttgtttgttttgctgtctgacaggcaggtgtcaacttcttttgatgttgtgctttggaattttggcagtagattgcagacttaacccccaacatgaatccaagtgtttcgaaaatggaagcacggacaaaattttatagctctttgattattagccgccattctgccaccaacaagcgtttggtaaactttgaaatttacactgtcagagatattcagtgaagattaatttatctggacaaaatgacaaataattatagaagctcaattctagctgcaggaaagagtgtcctaactcctaacctagtactattcatacgccaattacgaaataaaagatcttgcaaatatcttgaaagttactttgccaaataatgctgacagtgtaatcttttctctggtctctagggccgtggcctcaaaacttgtaaatgttaatttttgtacaattcgcttctcctctattcaatgaaaattggcgacttgccgatttcgttcaaaaataaataaatttgccaaataatgttccaatactcatggaattccatatcattccatgaaactgatcttctgattttcgtcagaaatatgagcatactatctgagctctgtcccgtacagcagcagaagtttgaattgctcttcaatacgtcatttagaaagctccctgtaacttggtcctaaatcaatactcctacagtgtattaaatcttcagaacctttctgtccagcagtacgtagcaaaccagtcataaatccggacaaagaactcaataccgacagagacaaaaacctacttttgtgcctacggattcctcatgatcaaagtcttaacaacagcattcttgattggacatctcatgtgtgcacaagcagatacgacgattatctttactgttgcagcagcccaacatttatgaaatcccagacttatgcaagacttatatgcaaacatttatgaaagattatttcatgattttcttccagagagaatctcattactgcgtcataagaaaccaaatgctgcaagacacggccacagtaacataaagcatatctatcatctcaaaatcaatcctgtacaggaaaaaatatctaagaaacatgaccaaacgccgagttgctgaaattttgtagcaatagaggatgaaaaaagttatgcagccacacttaattcgagccatcgtattcgtaattccagagatggaatcactcatctcaagaggccccgttcttttttattaagatcgatacagattttacctcggtttccattagtacagttttccataatgctaaacggtgtatttcgtgcgaaaaatttatatatagaagttactttaaaatatcagataaatcaaaatttcatgtttgaaataattaaaactcaattaatcatgaactaatggctttctcattttgcatgctcgtacttaatcttcatcttcagtgaactcaaaacggtgccttagttagttgtatctttccatgagcagtttggtgcaacaaaaagccaggaggatgcagtttattctgtgactgttttcaggtctgctacagcctagagctaatttttctgttcattttcagtcacattgtgcatgcattttctgtccttgtttcttgcatctctttcgcagccatgcaagtacaattgcataataaatacagtccaagatgaagggcctctctcctgtcatttttcttctgctggtcccagagacagattgtaagcttgtaatttaggagcatcaattgcagacgaccttccaacagttctgcttttgactggaaaaattggcaatgttgaagttttgcagatgaacttggaacaaaaggttatctgttgtcaacttggacttgcaggtttagacttgatgaggtgaagcattctaagatgctctagctctgaaatcaccctacgcatggattgtcaaaactgaccatttgacctggaacaaattactgacatttgctcagagctagatgaaaggtctatttcttcagacggatagacataccagttagtcaacaattcaacctgataagaccatgatctggtcccgacttttgaccaatgattaaaattgattcacttgcttgcatgtctaattatctatcacatgctgtcatgcctgatcatccctagggaatatgataagactagaatcccataattcagtggttaattacccaggtttatcttagtatgtacagaatattctgaaaaaaatcagaataaataaagcagaaactgtgtgcaatatacttcctttgaatgaacatatgacagcaaatgttggttgctttgccgtcttgcaatcttcagttagaccgtttcctttccgtcagtccgtcttaatgaatgacacgcagagatttcgtgctctctattagaaatcttgcccttttttagttctaaactttttcttcaaacttccaacttttccatcacatcaaaatttttctacacacacaaactttcaacttttccgtcacatcgttccaatttcagccaaactttcaattttggcgtgaactaaacacacccaagtgttcttcagatagtacaaacttaggccgagtttagttacaatttttttcttcaaactttcaacttttccatcacatcaaaactttcctacacacataaactttcaacttttccgtcacattgttctaattttaaccaaacttctaattttggcgtgaactaaacacacccttactagctcaggaactgaacc

SEQ ID NO: 60562 - DNA, 621 bp, Oryza sativa
tagtcccggttggtaacaccaaccgggagtaaagatcccgggggcctgacaaggtctgacaggtctagaactgggactaaagatcatctttagtcccggtttttagtggaatcgggactattgtggatttcggccgaccgaccaaagatggtttctccaccagtgctttattcaaattattgttcctggtgactaaggctatacacaacatggagacgtgcagagtgcccttgactctccatgttggtgatgatttcacgctatgtcggtcaagtgagtgccctagccaagatccaagtgccctacagagggcacaggtgtctcggcgggactgaggctactcatcgtcgaaggcatggtcgcgaccgtgttgtgggagaggccatgatcctcctccctttgcatgatttgttggtgacattctcttcgcacgatttgtaggtggtattcccctgaaacgatttattagttatatttccctcatgtgatttgtttggtgatttggtcaaagaggacagaggcggcaacagagtaggggtaggcgactgggaggggcataccatgaggcccttgtcacaacccaagatggaccggcaagctcctcttcacccgatctacact

SEQ ID NO: 60563 - DNA, 22857 bp, Oryza sativa
  unsure (1)..(22857): unsure at all n locations
atcataaggagtaggagttggcttgcagtcactatatccaaagcaactcaaaatcttgtccacatagtgggattgcacaagtgtaatcccactctcatctcctctttgtagtttgatgttaagaataacatcagcctctcccaaatccttcatttcaaaactcttggacagatagtccttgacctcctcaatcacattgaggctggtcccaaagatcaatatgccatcgacatataagcacaagatcactccttctcccccactatagcgatagtacacacatttgtcagcttcgttcacaacaaagcctgcagatgtaagcgtggtgtcaaacttctcatgccattgcttaggtgcttgcttgaggccatacaaggatttcaacagtttacacaccattccctcctaaccttctagtacatacctgtctggttgatccatatagatctcctcctccagctctccgtttaggaaagctgtcttaacgtccatctgatgaacgagaagaccataagaggctgccagaacaagtagttctcgaatcgtggtcaagcgagcaactggtgagtatgtgtcaaaaaagtcctcgccttccttttgggtataacccttggccacaagccttgtcttgtacttttcaattgtaccatcaggcctaagctttttcttgaaaacccatttgcatcctacgggcttgcacccatatggacgctcaacgacttcccaagtaccattagacatgatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatggggcatgacagtttcttgactagaggtgctaggtgtatgtttcatgggaaattcattctcaaagaatgtagcatctctggactcaaaaattgtaccaatatgcatgtcgggtactccagagtttactattaagaatctataacctacactgtgaatagcataaccaaggaacacacaatcaacagtgtttggtccaagtttctgctttttggctataggtacatttaccttggccaaacagccccatgttcgcaggtatgagagatttaatttcttcctttcccattcctcgaatggtgttacttccttatgcttcattggaattttattcaggacatgacacacagtcaaaactgcctcaccccaccattccttggaaagccctacagtgtctaacatggcattcaccatctcagttagagtacggttctttctttcgaccaccccatttgattggggtgaatagggaggcgtcctctcatgaataattccaaacttttcgcaaaaggatgcaaactcattggaaaaatactccccacctctatcagacctcaaccgtttgattttcctttcaagttagttttctacctcagctttatagatcttaaagtaatgcaatgcttcatcctttgttttcaatagatacacataacaaaatgtagtgcaatcatctatcagtgtcatgaaatatttctttccccctttagtcaacacgccgttcatttcgcacaaatcagaatgaacaagttctagaggtgccaaattcctcgcctcagatgtcttgtgaggcttgcgaggttgtttcgattgaacacaagtatggcacttggaacctttgaccaaagtgaattttggaattaaactcatgttagctaagcgcgtcatacaaccgaaattcacatgacagagtcgcgaatgccacacattagactcatctttctcgctaatatggttcacaacattatgattattacacatgtcattcaaagaaaagcggaacaagcctccgctgtcataaccttttccaacaaaagtcccatatttagatacgacacatttattggactcaaacacaagtctaaaaccttctctacacaatagagagccactaacaagattcttctttattgaagggacatgctgcacgttcttcagctgcacggtctttcccgaagtaaacttcagatcgaccgtaccaacaccatgaacaaccgcaagcgaaccgtttcccattaacaaggaggaacctctcccgacctgataagaagaaaacagagaaatgtcagcacatacatgaatattagcaccagtatccacccaccaatcaggtgagtgaaaaatagagagaactgtaggtaatattttaccgtacaccgatgttcctccgccctcgctaatgaccatgttggcagacttcctgtctttgcgctcaggacagtccttggcccaatgcccatacttaccatacacaaagcagtctccctttgcctttcccttgcctttcttcttaaagttggttgcagccttgggtttgacatcagacttgactttcttgttgttgtgggatgcatgagggttcttcttctgtaccatattggcactagaacctccctcaacctttttgccccggacgtcctttgccctcgccttctcctcaacacccaaagagccaataagatcagaaacactgaactcttgtctcttgtgctttagagaagtggcaaagtccgaccaagaaggtggcagtttggcaataatgccacccgccacaaacttgtccggcaactcacagttgttgttctcaagttccttagccagcatctgaatctcatgagcttgttctactacagaacggtcatcgaccatcttgtagtcatagaactgctccatgacatacagctcactgccggtgtcagaaactccgaacttggcctcaagtgcatcccacatgtccttcctagaaggcatgtgcatatacacgtccactatgttgtcagcgagtacactgatcaatgctccacagaacaggcaatccgaagcctcgaaattagcctcctcctcaggagaaagaggtggttcacttcgtttgccccgtgaaacatagaagcattgcatcgctgtcaaccacaatagtacacgtgctttccatctcttatagttagaaccatcaaaagcatgtggtttcagtgcagcagcaaagccaactaccgaaaataacctatcaggtttttggattgttagaaatatggtcataaatcggcatattttaatccaaaatgttaagacaataatcatggcataaacagtgtagggtgatctagtgacaacatgtaacataaccagtagcatactaatggcatcatgcgcattatgaatatcaggaacaagaacatagcagtaacgcagtagcatgctagagacatcatgaatatcaggaacaggaacatagcagtaaagcgctaacaacgggaacaggaacaggagaaggatataccccgagaatggccctccactggattgcgaggcagaattgactccgttggtgttgttgttcgcggcacaggctccagctcctggcgcaccacctccagctccagctcctggtggcgcaccacctccgccatctcctccagcagcagcagcggcgccggctccaggcgcagacatggtgggcgaggacgagcagtcgtgcgggaagcactccccaaaaacctgatcacccgcctacccggtgcagatctcaggcgaaggtgtggttccggaggccctgctccttccgatctctcgtgcgcgcaagcgatcagaagcgaggaggcgagagcagcacaggcgcggaggaggaggaactaacacccgggaaagaagcaagcgaacgggaaagaagcaagcgaatcgttctgatcagactcgcggcctccttatctatcaggagagaggcaatcggcattcgtgggaacgtgggatcgtggacgcgccgttgcggaggcagtcgtggtaacgtgggttcgtggttgcaaaagagtagcgacatgacgtgacgcacgcccgcccggcccggcccagcgcgcgcgcgtgtggctttccaacccccacctcaaccagtcaacagggggcctccaataactccctatttaggttgagatattcctcgcttaaatcctgaggtggtattattatccttaacacttattatgggtctttgagatttaataggataaattgggcctagcccaattattctaaaaatggctaaggatgcaagcgggacgggcaagcgggttttttacccgcttatctcacttttagtttatttttcttctaaaatttatactactatgtgggaaatgaactagctatcaagcgggttttttcgggtagcgggactattcacttgcatcctaacccatggctagatccagtgagcttgatggtgatggccatggcatggggagggacggtgggtgtagagattgaagggaaaggtgaccaactccactgaagcagctcgatgacggggagcttgtggtcaccgacagccgaagaggggtggagatggcgtcacgccctgtgggagcttgcagctggagaaggagaagaggcagtgacgatagtgtaaggagaggcataggcgtgaagaaaatgagggatttagggaatgagaagggaaggagagggagaaggagaggggaaggaggttaaaggtattttagttgatttgataataaaataatgctattatagggattgatattaaaaaattggctaaaaacgaaaatgtattaggacggagggtccattgatctttgatcatgcctaagaaggaattttttttttttgacttagagataagctcgtaaataatttgaatgcgcaacggatagtgcaacagatagctcctttatactaaaatataagcacttccaacacccatgtactagtattttattctattaatcacttttccgtactaatatctaatatcatttctcctcaatttttatctcttctaccacctccgtcctataatataaggatttttagaattagacgtgggtattaaaaaagtgggtagaattaaatgaaagaagattgtgtgttgtcgaatgacaattgcgtttgtcaagaaacttggttcactcttgattgaaaagtaaaacaatgtgtattgatattgcattttgttggtatgccacattatatatcccttggggtttatttatagtcttagtataaactcatgcactctaaggctaataaatacagagaaatttacatgtatactcttgtgatatagatatatataaaggtagttgtagataatttagccatggacttctcagtgggccataacatgggcctaatttgacgaatcagcccctacaggcatagagttctctacttctgatggcaaaggcgcttggctcagtggcgaatgcttccatcttcacccaatcggtatttcactctggtgctttgctttggacagtggcttgtttcggcagactcggttgaaggcccctgtaacatgctttcaacattgtaattggttgagaagtggaggtatgtgaaaagattgaatggcggagggctataattggttaggagtagaatgttggtcgagaaattgttatattttaggacaaaccttgagagttaaagttattatgtttttagacagagggagtaataattaatctataaatcattaatatattttaaaatagatggagtagtatgcatgcgacgttgggtcatcttttctatattcatccttgaatctaatgacaagtctgtgaacatactgaaacatatactcctgacatatatataccagtactacgaatctaaacaagtatgtctagattcgtagtattagaatatatcacatatatgtcacattcgatattaggggcctgcttatatcccctgccaaaattttacaccctgtcatatcgaatgtttggacatatgcatggagtaataaatataaacgaaaaaataactaattacacagattgcgtgtaaattgtgaaacaaatcttttaagtctaattgcaccatgatttagcaatatggtgctgcagtaaacatttgctaacgacgattaattaggcttaatatattcatctcgcgatttatagacggattttgtaatttatttttttattagactatatttaatactccaaatgtgtatccatatatccgatgtgacataccaaaatattacaccctgaatctaaacacagcctagcctaggttagttttctacataaggaaggtagtattctgttgagatgatagctatatattttaaatacgagggaataagaaaataaataaatagtaactgttaaatagtgttagaaaatgcagttaggagctactttatgacacggacagagacgcggcagggaccacgcctcactctcgcttgctgatgaagcgcttttaattccattaagacggacaacagaccatagtacggaataagagtccatatttattacactctccgtcacattattactatctacatcttaacatataagagattttaaatgaataacatatatttgagtactacaaattttgatttacctctgttcagatttaaactattaggatgtgtttcatccatccaaatcacatatattttataataaagggagtagtaagttcgaagtatatatatatgaactgctcgtaagtactattgtaggatattatctttgtaacttaatatagaatgggaacgcattctaatataataagtattacaaatctacaaccttcgtccagaagcgctgtaatactggacagatatttgtctagattcattttcaaaagttggcttattttggatggagggagtacatagggattgtgtagactcatgattagaatgtgtcttatctcgtactgaattgttatattttaatacggaagtcatatttaacatgttaggtaagctgattagatcacaataatattattggacatgactacacagcgaccggtctctgatttgcctaaagcagcgatcactccatcctagatttaaatctccttttagcttaaaaagtactatagtgcatgtttttttacctctttaatcacttgtatattttaaatcacatattatttttaagatctaatctatttgcatcattgtactctacttaaaatatgtgacaaaacgagatccatgttgaatatattaaaacattttattattttaaaagtaatttatttacattgtagaagtaacttagctatgtaatagaagtaactctatatagcattaaaagtaattacattatgagtgagttccaataagaaactacgtggagtaaattcaaaagtgtagagaagattttcatgtaaatacatttatgaaagtaaatttaataaagcctgaaagtaatttacataaatcataaaagtaacttagcataaaataaaagtaagttgttacgatattaaaagtaaatttgtcataggaataaaaaatataaatctatttagaaattaaatttaatcagcaaaaattatggaattgagtaaaaacaatcaactcaaagcattacgaaattatgagaagtaatttaatcaaatctaaaagtagtttttatataagataaaagtaacttacctatataataaaagtaatttacaatataaatgttttttcatcataatattatcatgtaagatcttgttataaagatttaattgcaacggacacaatggtgtaatcggattatatatcggataagtaatttaagagaaaattttataagaagaaaaaaaatatgcacaacctaatagcaaaaactacttgcatgcatgtctgtaacgctactagtacttctcacgtaattgtccgcgtcgctcgttaagtctaaatcgagatgcctctcgaaatagattttgcgtaaattattccctcctccgttctaaaatattttaatacagaagtagtatttagcgtgttaggtaagctgcttaaaaaaattatgtagttataatttattttggtatgagttgttttatcacttaaggtatttaaaatttttgaataagacgaatgatcaaacataaacatgtgttcaaaagtcaatggtgtcatcgattaaaaaccagagagagtagatttcaggacagagggagtattaaattagacacgtgtttgttatcattttttttgaaacagttgacggtaagatttctaccggatatattagaagaaaagagtttttacctaaagggggagagagttcacaaggcaacacctccaaggaggaaacagcacccgcatacatcgatgtcaccgatcctgtaagaccagacaaggatttcacccaagactgtcgccgatcctgtaagaccaggcaagaatttcacctaagactaccttaaaacgtgtagaaccttcaagaaacaagagcaaaagtgttgagtgttatcgttgcccaactcatcggctgacccgatgcagcagctccgactccgccttaacacgaaagctcaagcaccgtagagaaaagcacaccgctccaaactcggcactaagacagatccacacagtcacagggctcttatgcctcgccagtgctttgttatcattttgtaccatgtcttttgggcctacggtgtacattactacatgtggagcgattagcagcagccatttcgtagttagaatagaagaacacactcttgaggctatcagcaaccagctccactgctagctccaggccggtcatggcggcggctggtcacgatgtgcagctcccccacgtcgccatcttcccgttcatggccaggggccacaccgtcccgatgacccacctcgcctgccttctccgccgccgcggcctcgccaccgtcaccttcttcagcaccccgggcaacgcgccgttcgtccggggacagctcgacgacgacgtggccgtcgtggagcttcccttcccggaccatgtcgtcgcccgcggcgccgcggagtgcgtcgaggccctcgactccctgttcccccttccggcgttcgtcgaggcggtgtcggcgctccggccggggctggaggtgtcgctcgccgccgctcggccccgcgtcggcctcctcgtcgccgacgcgttcctgcactgggcgcacgcctccgccgccgcgctcggcgtcccgacggtggcgttcctcggcgggaacatgttcgcgacgatcatgcgcgacgtgatcctccgcgacaacccggccgccgcgctgctgtctggcggcggcggcgccgaggcggcgacgttcgccgtgccggagttcccgcacgtccacctcacgctcgccgacatcccggtccccttcaaccgcccgtccccggagggtccgatcatggagctgaacgccaagctatggaaggccatcgccggcagcaacggcctcatcgtcaacaccttcgacgccatggaaggccgctacgtcgagcactggaaccgtgaccaccgcgccggccccagggcgtggcccataggcccgctctgcctcgcccatggcggcaccggcaccggcaccggcgccgtcgagccctcatggatgaagtggctggacgagaaggcggccgccgggagagccgtgctgtacgtggcgctcggcaccgccatggccatcccggacgcgcagctcagggaggtcgccggcgggctggaagccgccgcggccgcgggcgtctacttcctgtgggccgtgcgccccagcgacgccgacctcggcgccggcttcgaggagcgcgtggaggggcgaggcatggtggtgcgggagtgggtggaccaatggcggatcctgcagcacggctgcgtgaggggcttcctcagccactgcgggtggaactcggcggtggagggcgtcgccgccggcgtgccgctggcggcgtggccgatgggcgccgagcagccgctcaacgcgatgctcgtcgtcgacgagctgcgcgtcggggtcagggtgccggtgccgacggcgatggcgacgggcgggcacggggtggtcgggagcgaggtgatcgcgcgcgtggcgagggagctgatgatgatggccggggaggggaagggcggcggcggcggcgaggaggcgaggaacgtcgccgcgctggcgtccaaggcgcgagaagcggtcgccgagggcgggtcgtcgtggaaggcgctggaggagatggttgccacgctctgccgccctgttgaaggagatacaccgaaacccacaaaataagtttatttgtttctacgtttgaccgtcatcttataatctatctatctatctatctatctatctatctatctatctatctattattattattattattattattattattattattattattattattatatactaaaagtccattaaactttctacaaacgctctcaagccaccacgtggcgctcctacaaacgctcctagatcggcaagtggcgctttaacatcctatcctattattatatactaaaagtccattaaacttcctataaacgctctcaagccaccacgtggcgctcctacaaacgctcctagatcggtacgtgggcgctttaacatcctatcctatcctatcctattatcctattattatatactaaaagtccattaaacttcctacaaacactctcaagccaccacgtggcgctcctacaaacgctcctagatcggcacgtggcgctttaacatccaaccatcggttttcatttaatctggtgaacccattatttttaaccattggatctttattttaagaaaaaacaaatcaatctatctaaaaaatcccacgttactcggccgtgtcccctgaacctgtacgtctgtacgtccgatgtacgtacatatcctctctatgtccttttctttttccttgttatatatttagattagatgaaaaactttagttcatgttaaccatatgttttaagttgtaaaaatatatgttattttaagttttattctaaatagtgcatctcatcgaaatatccataaaaaaatattaataattaacattatagactatatgattgtatatcacaattaaattggacttataattaaaaaaacaatttaaattttgagtagcattttaaaaatttactcactccctatcgtgtaatactgatatatccaaatgacattattaaatttatcaagaatgtatttttcatatattatatgttgctgtattcatatatttttttttggaaaattaacaaccatatatattttttacaccatgtggatgtccttttatctcttaggcttcattcggtctatctcattggatgaacttatctaggatacgcgaaacaaagcatgccatcagcgtaagattaattaagtatcaaatattacatatcacatgcttatctaagaaaatatatatagaaaaatgattctatacacccaggagtatgtactgtgtatatataagggtcatcctatatataaaaaaacaaatctagctacttatttaaacataacccgtggatatattattttcaaccattattttatatctattcgagtaatccttcattatgtacgtacgcaagagatgtcataaaggaaaaaaaagaatgtgtacaagatcagctccatcgagtagttttttttttctttctttgcggctctgagattttcctcaaattgtgcatatgagtagcgaccacccttggcaagtttgtcaaagaattcatgcggccgcaacaccgcttcacgccatctcgctaaattttttgaaattattttttactaatgatggataaggcaatcacgtttccttaaaaaaagcaatcacgagcgcatatataaacgtgtgctcacccatcatataaatacacatacacacacctaccctaagagaaaaaatatttgtctccaaaaaagaggaaaaagtatgtgcttagtatttgctagaaaaaacatatacacatgtcatcgaaaatgtcgcatagaaccacattatatctttttaattatgtcattctcatctatataatgttaataattaggacaaataattttgacaatatagattattcaatcgtatattacccatgaacatacataggtaaatcagatgtataataaaagaaaaaacaaaacaaaaaatatattagcttatatatttgtgaacgatggtgagagatcagattatatataaccgggacaattcgtaccgttcttattgtttaagggtgtaatcagacattttccttaaaagtcttccacataaggatttataataaaaaattaatcaacactaaacttcctacaaacactcctaagcctccacgtggcatcctataaatgctcctaagccgccacgtggcactctaataaattagagaaattcttaaaaggacacaacgtataatcattaatttttattaaattttgtagaccattatttgtaaccattagatttattagaaaaaacatatacgtacgtctgctcacccccccctccccccaaattctttcacccctttttttacctattttttatcctattttcatgcttttagaaaagcaaaaattgtatgccaaacaattaggaaatgcagcatctaaattataatgctaatatttgatctgcttatgtctttagatattttacattttaaaactcatgtcctcttttattcaactgtaaagagagaaatgtcacattaattggggatacattttctgacttttgcgtgtcatttaagcaattttaaaactataaaaattaatgatatatatttttgtcatcgtatataacttgataataattaaattagatctaataaaagtaaataaaagtaaaatgaacagatctatgagtaatattaaaaaaaataccccccccaaacattgtaacacagtaaaaaatacgcatcttataaatactcctaagatattatgacgttctcttaaatcggagataatacactcttaagatattacgtcgttctcttaaataagagaaaatcgtaaaaattctgacaagaaaacaaaacattcgaccatcagcttcgacttaaacatctgacataattttagtttgttagattaatcatttagaaaaagaacatccgaaatgtcccttcctccctgctcgcgtacagcatgcgccattcttttctctctattttttaaatctccttagcaactgaaattaaaattatctatatgtaaaaaagacacaaatggacctccatctattacttatatcctgtcaggtgtctaacgactttctactaacttaattaatttctcttaacatacctatgagggctatgtacctatataaattgaccttgatacttttaaaatgatctttttaggagataaataaatattcataagaaagatgatcatagcatcccaattacacatatgatctatgaagtcactaatcataataggtattcatctagcaatatagacaataggttaaaaataaatgtgtggccagttgaacatcataccgataaacatatgggttgcacctaggaatcttaacattgaaacaaccttgaggcctatacaattaatcaagtcaattccatataggaattaaaaaccatatcctttttttctaatttttggtaaaatttgctacaatatattgtaaagtcttgacgtagaacaatctagaaatgtgtatttgttataagacactccactttagtgatgatttgctaaacacactataaccattacttcaatatttcatgatagaaaaatttagaacgtatgcctttacaccatgccatgttatacgcacttatattttcgtcccaaaatgcaaagattgaatcatttcaaggatgactcgtagaatgaaaatctccaaaaagaaacaaaaaatggacatgaaataaattggaaattgagcaaatgttgctagatttaaaacccactgtaaatagaaaaattcaaacattttacgagttctgtttgaatgaaaaaatatataaaaattaaaatacaatcaatcaaaaaattgatattattggatatttttgggttgtaagatatcctactggggagttaaatatccttaattttctaataggaaccacctcctttgtttcgacacaatattttctcatcaattcgaaaccgcatgttctgaagtaattttattttagaacttaaatgttacaagggtaattataagaaaataatcagcgctcaaatcacacaaaatacatttcagtttataatataataaaaaatattttaataaacaacacccacacataaatattcataataaaatttcactcattatataagaaggtgcccgcgcatgtgcgcgggctatctttctagtttataaaaacaattaaaaataagtcacatataaagtattattcatgttatgtcgttcaataataataaaaatactaatcataaaaacatttaaataagacggatggttaaactttgaacataaaaacctagtaatgaattttttttttatgtttgctggttggaactcaatgtttcgtgcagtgattgttagtattgcagtcatttttttctggatgttgcatatttgtaaaacatttcataaaatggattgaaatattttgaccaagtgaggaaacaattttatataagtgatgaaacaacactcaatttttttagacatatattttgacatcaaaatataatcgtgtgagatcttgttatgaagatttaattgcaatgaatgcaaatgtgtgattggattctagattggataagtaattacaagaaaaaaaatcaatgtaagttattttaacatatttgtgttacaagtaaaagaagcaacctatgagttaagaatagataagaaaaaaaggccacgtggccactttggactggcaacttgtagcattatcgttatttattagtataaacacagaataatctgcaagcacataaatattattgtagctttcatccaagagtattatagtgtatcatatccacatggaacctagtcttctaactaggttgtccaaggacactagataaatggtaggtgagggtagagaggaattcttatgtgttacttatcttagtttaagttaagataaaactctatcaactagttcgggcaccggattacccttggtttgttaaggagactccggcctatagctctatgatatacccgaacgtgaaggattacgaaagacggacgggattgtcaccaccttccgcctacctctacaactcatggagcacacaacaaacaaagttaacttctaggctagacaccacgtctatgctatatattaccctaatctctgtaccacgcttaagattatggtactcaacctaagcagagcgatgaacccacaacgatgagaatatatcttacttaaatatgaaaagtaaatatcatcaagaaataacaaaacacttactcgtattaaggcaaacgtctgtagaggtacaagctaggataagagtgccaacagacccaacacttccccaggagaagagtgctgatagccctagcaattctctagacttcctctatctccctactctaggcactagctaagtagagcttcacttttagaatgaatcatatgatcttctatcttggtgtgtcttgagaatgagagtgtcaaagtgacttgagagagagtggagatgctaagagaatattctccctctatctcctctcaagcctccacctctcctcaaaccatcattcgatggtggtttcctgccttaagccttgcgccactgacttaaggattatgataaccgtcgccacgtgaagctgggcaagaggggagccaccccaggttcggcttgcgccgcctttcacctgggtcgctgcctagtgggcacccaagttggtttggggtgtatggatgaagttgaggcagttctcctcctggtgtggactatttgatccctgttctctcctctatttggttggagttgtgctttctcttaatttgcacaagtaatcacctgcatacaaatattcatcaacacttgtggaagtggttagtaataaaactgtaacatcctgaaaattcccaacaataaaaatcactaaaatttcgaactttttaaaactttttgcatcatgctggatgttatggttgcttttatttgccaagctataaattgtcacaatggaaaattaaactaaagttatacagctaagtaataatcataataataagatattattatgaaccctataaatatttacgcacgagaaaacaaagccagacaaagggaaggttaattaccaatttaatttatagatcaaatattaaatacttgaaccatgaaatataaacacttaggaaatgataatcattcaaataaatggaactctatctatagagtagttttactgggaaaaattaattagatattatataatttgaattgaatcacaaatgctaaattatagaaatccatgtggtggtaaaaccaatccaaaaagataaaccaatatatgtgaaaacatataaataccaaaatcccaaatatagggaattataaaaatctaggatatatattaaatattggacaatattaaattttgggaaaattcacatttgagcacttaatagggtcacccaaatgcttaggagtaaatacaaattaaaataaagattaggtggatagaaataaataaaatattatcgcgaccatatttggatcaattaaatttaagtacgatggaataagaattaatcctaattaaaactcaaataaattatataaaaataaaatatgagtaatattaatctagggtgaattcattagttgagataacacaaatattgagtaaacttcatttatgcaagatttagaaattatagaatcaaatttatatggaaaataaactgaaatcgggataaataggaaaatacactgttcattatggcgtaggtgttcgatgtggtccctagccttccccctcctctcccacctctgcccctagccgccccgagccgcgccatcgccgcctgccgcgcgcgcctcgcaccccgagccgtcgcgccgctgtcccgacggcccgcgcgcccacgcgccccgtcaccgcccatcccgtcaccgcgcgtcgccgcctcgcgccccgagccgccgtgcgccgtcgccatcgtcgcctgccgccgcgccaccgtcgccatcgccatctcattgccgcggccgcgccgtcgccgtcgcgtcccgccccgcgccgcgcgtgcatcccatcgccgcctcgcgccgtgcgacaccactgccgcgccgtcgccatcgaagtcccgtcgccgcgcgcgtnccatcccgctgccgcgccgcgcgccgtntcgtcgcctcgcgccgcgagcccgccgtctcgcgccccgtgccgcgctgatccctcgagccccgtgccgccgctgctaccgcgccgcgccgcccgttccatcgccctcgcgcagtcgccggtcggccgtcgcgtcggcggatcccgttcctcgcgcaccgcgccttgccgcgccgcgtggtggtcacatcgccgcgtcgagccccacncggcgccaccccaccnacnccatnagacccccgcccctcttccctcttccccattatctctttccccctcccttatataatccccccctaatnccactctttccttccatcctcacctcctctcctctacccactccaccacgccgccgagtcatcgcatagagccgccgcgccgccactttcggagccgccgcgccgtcgccccggagccgccgcgccgtgcgtcgccgccttgcgccgccgtcgccgtcgtcgccgccaccgccgccgccggtgagccgtctttccccctcccccccttcacctcgcgcccaccgccgtcgccgcccgcggaggcaaagaaccgagagagaaagagagaaaccgagggagggagaagccgaggaagagagaaaggagccgggagggagaaaagaaaaggaaaagagagaaaaagagaaaaagaaaagggaaaagagaaaagaaaagaaaaaggaaagggagaaaaaggaaaaggaaataaataggaaattagagggagtttgaggaagtttagaaaatttaaaataattagaatttaattatagattaattatagtcgtagaattgcaaaatttaatataaattatggattattcttggtaatttctataagaaatcaattcgcggtagtaaattagatgtaattaataactagacaaatagatgaattattatagattatttttgggtaatccctataagtaatcgattcacggtagaaattcggatttaattactagggattttagccgtgtattatatttaatcatttagtcataaactaaattaaatcgtataatatttctagaatttcgtccgatatttagctcatgatagaaatttctaacctattatatggatataatgctcgggaagattaaattaaaacttatgacaacgaaataattatacccgcaaaatagcttaaatcgaaattgggttgccgtagttcgcagatagtaaagttaataaaaaggaataaacccggggtcccacttgtcagttggtacaaggctgtggatatgtcttggattaaaaataaatcgtttatgaacagtagcttttcgcaatttctcggattaattcaaatttgaatctttacactagcataacttattcattttaactcggatttgagtgaaacttgaacctaaattcatctaaattcataagctttccaatgatatataattcactatttaaaaaaatatatttataattataaattaattaataccaaatgattagataatagttaacctaaatagtgtgccaatgaataaaaatggatattgtacagtagcataattatctttaacatgtcttgtcactgtagcaactaaataaattagttataatcaatccttcaaattaatgggtgtataggaaaatattagtgccatttactagtctatgtccaaatataactaaatccatgacttataaattgtttacataaagtttagcctcatattttgtaactaaaatatcaacacacatagatgaatctttaacttgtttaggagagtaatcacaaagctagttgtatttggaccacttaaaaatttgtcgatacaatgtcatgtgaagtagaatatatgtatatagtgggtcgatatccattagttaaccaaacagagccatcttaaaatcaacatgtattgtatagcttacagtaaacagcaactactcaaatatatgatccaataataagatattgttgcttacacatatactatacatcccattatagtggtacggtatagtattaatttgcgtgttgcatatattaaattaggagggagtgtatgacaaacatgtatattagataaatactagttataaatcttgaccttatataattataattatagttcaactgtaaattaggattattcattgtaaaattatgtgatgggataatctgtagccataatatgattagcctaaacaactttaacatatagagcatggataattattaaccttttataatttattgtgacaagtaaaatatgttcataattaaagtaaagcttccatcaataaaataaataatacaaatgattcactgtaattatttgaatgatcctaaatccatctaacaacagaacctctagtatataaccgtcctatttagatagatgcatgcttagccataatccttccataagctatttgatagactaaaccaccgattagccaaatatatatgtatcccataaatgctatgttggttaactcctaaataggccacgttgacaatagaaagattaagaaaccttagcccctagcatgattgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattccttgaacatgttgatcctaattgcgagattgttttgtttacaaataaaatttcatgcaatgatgaacatcctacttgtgattatgccatgccttgattattgtttacccttaaaatccttgtaaccatgattacgtataagtccctagtcaattatgacaattgcttagaaatgtcattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacaatgggacagccgttgaggtagggccgagaggcgtgccctacatcggtgtcgccattggtaggactgccatgagtgtgtgagagagagaacttaacttgaactataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactacagtgtgagtaaaccaaatctattcgaatagccgtgctcgcggttaatgagcaccgggacatgtattacacttggctagactctaaattcttaacttgtgtgggatgggatattgcatggtgatttttatgctgatggagccacttcctgagaggaagggaaggtggacgtcctcagaaaaccatgacgactcaatggcgggaagctatccttgggatcacaatggatggtggacagaaccgttgttgtttaatgtgaacactggaactaaaatttgatcagtctatgataggtcttaggcttgtgaaaatatttgcaaaacgcagctttatgcaaaagaacctaaaaccattccttgaataccctctatcatatgcattgttgttgtggtggcttgctgagtacggttggtactcacccttgctatttatatatcttttaggagagtgttgaagagaagcccttgtcggtacgcttgcgtatcccacgagatgatcagagtgcggtcttgttctaggtctcgttccccagtcgactgcctgtggcatgttaaccgggcccttatattattttgtcttccgctgttgttctctgatagttgttggcctaactggccctaatgtaagtgtttaactcttttagcctaaattcattcgtgatatgttgtgatccaactatgtatgtgtgtaccaactactgatccagggattggtacggataaacacagaagatttccgatttccaaaatcgggggtctacaaaaaccctatcgctagatttggtgatagacattagtaagttttatgttggaattgatggtcaaatttggtcgttaaggagcgtcaaaatgcatgcagagcaaacgagcaacttttggccgagaagttagcagtgagagcaaagctagcaaaggctaagagcgcaagcatctgattcttctctatttatcggagatccaatgcgtggcactctccaaaaagagtgccttattctttggtttgtgccaagtatttgctcgtggctttgttttttttagaccgactcagtgcagtttctaggtgacagggattgatgaatgatgtgagggatagttgttgcacaataacagaacaaattaaaggaataatttaggagaagattgaagcttagtcttctaacattcttttttattcaagctttctttcttgttatttcgttcttctgtttcaaggcttggagtctgttaactcctctatgtgtggatacagtggctggcataggcggatctataaggtggtccgagtggtcaaaaaagtgatgatcaaccctattatatatatcccgaaccaatccttagtggtatgatgcaatgttttacaacatactactaaaagagaaagagcatggtagttgtaggggatcttaccatgacaacacacacctccggggagcattcagaggtatctcgttgacggagggagttcacccagcactgataaggtcgccaaatgtgcaccgaaaattgctttcccctttcttttttgaagggaaaaagagttgtattgattaagtaacactatcgcaatcttgctgcaaaatctgttgatcacaaaacaatgcttgatcacgccaaaccgcttaatgagccatccgtttagcatattgagcaagttcaagcgtctcagatctaagagcacaaggcagtgtttggcatctacatctggttgcaatcatgtcgactttcgttaggcagaagcgttggccggtttgacgacataaccacgacgaggtggtataatgccgagagaagatcttcatgcacacaatctggatgaagggggggcagcgatgaataaggagcccattgaagattagtgtcgaaacatgaattcggcaataataaaaggggtagcgcacgagacctaaaagtggatgcatgcggagacaaaggatttaga

SEQ ID NO: 60564 - DNA, 4616 bp, Oryza sativa
ttggtgatggaaaaccttctcttcgggcacaatatttcacggatttatgatcttaaaggtgctatcttttcacgacacgttgcacactccaatgaccgtaatactgtttacttggatcaaaactacgtcgaggacatgcgtgtttctccgatttatattggtggaagaacaaagcatcttttgcaacgtgcaatctggaacgacacatcattcctcactgtatgtataaagcaaatcctgaatccaattacaggtaattgtggctttcaattaaaaatgtgtctttaaccgatttattggcttgcagtcggtcaacgttatggactattctctgcttgtgggagtggacaaagaaaagcatgagcttgtatttggcatcattgattatctgaggcagtacacttgggacaagcagctggaaacatgggtgaaaagttccctagtagtgccaaagaatgtttcaccaactgtagtttcacccaaggagtacaagaaaaggttccggaagttcatggcgaagcacttcctcacagttccagatacatggagttcagagaattcttccggaccaagcaaatcgtttgggcatagcaataacatgttggtagaagtccatagtgatgacaatctgcttcagcatccaattgaggctgagacagttgtataaatgacttctctgacagttgttgaatcctatcctgttgctacttggctttttttttttcattttgtaaaatggtgtacataggagggcctcactcactaattgattttggcaaccccagagaagtttgcagattttaggcaagtcgatggggggcaagtgaggcctacagtacatgtatgtatacaaatgttcattgttaatttcacagttattacagtgaaattgcaaaattgatgattattctgaacctcagtttccaccagctagttagttggtaacttgtgacattattgatagaccaatattgctccgattcatttccgctggagacgatcttcttgctgtgagcactgagccatactcattcgcagaagcaaaataggagtgctgccatgaagcacaaaacctgggttgtcgcaaattaaaggggtatgttcacaaccacaagcatggcatcgacttctcgcccaaatccttgtaatgaagattatgacgagcagaggaatttttttcttttttaagacaagtataactatggcattgcgattgtttttttgatcttgtcttggtgcttggttgcagaactgctttagccaagggattgttgtcgcgctgttcatttgttggagtgcagtcaaggtcagctaatttaattccccattgcatacatgcagattctcaacccacaaagaatggaatatgggctagctatactccaattatcatcattcttcgtttctccacctcatgcatgactctgcaaagaaagatgcttgaatccaatcgatttggcatttcttcatctgattgagtcctacaagtcaaggtgatcattgccatgtcccaattcaagaggacccaccttctcatcatcttgcagccaaaatggtgagcaatatcatggagaatcatgtccaagagctctgcgtagctgcatcgagggtgtgtgctgttctcagttttctttccctgttcatcttctttgcttgagtgattattaaaataaccaattaatatgtttgtgctgccatatatattctcgcatagtggagtgatgaatgataaggaaggtgataagcctaccgccaagaacaaaagggagaagaagaagaagaagctagagcaaagagatggaggttaaaagatgtcatttttaaacccttcccgattaccagtacttgtttctttttgtcccctcctctctagtctgtccaagttgttacttttccagtttttttattattttttttaatggaacttttccagttttagaaaagggcaaagagttggtttccctttcggacatctgattcgtcgcacttttagattcttcctttcacaggtagtaaatattacaccatcatcagtcataaaacaccattaaaatatggagtacaaaagaagaattaggacttactagtggacatatatatatgttgattctgacaattaagcatgaactggtcgctagtagccgcaatggtaatttggagacacaaagatggcatgcatgggcatatatattgatcgatctatagctagatacagtgactagatgagtgatatagctaagctagagaagtgcctgaattacaagaaaacaaaaacacctacgaccttcctagctggagtactacattaagtaattctcatttgttaattactagtagcaaactcatccatgcatcttgtgctaatgcgactatctaccatgcattaattatattagtaatatgcatgcatgatgttaataatctgtttgtggcaataattaataatcatacagtggatgtctggattagactttggatcagcgatggctgcagaggtcggagagcatcttcctgccctcgacaatgtcatcgaacaagtcgtcgagctcggcgatgacggcctcggcgccggagctgagcatggcgaggcagcctttgacgaggtgggccctctcggccatgtcctcccggtgggcgtagccggtgccggtggcgacgaccctgtcgaggtcggccttgaggctgtcgatggcggccctggcctggcggaactcgtacatcaggatgccgtcggcggcgggggcggcgagggcgcgcatctcctgggcgacgcggtggcggaggcgagccatggaggaggcgtagccgggtgcggtgggcaggggaaggggagtgcaggtggagatgaggtggtcggggaggcaggaggagacggtggcagagaggaggatggcgaggaggaaggaggtggcgttgcggagggcgtagaggagggcgcggaagccgttgaaggcgttgaggttgaggtccctcggggagcggtggtcgaggaggaggagggaggccgggtcgaggatgttgtcgtggaggagggcgcggttgtcctggaggaggccggcggcgtggcggcgaggggcgttgatggcgcgggcggcgtggatgtagtcgtcgtcatggtcgtagaggtggtggatggcgtgggcggcggcggcggagtaggcgtggagggcggaggcgccggcgcggacgaggaggcaggcgtcccacaggcgggaggtctcgtccatgtactcgtccagccacctctcccccgccggcaggtgcagcctccccaccacctccagcagctgcgcgtgcaccgaccgcaccagcgccgcagcctgctgcacgaacgccgccgacatgaaccccacttcgccgaccgccagactccggtgcagcgcctccaccccctgcccgatcgacgagtagaacctcttcatcatccttagcttaattaattaattcctagctatctactccttccttgtagtgttcatggtcatggctgctgcctctctgcctgtatatactcctgcggtgcctacatataggagagatgtcatggcagtggcagcagctactcctagtcctcgatgctaatctagtgtgtacagcagcaacagccagactgcaagagcaatggaacgaatgatatgatggtgtgtctgggcgccagggggaaggatgattgtcactgcctactgcttcttcgatcatctctctcactcatctatacgaatgatatgcactattacttgctactgttcatcactatctatccatctatcgattcgattcgattatgtgtgtatcatcacgtacctgcctttgcattgccattttgatttcctacgtgctctcttcctctcaaaaataacttaggccctgtttagttccaagggtgaaaagtttctgcatttcacattggacataccaacacacatataaagtattaaatgtagcctaataacaaaacaaattacagattccacatgtaaaccgcaagacgaatttattaagcctaattaatccgttattagcaaatatttattgtaccaccacattatcaaatcatggagcaatgtttcgcaatttacacacaatctgtgtaattagttttttttttgtctatatttaatactctatgcatgtgtccaaacattcgatgtgatagagtcaaaagtttttgcgtgggaactaaacagacccataacctagatggaaatgtgaaccctcctagtaaaacaaatcaagacaatcttctattcaaattcattatactaagaggggtcacatcacctcttaggttgagtttttttttcaacaaagggagtgctcatatacatatgcatcggaaaacgcaatacacctagttacttaccccctctgtcacataaaaaatccaacctggtattggataagacattttttagtttaacgaagagaaaatgtgtatcattcaatattaaattagttttttcttttttggacggatggagtagagggtacagtacagtactagattagctttgtgtctccatggctggctagcaagtagcaacagaaacaggggacaggggtagtagaaatactagaatggtgcgtggttgttttgatatgaatgtccaattgca

SEQ ID NO: 60565 - DNA, 7086 bp, Oryza sativa
acctaaccacatttattgcggtttggttgagcgtgtcacgccgcatgtaacgcagtgcagtgcactcgtttatccggtctgtgaccagtcacagaccggtcagatcgcgggttaggtggcgacaggcgatctgacacacgcctcgccccatcccgtcaggacgagggcttctaggcactcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggactaataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatccccttaagatataaaaggaggaccttgcccacggagagacgagactggacttttccagattagaaacccagaacaagggagaggctggctgatactttgtagctccttcatacacagatgtcccaaaacacaggagtagggtattacgcttctcagcggcccgaacctgtatacatcgcccgtgtcttgcgtgtttcctgtctcgcgagccttccacatacagagagcttagaatctctccctgagtccccggccgaaccggcaaaggggggcctgcgcggtctcccggtgaggagccccacgctccgtcacactccatcctcgaatcatccctaaatcctgaaatcccaaatcctcaaatcgatcatctccaagtacatcctaagtcatcacagatcacagatcaaaaggatcatctccaaatcctcaaatcgatcatctccaaatacatcacaaattcctaaaaaaattacatcataagttctaaaaaattcatcataaatacatcacatattcacatcacacacaaataaaatacatcgcaggatcatgcaatgaatcacaaattctttaaaaaaaattgttgctgcagcctcccgcctcctctccggcagaggcgccggccggccgctaccgcctcccctcctcccgtccacgccggccattgccacctcccgcctcccctccgcactgccctccatgtcgtcacgcaggctgctgcccgtcgcccggacgaccggccctctaccgcgccctgcgccgcccggtcttcccgctccagcactccttctccagcgctcgttcctagccaataaggctcagctctcagcgaaggaaagagataaggaaaaaagaaatagagagaggagtttgtgtggacgggagaagaggataagtgctatggaggattatatactgcattttgatttttattcctggttagtaattggtgttactaaccgggactaaagatcccgatcgccctgacacggcttgacatggaatcaactgggactaaagatcacatagtcccattgtgcttttaaaccaagactaaaaatattctttagtcttggatttttaagcaatcgggactattgtggtttttggcaaccgaccaaggatggtttctccagtagtgcatgcgttaatccatcgctctgtttcgtgtgtcggggaggatgagttcccaacccctcctcctgaacagagatcactgaactacacacgacgttgaccttccatcttcacttgtcacatctacaaccctaatgtagtttaccgcttgcaacccaaaaatgttttcccgctgctctcgctgttgtcaagccttgcacagctcaaaacactggcaccatcacaaaagagcacattagtaccctcttatcagtgctggtttgacaaaacccgatactgatgatggttgatggttttgaaccccaaaaaataagttcttgctacatacatgcttcatctggcattgatgaggagacatcaccatggtcaccggcacacctcactttccctgtcccaacctttgcctctcaagtttatccaactgccaccttgtcttagcgcatctgtatcaccacaactctgtcactccttgctctagcaccatctacagtgacaccaaaggaagtatgcagcagaaaatgaacgtgaaccgattcctaggaaactgtgcgatgctggtactagtcccaggaagaacatgctagtacctgtggttaattgaggtacatcatataatataaatagttgatatcatataggaggtcacaccttcagaataacttcgaaaaagtaaacagtaagtagagaagtagcaacggaacttagtgtagctagaacccagttacaagcaactggttgggattagatatgaaacccaactcttcaacttcacttctttctagggagaggaaaaataaggttgagttcgtatgtactcagcaagtcatgaaaaatgtgagtatgcaagcttcgaaggagggctgggtttatttcataaatctttcttcaaaatacatttttttaaaacactaagcgtgggttgtttttataacatgactgtaaagaggctttcgcttcaaccctattcatgaattgatttgcaacaactaaagcagacgaagcaagttttagttgattgaaattactagtgaagtctattgctctgccatttgtctaaccaaagaaaatggctcatagtctaccatcaggcaactcttatctcttctctcctctggctgattctagtaaatggttctcattcccacaatccatttttacaaagcataggcaaagaaatctacacaagaggaaccattgcacatacacccatgaccatgggcgcaattgtccgaacagtttcatcctgcagaggtgcacgctttacccacatgactcgaacttacttcccacacctgtagatagggaaggttcatgtcaaggccttcccaaaacaattctagtgatacctcatgcacgatagtcaatccactctcaaacaagtagtatgcgaaccttctgcatcctcacccttctccagaattcggggatgtcacctcactgcacatcccgacatttctcacctattggcaaatgaggtatattgttctggctaattacatagccagccatgtcctataccactcatgtgatcgtactgtatttatgatcagtgtaattccacaaggaatcgatccttatatgcaaatatagaggattgcctccaataaggccgctttgcatcgtgtgttttcgaaaataacttctattttcacaaacattgcaacaccacgtgttgggattttaaaggttttgcaatctagttttacatgtcgacaagcaatgcttttgtgagtgggaccatcggcaatatgaccaagagcacagttaccgaggtaccatggggtggagtgacaaggcgtactggtatcaatcaacctataggattgatgcaactatcaggtaggtccatcggtttgtcacacaaaccaaggccagtcaatttagtgtgcacactagtaatgtaatttgcaaataaaacattttgtaaaatggggaccatatatggtcaagggtgacttgcctctgtcttcatcttcaaaatctcgagaacccgctccaaaaataatttccatcatcgaagactgcatgcaagatggagaaaataacacaaaatcttacaaagaaaatactatacttagcaactaatagtgccattggtagatctcattttttacaaaaatttggagacttgaacggggtcaagcggagatatggataaaaagatattgattttctggaatttttggaaaagattaatgaattttggaaaagagtattctcaagaatattctttttgtcagactggcatgtggggtccacatgtcagtgatagggtgagagggagggaggtaatgtggacttacgtatacggaagggggtaatgggctcggcccaaagaggagggaggcataatggactttgcaatgtggatcgggcttagtgggtcggcctcaccagctcaagcggagagatgctgcagcatgggggagggaggttaaggaggtggggcctagtgtcatcaacactttatttgaaatcacctttaaatggtctctagcccacatgtcaatgaggtacgaggagggattagcatggatgagcggtgtcagtgggatctgacgatggggtggcggtccaaattttgccgacgaatgacggcggtccgcgagcagtggcgaccaccatgagaataagtgggagtatgggagtccttatgcgggctcagatgtggatgggggtggacaacggtgacaaatggcaggttcagacatcagtgacggactactccagccgtgcgacgtaatgtcactggtggcaaccaaagaggtggcagaggtgggtgggctatggttcgggtggaggcggtgcacggagagagagagaggaaaaggaagaaaagaggctaaatggggctcatcgaatgagagggagcataagagaaggcggcaccactcttgttgacttaagcttgagctcttccagctagcatggggaggccagctagtgagcacactgggggaagagaagaggagagggtccacaggttcatagccataaggtggtgctaggcgacaagtaagaatggaggggtgcgcggcgtggattagtgcggctggctagtgggcccgtgggattggctgtgcggcggacgttcatgctgacatgggtgagcgggtgtgtgcgggggtacgatgtgcgctcctgggctggcctgtggccgtggggcggtggcggtgcgagggatcaagttgggccgaagaaggaaaggaggggacgtctctatagggaacattagcacttcataatttcaagagaatatatatgaagggtagttgaaggatttgaattgtggtttgaatcaaaatttgatatttgagctcacaaaaagttttggatttcattcaagaggcttttgactgggatttagaatatttttgagaaaaggtcttgatcttcagtataaattgaagaacaaaaggatagaaaaaaatggaaaattcaaggaggtttggatttgaaaatttgaaatttgaataggagatatttggtgggggggggcattgatcaggaagaggcttcagggacaaacttgatgagaccttggcatttgggtttttattagagtaagtttcataatggatcagtttttattaccttcattgcatgatggactaggtggtagcataacttttcactttgggctaggtattattaccataaattcacttaacactagtggcccatatgtcagtcaatgtccgtaacccttatctctctcgaacactggtggccaacaattaacagatactcaacctaatcatagctacccatcatcaacttctctcctgaagcagcttgttggatggaggtttagcttgagagattgcaggactaggagggttgagcttgatgcagtgacgggtgtgggcgagatcgaccgagtggcctgagctgacaaaggtcgagctcaaacttgagctccaatgcacaagcagggattggaggaggtcaagctagattggtggcacgatcttgatggtctgctcaccgccgatggtgagctcaagtgcggagcaacgctcaatgcagctccagtgcaaggtcgagcttgatgcagtgtagggcaggggcttgatcaccggccagcggcagctcactcaaggtcctggtctcccagagccttgctcatctatggtagcgaccttcagctagatggcaggtacacctttacagattgggtacaatacaactcaatggagaagagagttggagaagaacaccggttcaatgtgcaactattgtacagttaacaggcccaatgtgaaaatataggtttacctctagttcactgtgcaaccaatgtaaatattagtggtccaatatgtaattcacttcttttattaaaatagtttttaacagaccataaaatagggcatgcttaatagtttacaaatagtttacaaagggtgatttaattgagatctttggcacgcaaacgtagctacgctcagagaatctagatttttgacatagcagggttcgtgttaaaatagttttgtcaattgcatggaattcgaggtgttatagtctgcgggggtcagcgtcaaggagattggcatggacccgtatgacatcagcaccaacagggctggtgctaagctcgcggtccctttttattgaagttttctaacgcagtgtttcgaaataagttttcaaagtgaaacaatttgtcaaattttcggcctccttattacattcgtctgcaatatactacggagtatatgtccacagggtgttcgatgttttcctgaacgaaaagctgacctactttcggaaatccttcttcggcctggtgggtaccatatcagcgatgctagtgaaggtggagaaaggctccttctgcaggatggaaggggtacggctaatgctggcgcgcgttttgctggttctccagctggtggtgctggtggtgatcctctcccctctcgcggtgttctacctgttcggcctcctcatcaccgccggcctctcgctgtggcgcttgctgcagcgcgactacggcgccggcgaggaggcggccaacctcgcgccggcgctcaacgtgctctactcgctggcgctcgtccagggcgccctcttcttctactacttcacctcgcgcctcctcgggaggcggctggcgaacttggtcgccggagtttacagcttcggcggcgagggggaggaggaggatgacggcgggcgcacgtcggtggtggagtacatgcggcagacgaggaacggatgcgagaaggacccgtcgtcggtgagagggaggaacctcgtcacgttcgccgtgacgatgatgaaggagtcgtcgtcgtcgtcgctgtcgtccggcgactactcctccggggctaggatcctcgacaagctcctgtcacaggcctggctgcgggagcagcacgagctcatcaggcagcttgttgggt

SEQ ID NO: 60566 - DNA, 9151 bp, Oryza sativa
atagggcgaattcgagctcggtacccacctatccgcatggccaatctagaagagccactgcacatatacccactcaggaccctggaccatccttgttagtcgtcagatttgcctatgtcgtcgaatgtgttttcctgacacatcccatttctgaggccaaaacgttttttttttaagagagagagagtagaaagcaagaccactactgaattgtaatgtgttattttctgtagcgaccatgtccaaagaggagcagcgtgggctacagggaagtgggagtaggcgtatatatatatatatatatatgtatgtatgctggcatgtcccctctctgttttaaaatattaacatttttagcatggtgacaagttaaacaattttaactttaaccattaatagcaacaaaattaaaaaaaccaatcatgtaaaattgacgttcctaaatttatcattaaacaaactatcataatatgcaactctttttatttaaaacatcttacttttatagatattgttggttaaagtagcatctcggtgaccgtgtcaggatctaaaaaaatgcttatattttgagacggaaagagtatatacatgggcaatataatgatgttatgaggtgatggttgacaaaattcaaaaccaaatcattagcaaaccgtctgctaagagacaatcatgagtttatccacgcgagagatcggaggctctgactgacagtaatcactcagagcgatggtcgatggtttcttcagcttgatatgccacaaacaacaagaaggacgaaaacggcccaaagttgctgcgtcgcccgggcacgtgcaccacacagtcgaacgtacggcgtgggattggatgcccatatatacggccgtgtgagccggtggcttggttgccaaacgttgacattgtgttaatgaattgctaagctaatattacctccgttttttaatagataacgtcgttgactttttttcttacatgtttgaccattcgtcttatttaaaaattttatacaaatgtataagatataaatccacttaaagtattatgagtgataaaacaactcataacaaaataaattataattacgtaaatttttttaataagacgaatggtcaaacatgtgagaaaaagtcaacggcgtcatctattaaaaaacggagggagtataattaacattgtgttgccgaattctctctttgatattcatcttccatccagggtttataattccgatcgattttggtaaaactgttagggttcggtttgtaaaaaccagacaattttacctggttttcatataaataagttaacagaaagtcatggtttttttttatcaatttctattggtttttcttggttttcggtgaattgatagggaccggttttcaactcgaaatcagaaatgtgaaacctgatcgggacatgtcagccaagaaacgatgacactcactggatgaagttaatagctacgttctggtatctatactgacttttcattgcactgctaaggcccatgtttaggttccacctcaaaatttttcaccgtatcacatcgaacgtttaaacacatgtataaagtattaaatatagacaaaaaaataactaattgtatagattcgcggctaatttgtgagacgaatcttttaagtctaattgctccatgatttgataatgtagtgctacagtaaacatttgctaatgatggattaattaggcttaataaattcatctcgcggtttactagcggatttcgtatttttttattagtatccaaacactctatacgataccctatataatacccgatgtgacacgttaaaactttacactcctggataagaaaaccggaggtgccagcgaaaactatctaatggacgaaccaaacggaaattggacaaaccatattcaaaatagtcagaagccgtatttcaacttcaacgttagttcaccagccacatgaacagttgttgcatggaggctcccaaacacgaatattagggtatgacctataataataaataattagagggggtgagacttcgaacctagatcagctagcccaccattttgtaaagctagccataagacccttaggcgttactaaggggcttaggatgagtgtaacaatgaggtcctatgccgatgagctatactatgcgcaaaaactgtatggagcggatgcaattcgaaatccccaaggtcaaagatattttctcgacacctcccattccgatcgagcccatcacttgatgtatatgccagttttcttggtgtcgaactgattttcctcatcgttcatgcatggctgatttgagcccgtaccttaaggaccatgtcaacatgagagtgagaacaatgttgatatatatatgcacacgggcaagtgaatcagtagatgtgaccgttagatggtgggtgggattcataaattagcttcaagcctgcttgattaagacacgaaaagattttacctacaaaattacattggtgtatagtatagtatttgtggcttatgtataaaaaaaaggaaaggtaactaaatagaatttccatatataacaaaaagaaacccatctaaatagaatttgaaatttccaagtgcactttaatggcatttccaagcttggatggggactagcttgacaacaatagtgttaaaagaaaggacaaaaggccatttcattagtgcatttttattgcgaggttatccttttaagcccttcaaccttacccaacatgtccgactctacagccatgtgaatcaaatagctcaactaattgacaactaaaggtgtgccaaagttttctcgcagcatgagagaatgtggcccatttacctggtgatctttcgcacacagttcaatcatatgctactagatgctaccacaccgtcgagaattagagaatttaccatcaaattcgtgtgccttaatttttttacctcttaactcgcataccctctataatatattattaggattctttcttggtattattagtttgaggcacacggatttgatgataaattatctaaattctcccacaccgtcacttcttgatgcgtcctctctgaggaaatcacgcttataacccacctggtgaaatcaccaagctggaggagtattagtctcatacgaactggggctagacgtgagtataccttaacgacaaccacggcaaatcgacaaaaacattttccttggtgtcactcaatcccaaaactatatgcattctctcgttgtagatggatatggcacgattaattgtcgtcctaatggtagcaatttgatgttttggggcgagaagagagcatgggctctcagcatatattgtgatgcaaagtaggacggacagaagcaatggattttgagaggcgcatgcagtgaaggccatgcatgcactgctgcctagtatttgcttctacaaactaatgaaagcaatatcaatgtgtattgcttcttaaacttaggccatccccaacccaaaaactatctagtagtttctatactagctatgtcatatagacactatgtatagaaaatatatatccaatggatggtgtcttcaaattaaattatcatccaatcacctttcttctctctccttttatccacctatccccttgttttcattcttgattcttgtagagatagtttctttatctttttatctctctcctcattaactttcttgccacatcagatttttacttatgtggcaatatattaaatgctatgaaactagatgacatggagggttaggatggccttagagcaagtttaatagtatagcccactgctaactccaatttatctatagccaatctaataatcaattcatacaatagatatttactgtactattaatatatggtcccacctgtcatacacacactgtgtcttggagtccgtgctgcagctggctacagatctgtagcccattgctcttctttctcatcttttatctcattaaaatatgtttatagctagctaatagcctgctattgtacctgctcttatgcaaggtggagaattcaaagagcatcactcttaggatgcgttctgagatgctaaaggccaggtttctaataaatggtgtgttttttcaaatactttatatacaaaagtttcttaaaaaattaaataaatttggttgatgcacggcctgccaaatgcatgttttattgtcgttatagcgtattattataccgtcttcgcatttgaattctttacatgtacgtacaattatagctcgaattacttcggatctttctagaggcatttaggacactgcgtctttgattacagcaataataacatcaccaatacgagcatatcgctgattactagcagctcctatgactcgaatacacatcaattttcgagctccactgttatctgctacatttaaaagggtctgaggttgaatcatattattttgattttaatttgttatttcaatgctcgggaaaaaaaagaaataagtatctaattagagctcgctcctttagtatttaatagggaaattcccaccgaaaaagctatgaaatcacgttgaaaataaggcaagcaattagagtattacgtaaggaaaaatacctcgcagagggtcttatggccgcttattcctattccttttgcgagcacaatactaattgaatccactccccatgtgtgtgcttctgcacctatccgggaaagaagagtggtgagattctttagcccgagaggggacctgggccggattcacaccaatccatggcccaccaacacgtgccgccgacgagacaaaccaaaccctcgttaattcgcgatgccaagtagggtaaatactattatggtatttgaatcttctaaagataaagatgaatataaagattaagtgtttcataaaaataaggttgtagtactgtgtaattaattaagttttaattattataaatttgagaaatggattaatctgatatttataaacaatctaagcataagcacacagatcagtgatgatttaaacacatagcctaattaaggtcaaaaaggaggaggggacacctatcctcatggccgatcgaactgagccactgcactttgacccactcaaggcccatgactatcaagcctattcttggtagctgtaggagaattgtctaacattgtcgaacgtgttttcctgacgtctcccatttctaagtccaaaactatttttcaagagggaggggagtgagaaaccaaagccatatcaaccttgtcaccagattgtaccccccctttttttttttgacaatgtccgaagagtagtgtgaatggactccaggccagggaagtgagtacgcggatatatatgctggcatgcgtacacatgggcaatgtaaatgaggttatgagatggtggttgacaaaattcaaaagcacatcatcatcagaggggggtttcctccccacgcttgagatcagaggccccgacaatcaagaccacaaatttgataaattcctataagattttatatggcgtacatttgatttatgtattttttttcttatttctacgattttcattgacgcgtttcataggagccctaaattaacctccgagggttgatcgcaattcgcaacgggtggtaattgctaaacccagggatgtaattcccaagtgcatagcacgctagaagtacgcattggccttgatcggccgcgattgctaccatacggcttcagtagttgaaagccgctgcaagtgcaagcagacattttgatgagaatcggagaagctagataactatggagatggtccgttgagccttactactgttgcccaaagaggcaaatatctatgcatgagccatgacaacgctggcgagctgtactagcggcctacactgtcgaaggtgtttttcctgacgcccccatttcctatgccaaaacttggatacttgagagagagtgtgtgtgcacgaacttcaagtatgtatggttaattgtacgtacagatgttgcttgacattgagttgttctcagtcttagtgagatgatgtgatgtccaaagaggaggagatatatatgcattaaggactactccagtacatagatagaagtgagtaggtggatacttacagtggtggagccagaaatttaaatctgtgaggtcaattactagtggtttgtatttaagtggggtcatttctctaaattcttttggatttatacatgaaaattaagatttataagatgtttttcaaaaagctgtggggtcagccgaccccacagaaatggcctaaatccgccattggatacttatacatactgatatgagaacacatgagcaaacaaatgagattatgagttggtggttgacaatattcatcaaaagcatagacggggaatttgtcatgataattgggaaaatatatactgcaaaccatatatgtagtgaaaattactgttgaatcgaaaaatgaacgtctaagattcgtccacatcaccactcactaaaatttttactcgtgagtaaatctactagtaaaattcctcgtgatgacatggactgatattttccctgataatcagagcgacgctcgtaggcgctccataggcctcgtcatcttcacagtcacacaccgaacgcgacaagcagaccgaaagcccaaaatcgcctctcgcgacgcggcccaataactcgtagcccatttagccgggcgcgtgcacccgattcgaccaccgccaagcccgaatgattccaccacacgccaccgattcgattccgaccgttgcgtccgcctcaggtgcgcgcccgcttttccaccccgaccgttgccagccagccaccctcgattccgcccaaaattcccccttcaaatccaccccccacaaacacgccaaaaccgcaaccaaatcccctcacccccacgacgcacgcgaaaccacctcgacgaatccatggcggccgacgcgctcgtcgtggcggggcaggcgaaggcgaggcacccgctgagccagatcgcggagagcgggacgcaccggctgctgctgaagcagtggctcaaggaggaggacctgctcgcccgccgcgtcgccctgcgggaggcccgcctcgacggcgcccgcaaggagatcgccttcctctactgcgccttcttcgccttccacgccgcctccatcctcctcctcttcctctccgcctccgcctccacctccgcggcgtgccggcgctcgtggatcccctgcctcgtgtcgctgctctcgtcgctggccatgctgtgggcgctgcggtacaaggcggacacggaggcggtgctggagcggctgctggcgcgggagcgggaggacgcgctgctgctcggcaagtgcgtcgccgagctcaagcggaaggggctcgagttcgacctcctcaaggaggtggacgcgctgcgccgcgccaagagcctgcgcgtcgaggccaagggcggcgccggcggcgagaggcccaagcgctgggcggccagggacctcgccgtcttcctcctcttcggcgccgcctgcggcgtcctcgtgctcaccaggtacttgctctgcaattagcccacccaaccgcaagaggaggaaggaggagatcggatcgcagttgcgccttcttggcgttgatctaatcccacgctgctcgttcgtgcagaactgtctgttctgcgaattttgatgttggttactcacttcgttcagtttgtaataaggacaaggattcgatacattttattttgctttttgtgattgtgattatttcagagagcaaatttactctccaaatgtgcactaatttaagtagcctctcatctgaatttctccaatccccaatcactccattattcagaggtagtgatgttcagaattatttaccttgggacaaggattttttgcttgaacaaaaggttgggatggctagaaggagctagccatccaatggaattaagataggaggagtcacatatttccaacccttcatttaatccaggcggaaggtgaggagttcaggaatcgaaccctggcttgaacaaactttggacaaaatttaaaccgttaaaattgatatttttttgaacggaattaaaattgatatataactggtaaaatatgtattcactcttcagattgtaatgcactactaccaatcagtttcaggacctgggctgtcgacgagtgcaaatttcttgtagctgtcaccgtctgaattctgaaattagatgtgctgaattctgaagttggatatgctgaattctgaactctgaagtagatgaccaaaaaaaaaaagaggaaaattgctgctttgcttgtccagtagacacacctaatgtcctaatgctcaaaccattcagggggaacaggaacaaacacatagcagcatgactataattttaaggcctatgcatgtttacaaattagtacaggttcaagtggatatgttaattttgttacttcaacatggaagttggatctcgacagataattccatcgacacttggaagttgacactgctaggtacagtggagtactttgtttccacataatcaagcatttggttattctaacagaacttacaaactaaacaatgctgaatcagtagacttgatataagtggcgcccaggttcactcatgctttgagtaaggtcatcaagttcatgtgtcttgtcttccctctgcctacaaaaatctgcctcggcaacatgagaaataataacgaaccgtttctttccaacaaattttcttgtggtgctccatttaatgtggcattattctgctaggttcattattttgtttgcgctgaatccactacttggttcgtcgacagacaatttatgaatatgaaccaaataatgctaaaccattaaacctgagatgagtggcaccaaggttcactactcactttttaatacaacagaataggatcatcaattgtacataaccctttctttccaatgaaatatcttgttatgctttcagtagacaatacgatgcaaaaaggagaaatgttaatttcatagatagtgcactcattaagcgctgcaaaaacaaatactacctccattttttaatagatgacgctgttgactttttctcacatgattgaccattcgtcttattcaaaaattttatgtaaatgcataagatataaatcacactt

SEQ ID NO: 60567 - DNA, 27857 bp, Oryza sativa
  unsure (1)..(27857): unsure at all n locations
ggggccgactggaggactgacacatgcaggttagcnnacccacannagtctttcagatctagcaaaactccatatatatcacggcaattttcaccgtcatcatacatatctactccgcccacctaaagtgactttaaaatttgtctcaaaatataagaacttctaaagtagtaatttatctcaccttatctagtgcgtactctcccaagccactcgcccatcaccacccgaatatggattagaccaaaaccaaccggcaattaatgaatcgggactagccacctatttaattatgagtattgtgaacttttgtcttgctactcatttaatttgttctaaaattactagaagtccttttaggacggagagataaaatattaaatgtgtaaatactttggtcatatactctctccatcataaaaagaatgcaaacttgcatctaaattttgttagaaaaatataattatatagagagtagtacaactttttcttgcaacccctagtttgaattaatttcttattatcttacccctaaaatcacccttcatttatattaaggccggcaattcatgttatttaatttctctttcctattaatttttctttcgaagttagaattgttctttttctttggattattgtatcattccagcagtcaagaggaaaaaaaatgatgttgcattgtgtacatgtacagtgcccctggttgcacaacagctggccataaagcgcaaaatgcatctatataatcgatcgagtgaggaacagtaactcacgtctgacattttgatacaataatcctcaaagattcggtgaaattttctttctgatccctcgagcactacgcgcactgtgtttcagtctcctcacatatcatgtacatactacatatacgcatgcatactgcatgcagtatacacacaacaataaaatatatgaataatgtgttttcgtattgatctgcaggtgtgtactgcatattgtgttacatgtgtgcgcatcacaaagcaatatatatactacaaaattaatgctttgacgatatcatcagatcttcaatttcttatcgcatgcatttcataagtgtatttccaaaggaatccaaacaataatttcacttcatatatacttatgcatttcataagtatatatagagagagagagcatttaatcatataaaccaaacatgtgcatatgcgcgcgatttcagcaaaatagttaatcgatcatatattagatactttatggtgcaaaattgcataaagcaaagtggtaaaatacatggttagtcgtgtgcctcacaacagaggcaagagatgtaaaccattatcgctattaaatataaagaaatggtaatatgtatgtgctagctaatttggcctgattaattgcacatgtgtttaattcgaaaccttggtaatatatagctaacatgattatattgggcacatgcaaagtgtgcacatgatcatgtgatcgatcaggacaagatttgtataggtccttgtctattagatttgttaggttagcagcagatgcacgccaaaagcaaaaggctctgccctatatttgtacatgctcaatcattaaaatttaatttgttgagcaaaactagctagccaccaggacagtgtcatgatcgatcgatatatgtactatatatgcttgtacattgtgattaattatttagtagaagaagactgtgcatctacagtagatgaccaagaaaaaaatgtgaatatattggatccatgcgcgcaggtgtgccgtacatgcatgcatgtgttcaaatgagagagagagagagagattaaaggagcaaatcgatcgatctagcttttgcttttgcctcttttaatttttgggtacttgaaaagggtggccagtctatgtaactattctagctagtagaacgaatctgaatagaggtatgtctatattcatagtactaggatgtgtcacatccatttctagattggttttttagggacggagagagtatgtgcgatggccatatatgtacacaccgtaaagtaaattaattaagatgtactatgatccattgtacctgcatatatatgcaaattaagctagctagctaaatatatatatcatatggattttcgaagagaagaaattaaattaattaagagaaatgaggaataattgattggcgatcatggaaatttcgaattctggtggaaggaaaggcatctctattgtaggcagctgaatccgaatagaaaaggttatctcgatgagctcgatcgacaggatctctatggccggtggccgggctggggggcactgacacgaatgcatgcatgcaccatcatataatcatgcccttcagctggacactactgcatttcgtatccgatccatcgatgatgctacttcaatccctgcatcttttactcccggtttgcaagtctttaattctatttttgggagaatacatatatatatggccttatgcgtgtggttggaacagactaaatgcactttaacagtcaggtggccactcgagctctatcgtcgtcgacatttccactatcttgttctcagtaacacatgtaaaatttatcaatctcttcgtcaactgggctcaacgacgccgctatatcttcgccactgcaccttacaatctgcaggccatgtagttaaatgcaagttatttaataatcttcactaatatattagcgtgtaatccttttgtaatcttcattaatcaatttgaagcatatgtgcataatggcatattattatagaaactagcatggtggtccgcacagattgcgcagctagcatcattatattttctttcatataatagcatactagaaaaaatgcccgtgcgttgcaacgggtaaaaccatttttggattgatatacattgtaccttttggttttggataaaaacttattttcttccttcctattcagtcttggcccaacccgctacttctctctacttggcttacttcttttaaacctagaccacaagtagagctataggcctagctcgtatagtcgactgccgtcttcaacctcgaagacagtaccgtgtagtatgatgccagaaccaatactccccatcaaatacgatccaatctttctcaatctcctaaaattggttgagtgctcttattcactcgatcttttctttccgtttttatcaaaaccacaacgaatccataaaactctaggatataaatggtgacttctaaatatagagattgaatctggtaaattaaagcagaactaaaagaaaaaattatggggaaaatgatgatggagtagtggagaactgatttttcaatcaattggaggagggaaagcatgagaaagccaatcgatgtggcggtggtgctagagttcggcctgacgacgaaaaaatcgggtagataaaaaaaagaatcctcacaatgtgcacagaccctttctcatgacaaaaattgcgaataaaatataaggacaaaaaaagcggatgggaaaaaaagaaaagcggaaaaaaaaagaaaaaaaggcggataaaagagagggactttttttgctgttttataatgttttttttctctggtaatttttacggtcttttttctacaccgttttttagacgacagtttttttttcgcgtggctttctttattttttttacgatcgacgacttttatatttttgtacagtcggttttttccgtttttttcagcttttttcagtagtagagattaaaactgaaaaaaatattaaaacctactcaaatacagatgacgtaccaaaatattggcaaaaacatcttaaacttttataataggtaaagatatgttttctcattatattattcaaatatattaaaatgacatcataattttaaattttgcaataactttacgaaactacaaatgtgtaatactcatattgcattttatatacgtgttagttattaattatttttaatatcaaattttagttatttgtaaattatatatattcctatatggactctagactcgtcttttaatatttctttttttaattccgaattttctgtaaattgtatttctatatagactctaggctcttcttccaatattatttatttttatttttgaatttttattatttctaattgtatttctatgtggactctaaactcatctctcaatattctttaatttttaatttcgaattacagttacttcattgtattcctatattgacctttaactcttcttcccatatttttcttaatttcgaattttagttatttgtaaattgtatttttatacgaactcaaaactctactttaaattttaattttagttagttttaaattcctatatggactctatactctacttctaatattccttattttttaattccgaatttctattttttttcttaattgtacttctatatggactctatactctacttctaatatttcttatttttaattccgaatttcagttatttcatgattgtatttgtatatggactctatactctacttctaatattccttatttttaattccgaatttcagttattccctaattgtatctctatatggactctagtctcctcttctaatattcctttttttttaattctgagtttcaactatttctaaattgtatttctatatggactctagtctcctcttctaatatttcttattttttaattcgagtttcaactatttctaaattatatttctatatggactctagtctcctcttctaatattccttattttttaattccgaatttcagctatttctaaattgtatttctatatggactctgctttttctttttctccgattaatatgagaatttctatgccatgagagcgaacgtggagactcctttttctatccatttaataatataatagatgttttttttgtcgatggtatattgtagaatgtggcttcactgatgcatatatatttgtagattatgttgctaaccttcatttgacagatgtttgttatatatttctgttgaatcctccactgttggatcagtgtgacgattcatgcttcaatcctttagctccagcaagatggcggccactctggtgagatagcgacgacccaaccagttagggtcctaggttgagataggagtaggaggtggccaggtggatggggtgagggagggtgaggggaagggggaggagggaggagttcactgaccttagagggatggctatggtaggcggcgtcctggcattggtcagtggaattggtgattagcgagacaaccacaacactgcaaagctgcagggtcgccagtggggcggtgggccaatgttatcggcaggggcaaagcggagggagtggttaggaggcgatggatggtggtggcggatccaacgatggggagccaccagtgatgggaaagacggtgggggcgttggcacctcgctaccaatgacttaaggatgaggtgagggagaggcagggggatggtacgatgggccttaccgatgccattgagccctgtcgaacagcaacgtgatgggatggtggcagcaaaggagtacgaggaatcggtggatcagagacggtgttgaattgacaggtggcggcacatgaaagcaggagtaaggaagaaggacgaggagttagggttaagtggtggcgccgaatctcaaagaagatccaacagttaaaaattcatataattagggattggattttcggtcaactaccattcccctatatttaaccctcactcatagttttggaacatggatctctaaagctaacgctggtgatcagctgtcaattaattggcgttgtcagctagctagagtttgatccggcactgtcaaatagcaataccgatggcgattgatcgatctaagaacagtgtaatgtacggcatgcaatagctatctaataatgcccaagctttgtatgtatatgttccccgaatacaagtaagcagtagcaatgcaatgcaagtatagtccacatcattaattccattattgacgaagcatgtcgcttttcatgtaatatacttatataatatacatacaccactacagaaaccaaattaaatagatactggcataaggatatcggttcagattaaaccggcacctattatcagttacaagtaccggttacgagataaaaccagcaccaatattttaggtctccgttattaaaaaaactgacacctatatatagttcatccaatcactatggagcacgcttatatgtaccggtataattttattaaaccggtacctatcatattaggtattggttctcctaaattagttccagctcggaaaccgacacctatagcctgtttctaactggcaccaataaaggtttttcagtagtgatgcatatacacacaagtaactacaccctcggtaaaaaaagaaaccatcttctaagaacgaacctgaatgaatgtttatccagattaattaatccttagaaattgtcttctttttttttacggagcgagctgtgtatatacgagcggtgccgtgcaccgttgagcagtcaccatcagtgccaatgccggacatgtttatttgcatctgtacacaacgcacaggccggaacgatagatcgagaaatatataaattaagattattttcataggtacgaattgacggtacagatcttgctcaactgcatccgcatggattattcatatatatactctcccttttccaaaataagttaacctcctatactatgtgtttgaacttattttaagactaagaaagtacaccgttttatcgtctctgcgaagtattatatatactaaataaaaaataattagaaacatatatacctatactttaaagttaatcatgatatatattcaattggtaaagaaaattagcacttgtggttaattacccctgtacatctggtcaattaatgtaataaatgtaatagtctaaatgcacgtcaattatctagttaattttattagtatagaggaatattttagaagaggtggataagaaaagaaggcacgataaggtatcgagacaagctacatgtgtcgtgcatgcaagagaagcctaacggtactgtgtttgtgcttgttcaaacaagatggtgctgagacccctgtcacgaacgtcggtggggatcggctcggccgccacgatggtaggggtcagcaccaaccgcttgactgctatggtattgtgctcattttatttttggataaaatttttttttgcacggtctagtttcaaaataaatttttaaaaaaggctaatttgtcaaaaaaaaaagagaaaaaggtatttttaggtagggtgaacttagctgcatgcctgcatatataaattagtatatggagttgcaaacatggacgatcgagacgatggagctagcccagcatctggcaaaaagtgccataaactagtatatggagtatgtgttacagtgtgatcaagatgggcccacattggcacggtggggccctatggaactaggatgtttgtatctttcccttagctagtcagatctgatatgatcctcgtttattgttaatattgtcgagcctacatgttcgctgtcatatatacatgtctctgtctcgatctctctttttatatatttgtatatatatgtatacatgaatatacaaattattgatcgacttcgagccgagagtgtcaacccagccatatatatcactgtactggagaaatcatctttgtccggtcgacaaaaactacaatattcctgattgcaataaaaaccgggactaaagatgatttttagtcccggtttataagcagaacggactatgtgatctttagtcccggttcacatgctgtcaggggctgtcagggcccttcgggatctttagtcccgattggtaactctaaccgggattaaagttcggatcgttagttccagtttgtattataactttagtctcagttggtgttactaaccgggactaaagatcaaaacacactatataatctctagtacttatcctcttctcccgtccacacaaactcctctatcttaattttctctctaacttatctctttccttccttcacacggttcacagccttatctctttcttccttcacagttcacggctaagcgagcgcatgaggagggtgggccggctgggcagcggcctgcgaggcggcgcggaggcccgtgcggcggcggccggcgcagatgggatggcggtggcaggcggatgggagggcggcggcggggatatttgtcccttttttttgaagaatttgtgattcattgtatggattgtgatgtataatttctttttttgagaatccgtgattcattgcatggatctgagatgtataatctgtgatgtatttgatttgtggtgtttgggatgttactttgatttggcgtttgatttggggatatgcatcccactcgatttgggagaaaatcagttagggattaagtagtaagtagcaataaaaacaatgaaagaaaaaaaaagaaactaatcgggactgccgctgccctctttagtcccggttggtattatatcaatttttagtcctgggtatttgaaccgggactaaagatagcgatcttatttagtcccaaattcgtagtcccgattggaaaactgggactacagaggattacaaaccgggagtaaaaacgatttctctaccagtgtatacaattacaagtatacaacccagcgcaaatcacacaagaaaaatcgaacaacaaaaacactaaactagctcactcttgtagtcttgagtgtattaggtatattctgcacgattctacactgaaggtttttttaattaaacacattatggacatccgtacataacaaacaaaaacctagcacgaaatgtgacatatcgatcctagtactacaaataatctaaacattcattctatccagattcgtagtatactaggatgtgttatatatcgtactaggtttattttttatgagagggaggagtagatggtaatatatatgagtgcacacccacctctgcaaacatacacatgtgcacttacctatataaacactttttaagattggtcgctacatattaagattgacaaaatcatcacacacacacactcgatatcgataaaatatcgcctactcttaaagaaaacttattgtaaatgcaattaccattaccaaatctagaatttgaatcccttgcaagcgtagaagttgtttagtttggcgaagtctttcataaatgtaaattgtttcagaactccatgcattttctttccatttcgtgccatcaaataaatgttactactaccttttttttaataacaaaaggtgtaattaacatttacattttaaatcatagagtactttactataggaaaaagtccaaataccacccccccccccaaaaaaaataaactttggacaaaagtctgtctagcaccctaaactttaaaacgggacatcaaaccccctaaactttgcaactgttcatattacccctaaggtggtttttatctaatttgtatataacttgaatgagtttgatcacgtgacatacacattagatatatatatatatatatatatatatatataaatctccacttaaatctttttctttttaatcacttgttagctctcacttcaaacaaatattgtatgctattactgtataagtataaattgatgacttagaactgatgatacacagatatgttataatagttattcaaagttgttcgtttaagcttccaaaatatgcaaaaccaccattcaaaaccactttagggggtaatataaacggttttacaaaatttaggggattagatgtcaggttttaaagttaattcagggtactaaatagatttccatccaaagtttaagggagtatttggactttttcctttactataacttcgtaacaagtaagtaagaaattaattcacttgttgtaaaaaaaggaaagaaattaattcactttgaatgttacgcgcatgggcgtcgaccgtccacatgtgttgattgtttgtacgtaacgtaagtagttattatgtggtcctgtctctctctgggtcacgcgcagcgtatgtatacatatataataccacgtacatatactacgtattttctccactgtggtgcgtgtacgtatgtacaccctttattctacaagattatttaatttatgatgggttttaagatggtacccagagatatttagagaaaaatgtgactggaagggtttatgtgattttgtatgatgcttatgctgcgatgagcgtggcagcgatgacgatgtttggataaccgtatatatgtaatatcatacgagcaaaaactggataaccatatagataataacgtacgagcatgttaagaattaaacacgagaccttaggatagaaattgcatacctcttaccactgcacatactccttaccattgtactatcaagtgcatctcgtaatgtactattcttgaatcattactagtgatctatctcatataaaagactaaaattccactgatatgtcgagaaccagataatgttacgtttttatccagttagtaaaaaaaattataaatattagaaaagacctaatatcaaataattagaatgggtgaggcttcgaacccagatcttctagtccatcaccttgtgaagctaccaggtttttacccggttagtgagttgaggtggcatgtcacgcatgcatgcattattgtaccacacaatatatatatatattatcgatgtatatatatatatatacggcaacggtcatgtacgtaagatgtatgggggcgatcaagcagacatatatacggctgcatgctcagcttgatcgatcatatggattgccggaggtctcagcaaccacttggattctagctactagctctctctctaactcataaatttcggcatgccatgcctgcctcctccattttcggctgcagtgtgtgtttacacgccaagcatatactcatgtacatacatacattctcaaaatgctgctctgactttttcatcaatatatatattttttaaaaaagtatatgtagtaatataatagtagtattaattgaagtacactagctttgcattggtgatcataaaccgtgttgttatattaattcattggcactggccacttattcagtattatcgataatatggaatttaatccagtctctgcatgatctatatggtaaatatatgataatctaaatgctgttgttagtataaattcatagtgaaaaaaaaaatcctgcaagaagctactagctagctagcttatcagctatatagctaaaatttaaatcttagaatttaattttagagttatttcatcatcgcttatttttcagtataagcttttaaaccggtaattataacatactttcttcgtttcacaatataagtcattttagcattttccacattcatattagtgttaatgaattaatatagatatttatgtctagattaattaacatcaatatgaatatggaaaatgttagaatgacttacattgtgaaacggagggagtagatatgtatgttttagttgtaaactattttatcactttttcatggtttatcgtcctcaaacgatcagaatgaagacttgaagagtatattaagtatagctaggaggaaaaaaggatcattggctgctggtgtgcaaactgcaaattaagcaaagggccgggtgctcccaaaagagaaggccggtgttgctagctagcgtggcatgcatggtttgggcaaaaagggcggcaaacgactaactggagtagctaaatgttgtgtctcaacggaagtcatcactcacctgaaactgcatgccagcagcgctagcagccgagcattccatttcaatgtatttcgttgtgctcgcaacacctctcctagctagctacatttactaggctctgattgggggagatggaacataattttgagaagtaggacatgtttgacagggctctaatttataaatataacataatttgtggaacgacttgaacctgttccaccctctaatttattttttcatatcactttagcttgcctcgctccctttttaggtggacctgaaattgtatgatcgatcatttggcaagcctttagctccagaagaggtggagatggagtttaattcaagccaaacagatcgtagtagagttaggttcccttacttccaaaagcggatctaggaaggattagcaggagaggcttaatggagactcccatggttacaaaattggtagtgggggctcgagaccccgccgcccccatggtagatccaccactgtttacttcttgttactagttactctatccgccccaatatatagtaacctagtattagatgggacatcaccaaatctagacatagatttgttcaaattcatagcagtaggtgatttatattttaagacagtaaaataattttctaggttatatagctacaaaatctgagagtctagaatgtttacaagagctagaatcagctgtcaaaagctctccaaacggtcggcataatttgctgcaccagcccatgcatgctactgctcatacatactccaaattcagagagaagtgtagtacatgtactttttgtggccttaactttgggagagtccaaaaatgcatgcctggctttgcattgataaaaagaaggtacgacataccgttgatatatcaatcagtcgactgtagatagtgagcttggaaagtactactatagtgctgccgcaggaagctgaagaagaatatatgtgctgcactttatttgtacctatcgatccaattgttttttatatatacttacttagataccatggtacacatgcatgccattcaattaattatcctttcgaagcactgtactgcacccacacaaactggaaatatacatgtacaacatattcttttcttgctatatatatcactcattgatgaacttgttgtgttcctgttggttaattatgcggtaccgtaccttttcggctttccttttcatatttggctgatcgatgttaatgtatgctgtcatcgtttgctatgacttattattaatcattgttaaatttgaattttaaaatttaattctacagttgatttttggtttttcatcataatttattttccagcattagcttttaaaccatgaataatacacatataaaaggtttttacctattatactttttttgcatcatccatttttctactgcttattagccatatatataaagctcaaaccttgccagtgtgacaagaatacactcatacgtatacacatgacagaatcattaatttagcccgcatgttttctatctagtgagggtttttttcataacaattaaaatttttaactaaaggggaatatactaggatttgtcactcaatactcggtactttctttctgttataatccatttccattatctaaaaaaataatgattagtatttctcatttgtgtagcggtgaccactcgacttgaaacttaatggtagctagagaacgggatctcttgaaaatcagaaagatgcatggtatcgaaaatattcgggcatggcaaatagcaaaatattcagagatgaggtgtgcaggctagcggctggatctgtctcatttccgggccggccttttgcattatgggcttgtttgcctacttgcttgaccgcaaattgggtcgggccggacaattgttaattgggccatgtatgcaaccgcatctttctttctgtagatcgaaagatccatcgctttgtcactgttcacgtcgtaatagcatgtagtatgagtagtagatgacagacaccccgtaaaaaaaaagtagatgacagacacaaacatactccctcctttcctaaatacttgacgcagttgaattttttaaacatatttgaccgttcgtcttattcaaaaacttttgtgaaatgtgtaaaattatatgtatacatcaaagtatatttaacaataaatcaaatgataggaaaagaattaataattacttaaattttttaaataagacgaacggtcaaatattttttaaaaagtcaacggcgtcaaatattttgggatggagggaatacatagagaaaaaggtccagcatctatgtattcgctagttagcgtgtgtgcacttgcttatcttacgagctacgttggagatccatcaattgatctgcttgtttatgtgtctagtgtaacatcagattagtgcaacgatgattgagcaaggatcgaaaagtatatctttctatagatccgatcgatcgatcgatcgatctttttacctaaattagtggcacgagctaattaactaagatggccttgcaacacactcaaaaaacaattgtggaatgcaactcaaaactcactcgatcgatcgcttacaagctactagctagcaatctcctgttgcaacatgtgtcgttcaattggcatccatctgcaacagaagaagagctgcccattgtgctacgccatgcatgcatccatcccaattcccaagcagcagtagtgagaaagaaatgggaattagctagggctttgatgccaaggaaggcattgatttgaagcaacgtagtccggctgctcaaaccgtagcatatgagccaactccatcccatcacttgcttcccttgcaaacgcaaccaacaacccattcccatgcaatatatatacaccacactgctgcatgctcaccaccacacctcactcccctctctacagcaaccagcattccatttccatagcaatgactttcaaccctggctctcctggcttcggcttcccctttcccttctaccctcccaatcccaacccttatgctcccctaaaccccaatgctccgaagccaccggtgatgccaccgcgccctcaagccccgccacccccgcagcgtttcccgccaccacctgccccgcccatccgacccccgtcaccttcaggccgcgctccaccaccacccggtcgtgcaccgccaccgccttctcaagccccaccgcccccacgccgtgctcccctccacccgccctgccaccgccacccccacgacgtgccccaccgccaccatcaatgcccccaccaccaccacctcgtcgtgctccacccccaccagcaacacctccgcccccgccacgccgtgctccacccccaccgtcaccgcccattcgaccaccgcctccaccaactcctcgcccttatgcaccaccaccgccgtctcacccactagcaccgcccccgccccacatcagcccaccagcacccgtgccgcctccgcctagcccaccaccccacatcgtcatcatcgtcgtcttcgtctcattcggcggcctcctgttgctagcatgcctcgccgccctcttctgctggcacaagaagaggagggagacggagaggaaggcggaggtgcacaacctgagtggccatgtccatgtccacaaggcgactgagtcaggccccagcggcgccaaggccaccgtgctgtccatcgacgaggacctcaaattccaggaggtcgccggcgagtcgtcgagcgccgccggagcagggagccatcataccccttggtcatggcacaggaggcagcaggaaggcaaagcagagaacaaggcagagctcatcaatgtcacggagcacatccatgtcgatgagaagattgtatcagggcctcaggggcaaaagatcgagatcctttcagaagatgaggacatcaggtttgaagaggaaggcaggaaggaaaagggagatcaaagatcaaagactcgcatcaccaagacctgacaagatgagtctgcatgcccaagtgttactacagctctaaagaaagctacttcagctgagacggtaaagttatccctacacttgtgtgatttgattattttgataagattgtatgttctttggtgtgaatgaaataagggagtctcagaccccatttggttgaatggaaagtgtaactattgctatcagcatttgaaatgaatgaaattctttaatgaaattggtaaaaaaaaaggctgtcaaatataaatagagacatctggtatctgcaagttgatttataaccaaatgtgctcactgacacaagctgtgtccatataactgcttccactatgtgccattagcagaaccggagtttctggggttaggccacaagttgaacacgcgttgcaaaataaatttctttacagggtgacctaaatgtaaattcttgtacttgctatcactacagaagatatcataatcctaggtcctaattactttgcattacttagttgattgcaataggagtaattcgcttcttggtaggcttacttgatgcgctgttcttggtcgacactggcggcgctgtcacttgtacagcgacaggagtgacttccatcttagctttgttttcaccaacatcaacttccatattgtccaccgctgaaggcctgtcattttcacttgtcgcatttccttcagcaacgtcctttgtcactgtgagtttccaattaataaatcgtgtaaggaaagtgtcttgagggaaaaaaaagtaaacaaagatagcgagcacatccaagaagcagatacagccacaaactaaatttatttactgagtaaactaaaagcactttccactatttgcggatcactgcagatgtcgaaattcatgaggtaggaaactagtggagtaactaatcttaagcttactcaatatattgttctgggccagcactggtggtgatggtgtcacttcaacggctgcagaactggcttttatcttagctttgctggaaccagcatcaatttccatactgtccacctttaatggcttcatgttctcacagttggtattcccttcatcaagttcctttgttcctaggattttgaagaattgtcatgtaataaaacagtaaactagaaacaatgatcgtggcaaacaaccaagccttcacagatccaatccttgtactttagctcagcatgaactacaattaataaattcatagcaggccttatgctattcatcgaaaacaagcagattgaagatttgctatgcatacttcaatggtagctttgaattagtactaggaacacaaaacaatcatatcctgatgcaatcaaagagatcatcctacttagcaacacattatttgctttgagttacatcagaaaacaaggaaccccatgaggttgcatcacaggcaaatgaaagtgccactacaagttaacagcagaatgggtaaaatagttatcagtcacctaaagaagtctgctctgatgagtctggctggaccaaatattaataatctttcaagaggtgaacatactaccaaatatccattttctattaacaagtgagtccatttaagatatatgattaaaactatttatatcctgactggcgtaacacatcttgacagaagatggtaagcagaacaaattggaaaattgatacatatacataatccacccattagctctagaaaaggcaggcaccaatattacttgataatacatggtaataacttcaaccaagtaatattatgatccaattttggatactaacataaattttccattcaacaaagtttaaataaacacacccaacaaaataaaaaaagggaagacaaagagataccagagagattatagggcagccccaactcttcattctcaaactcaataatggtgcagaagcaatctcgtgatgacactgccaggtacttggcatcagaagacctatcaaaaaagcgaaaaggtttaaacagaaaacgtgaactgttagttccagtaagacaagtttctctgctcactgaaggctaggagtaaaactattgtaaaactcaccatgcaatatccgtaattgcagcatagtgcagaccagcatgtattagaataggagcaacactttcagtgtcataaacatacagggagttcaaagtagcaacagcaaaaataactctgtaaggaagcttgaagaaacaatctgcaacagttccatagtacagcgtcattttaagagatcagtaaaacaattagaaccttcaagcaaggtaaagctgaaaagaaaatgagctacctgattgggaaccacgcagcttgaagagaaccgggcaaaagcgcactgccactattgctttacttgcgccagggagttgtatcgcaggcctgtagcaccaaaacaaggttggtatcctaaaataaatacagaactaaatatatggtatacaggttatatgctaaagtatatgttttttctgacatataattaatgaaacgttgaaaattaagtgggacaaatgaaataccataagttcctgtggaaccattttatcagctaagaacatctgtagggaatagcatgtttttatcatagtaaaagaatgttggactggccattgaatgctcaatctccaggtttaccttctggtggaataaccaatctatgttcagcaaaggaaggtttcattcacccccgccaaaaccaaggattgatccccaccccacactttcttcacgtataattgaagttagtgggccttaaaatacaaggtcaaccattgggccttcaattcaatgacccatgtcttttgttcctgtgcaagaaccccccaacttaggatgtcctggttcaccagtttcacaaggaaaccatccgattcagccagttgccacggtctaattttgtgatttgtactcggagcaaatcgaaccactgaggttgctagttccagcttttagtaccatggtactgtatcctgttgtaaaaataaaactacctataaagaattctatgtttgtgtgtgcaagcttagagcttaggttagctgatttaaccattcagggaacacctgaacaaacgagtttctaaattgtgaaacatctgaaaaactttatattttgccagtaatgatggttgaaatgtaaaggagcaaattaaacgttataaggcaaggtcatcgttatttcaagcattaaatgtgcttctaccttgacaagtctctccttgacattacataagctgtattgatcacttcagatgaatatttgcataaacctgatcaagataaaaggtgaattagggaaatgaacttgttgatggaataaaaggtatgatgacagggactgactgcagatgaactatattacatgcagcaagaccgtataactaatgcactttagaatgacctgttttgcgttatagaaattagcagagcaactaggtattgccgactagaagtctagcactaacgggaaatttctatacctgctggcagtaccagaaaagatccatcaggcgaccatgccaatctccgaaagaaagatggtaacgtttcgtcatgaaacaaatgagctctaactggtggctgcaagataaaggtagctaatttagagcaacgaataaccaaagaatgccacagagtacattaaacaaaccttggactcatcatgattttgatgttcggccttcaccagtgtatgctggcaaacaaagttcatcctatctgtgttctttgacttgccttggggcttatttgcatatattctacaagttctgtcagagctcagtgaagcaatgtattgacccagaggatcccatgccacgccttgaacataatgcaaatgaccctccaacttttgttgccccgaacctgagaagtaaattgcatacaaatcagtataacagaggaaacatggtgctacagtcataggatcacttgttttagggtttacctttaatagcatcccatacaatgcaactgttatcaactgaagcagaaacaaggaatgcgccatcttgggaccattgcaggtcaagaacatccttgtgatggaacctatgtgataagttaggagaatacagctaagcaagtgtcaacaataaaatgggctaattcaaataattctctattttttttcagaggtttgctctcacaataatgtcttttgtactttccaagcctcgccgtcatcagtggaatgcaacttccagatgataataccaccacctgtcaattacataatagcctaaatgcatagcaaggacacaacaaatctacttgattgtctagctaaaatggagacggttttaattacaacagtttattcccattgtaataaattcatggccatgaatttttccgcgcaggtggggcaaaaaataatgtggcagtttaacataattagcctttatttatcagtttgtttagtggaattcaaacactccagcaggactagtaaatcctttccttgcttgattgaattgatagagcccctgcgtccgttagggggaaaaactaaagtaaacgtaccatcagcaccagacgcaagattttcgcctgcgaacaaccgaacggaaaaggtttgcttagttaggtatgtagaaatttctcaacatatagagagcatttcattcagaaaattgccagtgctaaactcaattcatagcagcgcttaccggaaggcgagaagcggagaacgttcaccgcggagctgtgggaggagaggctgctgtggtaggtggcagtggggagcttcttgtcggaatcatccgacgcaatcacccagatctgcaagccaatatattataatccatgacgaaatgggccagaaagccatccaaaccgcaacgagaaatcgagagcagcaaatcgggcaggggggtggagcaagggaggtgggtgaagagagaccttgatgtcgtggtcgctgccgccggtggcgaggcggcgggagacggggtggaagtcgagggtgaggaccggctgctgctcgtgccagttgatctgcaccgtgccgccccgcatcgccgcctcctcctcctcgccgcgtcaaggagtctaggttggggaaaggctagctagggtttgggagaaattggggaaggcgggaaatgggagggggatttggcgcgcctctcctccgccgctctccccgctttactagacgatcgacgacgatgagggtctctgtatgtgggctttctagtgggcccaaatgaggcccaataaccattagccaatattacatgggccttctcggctcggcccagcctacttctacttggggatatatcatatatgcgagtattttgacattgttatatatttcctctcataataaatatggtacagatagtttcaagttgtaaaaagaaaaatgtgctgacaagtagttcgaaggtagtagtatttttaccctaggttacctttttaacaaaattatgtgtatgcccctgaaattttagatgattctttcaatgtgtcttagttttgttccctaattaagaattttgattttaatccctttcatactctttattgcaattgaccgtcagttgaaagttcaataggtgtaatatatcagttttacccttagtaatcatgaaaggagtgtataattttttgaaatctatcgtgggaaacacaataatttgttgtgtaactacagtatttattcattcatgagattgttgcgtgaggaatcattttacatagaaattttaataagattacatatccatagaacgtattcgtggcatttttttaagacggtaaacataatatttagtcttgcatagcatttctttagataaaatatgctacataaaatatttgttataataataaatttaaatttaaattgcattttttttaatcatgatctaaaaaatatttacatatataatacctcacacagtaaacatataaatataatagtcacgtaaaaaaacttctccactttgaacaataaacttttttacacttcgaacaatatactccacagttttttttaagcgatatactccacaaatttagtgtgcttctttcatactcctacatgaaggcaaaatgaaccgttcgataggtattaaacggtcaactacgaaataggttacatgggatagaatagaaatttggggataataagaattggctggaattccaagggaatacacagggaactacctctagaaattttgtgtgttcgtgttttaagaaaacactatattatgagcggattagatcaaatgtgcagtgacattcctccacaatttaaaatgggagacagatatttagactaggttagatttttgtgtttttaaaaaacactttttgtgagaagattggatgaaatgtgcaggcactagtagagtagatgagttttgcattggatagtggcttctgatcgactagaggatagtgctgcctgcaagtggactgattattggataaggtgtgatgttattcatatactggtctaattctgtgtagtgaaatagcagaatgcatgatgatgatcagtagcactagtaaacacactaacactgtaatatcaagctaatccaacatgcattatacattaagaccaccaaatctttgcatacggtagctacaagatgactatctgctaatgtatatatttggtctacaacagtaggatcaagaaaaagcgtaataaaataggcagaaagtgaaacaaaggggaaattaagtggagcaataaggggtaacacacttccaaaatgcacccactaataactaggagtagcatctatctcacattatttgcaaatataggccacctggaaaatagacagaatgagttaaaaattttgcaaaatcttcagtgccaaatacagattgatgcattcgtcagtacatacccacacattcactcactaattaattaacatcaatcaatacacgtgcaaatcatctggcatatagctagagggaatggaacactgtcaaattaaaactttaattccaggaacccggattgagtggtaattaaattaatactcacactgatcgatatgttaataattcagccccctcatcaataatgaaactatacgtactgatcacctgcagcctggaggcaatatattcagagaaaacaagcagcttacagttacattctttctccatcattgctgaattactttaagtttaattaatcgatcggttcagacaaaataattaggcaggtagaattagtatatgatcgaacgtgcgattgatcattgatcaggccatcaatcgatcgattccagctgctgcatgcagcagttgcaagaactacttttctgctgccgttggttggagttggacgaatcgacggctgcaatgcaaaacagatagctatctaattaaggtagcatacatatccacgcatgcaactcgatcgatctgcagactgcaggtggaaagcaagatactagagtgcaggtacagctatgcatctacctatttaatcgatcaaaatggagtcaaaagtgtgtacttgcgcgtgtttagtataggagtagtaatgatcgatcgatcgatcgagaagttgttgttaagggggcgcctaacccaatagtttaagcatcaggctaattaatcagtcaattagctttaatttaattattagcatatgcatgagcgtgtaatataatgtacctagctacgtgcatcagttctagagaattcaattcaattcgattcaactcagtttcgttttcttgcggccgtcttgttttgatcaaggagatatacccaacaagtgatcatgcgtatatagctttaagactttggttttctttctttatttctgcaaaaagccacaagtcagagtcgttctaggacaatatgatgacgatgctactgtttgcagaggacaagagagacgacgatggcgatggagcgatgaaggggtagccacacaagatggaaacacgcatagaatttggtggtccatgttgcagcatattttcagctgctggttgacagaaattcacaagtcgttgtttcattaatttgttgttggaggagtgctacgtaccggaatctgccagacaaacatagactaatatctctgcagccaattccatcagaaattcagagttagcagcaggcagcaacaggacgcgttttgtccgatcggatgccactagagagtagagagagagaccaacaccactagcaaattgcaacagagaagcattaacaattaagcaagcaagcaatagtcaaaggcttgtttagataggtcgatcgctagtggtagtggtagtggcccattcagtgaagcaggtaggaagcaacccatatacgtacgtattgcattgctacctagctctgaattaccattcagctctagctaattagtgtactagtagatgatacttagttcattccacacgtcgtatagacgcggtctcgccatgccatggaggcgtcaacacgctggtcaatcgagaggagaagagaaacggattaaattaattaaggagatcaaactattgcagttcagactggatcgatgtatataattaattagatagttcctttaattggagctgtaaagctactggttcttgtcaaattgatgcaagattaattatagtacatatatagtttcccagctcgtcgcagacgctgactgaaaatgtcagtcgtctaacgtactgtatatgtatatagctaataagctagcggaccacgtaattaattaattaggtgataattactttgcatcattgcatcagtcgttcagcagattatattttgctgaacacaatttgttccgtgattaaaacaacaacagcgcacatacgatacataaaatttatcatatgtagtaattatctaattaatatcaataaagctttttatataaaaaagcagacatttatagtatacgctctccttctaattaacttgctggagtagtatatatcaagcttgctaggagagacatatatacgtatccacatgaggaacacgagcgatctatgaatgttaacaaaagaacagaaaagctagctaagaaaggtgcgtgcacttacattttcttactgtaataaacaatcaaaaatgaatactaaagtttactcactgcattgcaaatatgcagcttgcatatttgtaagaaatctaagtgttacaacatacgtgcattaattaattattaatttacttttgacaattactaattagccattacaatccagcaaaactaagtcggcaggcagcagataaattaaaccacgcgcgcgcggtatacacttgtgaacacgtacgtaggcgggaaagaagaaggaaaacgcaacaaaattaatggagcatccaactaagttgatttcgcctaaactaaagctgcatctactattactagctgctaattaacaacgcactaactataataaacatgctaagtggactagctagctaagctaagctactacagtactcctctcccacttgaccacctcagcttcctcctcctttctcatactaagaaagaattcagagtcaaatttctcagccacctcgcctatatatacatcccatgcctagcttaattccatcatccatcatcacacagctcactgaccagcagctcagcctcatcactcacgagcaatcagctagctagcttagcttgatcactacacctccatagatcttagcttaattagcttagattatacaagtggtcaagtcaagaactgtaccaatggcatcatcaatggcgcttgcagcagcaatggcgatcctcctcctggcgcttctcatgcccgccacgctgtgctcccgctcagggccgccctcgtccaagcacggccacggcggccacgccaagcgcgcgccgccgccggcgtcgcccgtggtgccggtggcgcctcaggccgcggcgctggtgcgcgccacctgcaactccaccgcctactacgacgtgtgcgtgtcagcgctcgccgccgacccgtcgagcaccacggccgacgtgcgcgggctctccgccatcgccgtgtcagtgcccgcggcgaacgcgtccggcgcggcgcaggcgccgacggcgctggccaacggcacggcgcccttcgccgccgctgccgccgggaacggcaccgtgcaggcgctgctccgcgcgtgcgccggcaagtacggcaacgcgcgcgacgcgctggcggcggcgaagaagtcgatggggcagcaggactacgacctggcgacggtgcacgtgagcgccggcgccgaatacccgcaggtgtgcaaggcgctgttccggcgacacaggcccggggcgtacccggcgaagctgccggcgagggagaaggcgctcaacaagctctgctccgtcgcgctcgacatcatcgccctcctcacctcctctcttgcatccaacaacaacaacagctagagctagatacgtataaatacggtataatactactagtactgcatgcgtacgtgctaaatacgtgtaatgacatgtatttggtagtaactagttaatcctgtgtggtgctgagtgagcatatatatgttcttcttgtattactaagtatagatgagttaattactgccgtgctgaagcttagcatgctgcatcttgtacttcactttggctccagtataattagtcactattcatttttgttgaattaaaatgatctgaatatgtgccccccctttttttttgtttgatatatgatcatatagtttatgtcggaattcaaacggttaaaccccccataacaaatgtattttaaaattcccatgaagttaaaagtgctcaagtggtggcatgatatattcccctgcttttgccccaactttacttgtttagataattaccttcctataatgcaatcacacatgaattactagtttgttctcctttttaatttcatttgagaaagtttggaggacaaatttagtggtccaaaatgctagtagtactagttaaggttgttacaaagctactaaagatcatgcagcatgtatagcacatgaaagaaagccctacctcggcatctagcttccttttgagataattggcatcttgtgttctttcatccacatttgcttggctgcatgaatccatggctggaccatctgtcctatgtgagattgtaattgaagaaaaagaagatcaaaaagcttaggtgatgaatagcccaggtaacatggccatgtcctcctgaccagttcatgtggggttaagctaaaaaaaagcaggcatgcttgcatgtttgcctgacctttgtttccccttgattatcttcctgggtgcacctgagtcccagatttcatcatctttgttcttgcctttgtccctccatgcatgtttaatgttttggccttaaatctgatgacttttgctcatacagtgtcatcttcttctatcctttttcaagttcctatgattttgcctctcacttttaactgctgctgtctctatgaccattgattgcagcttggttactgtttgtctcaagagcagatggatactagcaaacagtagcatgctccataagaaataatggaggagagaataatcatgttcatgcgtttacagttacagatgatcctaacctttttctctttgcatcaaagtcactaggttcctatagaattgtcatggagtaaagctctcatcctgtgtaagctagggtacaggaatctacaaaagccaaaagagagaagaaataaggctgcctacccaacattactcctcaagaggctaagatgccattaagcagacagtgggtatcagattaaagattaaatcttgataggcccaggctgagcctttaatcacactgttctgctttccacaaataaaaaaaaaaaagttcttcaaactgtagggtctcctcttctttaggaagagatgagttttactagtggatcaagtgcagggagatcagatattattccaagtgcacattacaaattgtaaaaatgaaactgcactttctatcttgaaagaacccactttgtgggctggccaacagaccttccattctcagcagtgccagttggcccaattaaaacaccaccc

SEQ ID NO: 60568 - DNA, 24519 bp, Oryza sativa
tgcatatttgctgcgtggcttgctgagtatgtcatatactcaccttgcaatcattcatcagaggaagagttctacagtgaagctgatggtgtggaggattaggtgtagccctggtcaagctgcttgtggagtggagccgtctgcaccgtttatcttattttccgctgcttagatctttattgattgagaggaactatctacctctgtaatgacattttattcgcttattaattagagtaataattgtactctattatcaatttgttattgtgtgcctcggctgattcctggacgagggctcacacacatgtaagcgtttggaattttggatagaaattccatgcgtgacaagttggtatcagagcctccttgaccctaggttatgccaaatggttacccatagaagccctctaaaaatattggaaaagtagaactgttctcttccccttctcttttaattaaaccaaactaatggcacatgcacttcataatcccttttaatggttttcattcaaaaatttattccagtgttattagtactgtacatctattactgtactaatggctcatttaccagcaaaagttttacaatattgttttatttaatcttgctacaataaaataaatttagcaagttgattttataactttcttttatttcttttggaacctgttattcaaaagtataaaatttgtaaccttgtttccaactgttttcaatttatgttgcaagcttggtttacttgatctacttacctttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgtcattggatttgggactgcccctttttatgctcagattcctcatgatcgtcatgaagagaagtgccgagtcaaagtcaccttgaacagtaatagtgaagatatcccctcagtgatgttcgaagctggaggaagaaactacatccatgcatgtcaggaggtggcaaggatcgccataggagagcttcgcgatcgctacagtgatcagttggccgacgctgagtatcgctaccatcctcgccaaccccagggaagtgaccgtggcagttaccttgagactgaaggaattgagaatgatgctaccacaaggcatttggttgagatgctgtgggctatggataaaagtcgtgcggagactgtgttagcagctcaagatcgtgaagaccggaatcgtggtaagatttgcaagctagaagacaaggtggatcgtttggagaaggaactagctgcattaaaaggagaagcaccgccgcagaaggccaggattcgtctcaccgcaaggaagagagctctatttgtccctcgctaccaattggcgccaaaggtccgtgtggtggagaaagaagttgccccagccctagcggatcctccggtcattatcataagtgatgatgaaggagaagaatcaaagcgcacccattccaagattgagtgggtagcaactcaagatgatgaagacgagccgaacgagccttcaatcgacctccgatgctcggaagaactagagtgacttgttaagtcgttgtcttagatcgttgtgttagtttgcttgctttaagtttggttgtgtgtgtctcgcatgtgatttacatcagtggtggaatgtaagtgcatgcgtttgtttgctttcgagtgttagggagttggtgagtttagtggtgtgagagtcttcagttctgtaataatgaaactcagttaagatcaataaaagttaaagtaattctctgtcctaagtagtttcccccggtttctcttcttgtgccctgtccatgccagatggtgatcactcgcagcaatgggaatggccccaacaaccccaataacaacaatgaagggaacccaacacttgctcaagttcttgctcaacagactcagttaatgaacatgatgatgcagcaacttcagaaccagcagaaccagggaaataaccatgcacctccccagaacaagttagcagaatttcttcgtgtgaggccgcctattttctctagtaccactaatcctgttgaagctggtgattggctgcatgccatagagaagaagttggatttgcttcaatgcactgatcaggaaaaggtctcatttgcatcacatcagttgcatggccctgcctctgaatggtgggatcacttccgccttaataggactactgctgaacctattacttggcttgaattcaccgctgctttccggaagacgcatataccatcgggagtggtgtctctcaagaagaaggaattcaggtcgctcactcaggggtctcgctctgtcacggagtatctgcacgagttcaatcgtctggctcgttatgctccggaagatgtgcgcaatgatgaagagcgccaggagaagttcttggaaggacttaatgatgagctttcttatccactcatggctggagattatcctgatttccagaagttagtggataaggctattcgtcaggaggacaaatacaatcgcatggaacagaagaaacgccggattgctcaattcaagacacaaccgggaaataatcaaaggccgcgtcttactttaggaccccagtccatgccacatggaggttcttcgtctgttgttcgtccgcggcgtcagttcttcaacaacaatgctggcaacaacatccgcaatcaagctccacgccctgttgcagtttcgacacagcaacagcctgccaagagggagcaaggcagcaagcccgtagtgtgcttcaactgtggagacccaggacattatgctgacaagtgtccgaagccccgacgcgtgaaggttgtccctgcccagagcaactctaccgcatcagcatcaaaggcccgtgtcaatcatgttgctgctgcagaagctcaagatgctccagatgtgattttgggtacgttccttgttaactcagttcctgcaacagtgcttttcgattctggtgctacacattaatttttatctatgagttttgcgggaaatcatgggatggaagtagaagatcttagacgtcctttgatggttagtaccccaagtaatcaagcactctctttgcaacgtagcccctctgtcagaatagaaattaaaggagtaccatttctggccaatcttatcttgttagaatccaaagaccttgatgtcatcctagggatggactggttagccagacataaaggtgtgatagactgtgctaacagaaaagtaactctcactagcaatgatggtcgagttgtaactgttcatgcattgtcttctgagtctttaaggtcaagactgaaccagataactttggaagagattcctatagtccgggagtatcccgatgtgttcccagatgatttacctggtatgccgcctaaaagggatatagagttcagaatagatttggtacctggaacaactccgatccataagagaccttatagaatggcagccaacgagttggcagaagtcaaaaggcaagtagatgatttgcttcagaaaggatacatcagaccgagttcatcaccatggggagctccggttatttttgtgaaaaagaaagatcatacccagaggatgtgtgtggactatcgtgcactaaacgatgtgactatcaagaataagtatccactacccagaattgatgatttgtttgatcagcttaaaggtgccactgttttctccaagatagatcttcgatcagggtatcaccagttaagaatcaaagaggaagatatacctaagacagcttttaccactaggtatggattgtttgaatgtactgttatgtcttttggacttaccaatgcccctgctttcttcatgaacttgatgaataaggtatttatggaatacctagacaagttcgtggtggtctttattgatgacattcttatctgctcccgaaccaaagaagagcatgaagaacatcttcgccttgtactagagaagctacgagaacatcaactgtatgctaagtttagcaagtgtgaattttggttgtctgaagtgaagttccttggtcacgtcatctcagcaggaggagttgccgttgatcctagcaatgtggaatccgtaaccaactggaaacaaccaaagacagtttcagagattcgcagtttcctaggcctcgcaggatattaccggaggtttatagagaatttttccaagattgctaagcccatgacacgactgcttcagaaagatgtgaagtacaagtggtcggaagaatgtgagcagagttttcaagagttgaagaatcgcttgatatcagctcctattttgattttacctgatccaaagaagggtttccaagtgtattgcgatgcatccaaacttgggttaggttgcgttctgatgcaagatgggaaggtggttgcctatgcatctcgtcagttacgtccgcatgagaagaactaccctactcatgatattgagttagctgcagtggttcatgcgttgaagatttggcgtcattatctttttggtactcgtacagaggtgtacactgatcacaagagtttaaagtatatctttactcagccagatctgaacatgagacaaaggagatggttggaattaattaaggattatgacatgtgaattcattatcacccgggaaaggctaatgttgtagcagacgctcttagcaggaaaggctattgcaatgctacagaaggacgacagttgccattggaattatgcaaggaatttgaaagattaaatttgggaattgtcagtagaggttttgttgcagccttagaagcgaagcccacactaattgatcaagttagagaagcccaaattaatgatcctgatattcaagagatcaagaagaatatgagaagaggaaaagctatcggtttcttggaagatgagcaaggaactgtatggttaggtgagagaatttgcgtccccgacaacaaagatttaaaagatgcaattctgaaagaagctcatgatactttatactccattcatcctggtagtaccaaaatgtaccaggatctcaaggaacgattttggtgggcaagtatgaagcgtgaaatcgcagaatacgtagcagtatgtgatgtttgtcagcgcgtcaaggcagaacatcagaaacccgccggtttattgcagcctttgaagattcctgaatggaaatgggaagaaataggtatggattttatcactagtttacccagaacgtcatcaggccatgactctatttgggtgatagtcgacagacttaccaaagtggctcatttcattccggtaaagacaacttattctggaagtcggttggcggaattgtatatggccaggattgtgtgtttgcatggcgtccctaagaagatagtgtctgatcgaggcagtcagtttacttcaaatttttggaagaagcttcaggaagagatgggttctaagctgaactttagtactgcttatcatccgcagacagacggacaaaccgaaagggtgaatcagattttggaagatatgttgagagcttgtgctttagatttcggtggaagttgggataagaatctaccttatgcagaattttcgtacaacaacagttatcaagctagtcttcagatggccccttacgaagcactgtatggtcagaagtgccgcactccacttttgtgggatcaaacgggagaacgtcaggttttcgggactgatatcctgagggaagcagaagaaaaggtaaaaatcattcaagaaagattgcgtgtggcccagtcccgacataagagttatgccgacaatcgccgcagagatttgagttttgaagaaggagattatgtgtatcttcgtgtcacgcctcttcgaggggttcattgttttcacaccaaaggaaaattgtcaccgcgttttgtgggaccttataagatcgtcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaacagatgagagaagaaccaggaatcaagttatccgtttttgtaaagttcaatggagtaatcactcggaagaataatcaacttgggaacgagaagatgaattgaagtcagctcatccgcatctgttcgccagttcttccgaatctcgaggacgagattctgtttaaggggggtaggtttgtcacaccctgaaaatcataaatatataaattgttgtttaaatggaattttttttgaaataattttaaaagccttgaagagaagatctaattttaattaataaattccaatataaaatggggccagataaaattttattaaatactttgcttaattctataattcctagatttttctgggatttatttgagctaaggaagtatttttaataaatggatttgcatttaagaaataatttaaattgaaaaatgttttaaaaagtcttcttttggctttgggccgaaagtcggcccaaaacctctcttctctctctccacggcccagtccggcccagtccgccgccgcgcgcgcgctccctcgctcactgacaggtagggtccacctgtcaggttcgtcttccccgagccgccgtcgcccggccgaaaccctagcgcgccgccgccgccgttcccttccaaatccggccgttcctttccttctccggccgaatcaaaagaggggaaatgatctccggaatctcctctaccttttctccgttggaatcatcggctaaaacgttttggaagttcgtggaatcgagttcgattcggatcggcctctttccttcaagccacgaagtttccttctcgtcgccggccgccgtgggccttcgccgccgcctcctagcccctttaaaaggctccccggtgtctcctctacccgcagccaccctcgccttcgcctctcgtcgcccgtagagctctagcgccgtgtgccctagcgccgccgtcgccgccgtcgctccagccgtgcgccgccgccgttccagacgtcgccgtcactcgggaaggtcgtcgtcgtggtcgccaagtcgtcgccgtcctcgtccgccgcttcatcaccgtcggaaaccgccggagcatcgtcgccgtcgtcaagccgcagtctgccgccgttccttcgtcatctccgtcgccgtccgttggtcttccgccgctcccttggtcgccggtgagttcgccgtgccgtccgctacctgttggtgccctccgtttgtgccgtagtgccgccgttcgccggcgagcttgcgccgtccgagctgtcgagccgccgagccaccgccgccggttgtgaaccgccgccgtgcgcccggtccaccgcgaaaccctagcccgctgacgtaataaatcccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccgaagagtccgttttcgccggagaagagtttgaagagttccaaggccagcaaggcaagtcacacagatcccaaacaaccctttgagcatgttgatcctatttaaagctattgtttttattcaaatattgcatttattttcgaatgtcattgggtggaattaacctattgtttgttatagcccttttgttcttgattactttattccttgataccttgggttattataatttgactagttgagctttgtttatattggttcaactagatgtattagatataattgcttagccctgcttagaaacattagcacactattgggataacttatgactcactattatttaaagatggcttaatgatagttcacgatggtcaatcgtgattggttaattaattaatgtgccaactaaaacctgataatggtgggttgtgagcacatggttttgagagtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgagggtcgctggggagtccatgccttgtttataagggggtgattaagatccaggaaaggtgcgctgtaatggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattagctcctggtttggaatggtatattcctggtttggagatagaactgtgcagccggggtggttgttcagaatggttgggcctatacaacagggtacgttgtatagtgttggattaatattgtttaattattacttaacagttttattaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagcagcttgtggagtggagccgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggctcacacacatgtaagcgttttgaattttggatagaaattccgggcgtgacaagttaggaaataaaatggtcagggttaatcatagattatttttggaaattcctcgagcgtaatagtatttcggtcgaaattccgagttaattataaaaatatgtttcttgaacagattagattaaaattggtagtaatttagatataattagtagctaaacaattagatgaattcttatagattattatagattatttttggtaatctctataagtcatcggttcacggtagaaattcggatttaattactaggaatcttagccgtgtatcatatttaatcgtttagtcatagactaaattaagttgtataatatttctaggatttcgttcgatatttagctcgtaatagaaatttctaacctattatatggatacaatgctcggggagagtaaattaaaaacttatgacaacgaaataattatacccgcaaaatagtttaaatcaaaattgggtttgccgtagttcgcagatagtaaagttaataaaaaggaatcgactttcgcattcgactttcatttggatttatttggatttttatttgaattctaaccgaattcaaatcaatttttgcacgtaactatagagcccgagggagttgcggatccaagcgaaggccaagacccgcaagactttgagcaaggcaagtcatcactattccttgaacatgttgatcctaattgcgaaattgttttgtttacaaacaaagttgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggtaattacctttgggaaggtaattgagatgcggcatgtggagacatgagcgccacattgccatgatgttgatgacatgatttgtgaaaggagaaataaaattaaacaattgttttcgactggggcggacggagaatttgggttgtatctggaaaaggctagtaccgtccccagtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtgtgtgagagagagaacttaacttgaaccataatttaatatgcgtgtgagacttctctttccccgggagcgccagaactcctctcactgctagaaacatggacgcctagagtgcatgaggatttaagttcatggagcgggtactggcaatgcgaggttatcgaaaagctttgccgtgacgcgtctcatgtgttgggacgaggctcatgtgttgggcagtcgcggagtgcgggtaaaatgtacatccactgtagtgtgagtaaaccaaatctattcgaacagccgtgctcgcggttattgagcaccgggacatgtattacacttggctagactctaaattctttaacttgtgtgggatgggatattacatgatgatttttatgctgatggagccacttcctgagaggcgggaatgtggatgtcctcagaaaaccataacgactcaatggcgggaagctatccttgggatcacaatggatggtggacagaaccgtcattgttaaatatgaacactggtaataaaacttgatcagtctatgctaggtcttaggcttgtgaaaataattacaaaacttgcttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatacctactaccaggagggagatgaagacgatggcactcagtaggtcttagtacggtcgttgcctgtggcaatggcatgccgctgcctgaattccgctgccttatctatttctgcttttggatgtattccggaccgctcggtccgatgatttaagactatgcctgcgggcttatgatgtaataattcgaattagacactcgtgtatgtgcacttggtattccagctatgaattcgtgcgtaccagatctgatccagggaaatggtactgtttacacgattgactcctgttataaaaacgggggtccacagcatggctaagcatcctaagcactttagctaaaaccatataatgttctagctaatccaattattaaccaagtgacaaagtataggtaagcaataacaaaggcaataggttccacccaatgacattcaaaaataaatgcaatagttgaatagaaacaatagctttaaacaggatcaacatgctcaaagggtcttttgggatctgtgtgacttgccttgctggccttggaactcttcaaagtcttctcctgcaaattcggactctccgggaatgtcggaatctaagcaaaaaagagcaaaatcaccaaaaaagcacataaacaatcatgaacagtacatgtggatatttttaacatgtagatctcaattttataaaaatttagagacttgaaccaactaaatctgagctaagatgacttagttatgaatttttaaagattaaaccggattaaatcatttatatagattttaattgaattatgacgcaataaagaattatttttgaaaaggaaaagatatttattgcatcagcggtcttgggtttacagtggaccgggtgcacggggatggtctacggaacgaacggccgtgatctaatcttatccaaaacaaacggccgagatcgaatcggtctaccgcgggtctacggctgacgcggtgctgacgttggcgatgacgtcatcaccggcggtggcttggcaactcacgctcgccggagaacgacggcgcggcgacgcaaacggagggcaccaacaggtagcgggcgacgcggcgaactcaccgagggcttagacgatggcgaacgacaacggacggcgacggcggtgaggttgaagctgcggcggcgttcgggtcaacgatgatggcggtgctccggcggtcttcggcggaaacagagggcgggacgaggacggcgacgacttggcgatcccgacggcggccttcccgaccgacgacgacgaccggagtggcggcggcgcacggctggactcccttcggcggcggcggagcacgggctctagtgcctagggcgctacgagcgacggcgagctaaagcgagggtggcggcggatagaggaggtcccgggagtccttatataggggctaggagcggtgacggaggcccacggcgaccggcgacggcgatggaaagtttagggttcgggaggaaaaacgaatccgaatcgagctcgaatcccacgatttccaaacgaaactagatgatgtttctataggagaaaagatagaggagatcaacgggatcatttcccctctaccaatttgatcggatcgggaacgacgcggccgaatttggaaggaggcggcggtggcttgcgtgcggcgggctagggtgcggctggcccgaggaggacgacgaccctgacaggtgggacccccacctgtcagggggagagagagagggagagcggcggctcggctcggcgggctaactacaccggggcgctagcaggccgaggagagagagaggggttttgggccgactttcggcccaaagccaaaagaggacttttaaaacctttttcattttaaattattcatgaaatgcaattccatttattaaaaatactttcttggctcaaataaatcctagaattatctaggaactatagaatcaaatgaagtatttaataaaattttatctggcccacttttatattggaatttattatttaataattagatcttttcttctagacttttaaaatcatttctaataattccaattaaacaacaatttatacatttgggatttttagggtgtgaaaaacctacccccttcaacataatctcgtcctcgagattcggaagagctggcgaaaagatgcggatgggctgactttaattcatcttcttgttcccaggtagcttcttcttccgagtgattactccattggaccttacagaaacggataactcagttcctggttcttctttcatctatctccaagatacggattagttgatcgcaccagctcgaccttctcctcctcgtgcgttcacctcgctgtactcccacgccgataagcaccgcaaactagcggcgcctctaccggtatccacacgtacagggacggaacgccacgcgcagatgtgctagcacccgcgcgcagctagggttttgcttggggagggatgtgacggctagggtttctcacgtgatgcaatgcctctgccggtcacacccctcacgaatataaaggattcatcactcgggcctccaaggtccgtaggactcctattcggatccctatccgaattaagctcatattggatctctatccaatccccttattccggcccattaagcatgcgaccctgtaggttcatatatactcggctgtaacccgaaaactcctttttggtccacgcgtcaacagcagcccctagcataacgtattgacccaccgggcatacataaagatcatatcggctgaacctctagtgtatacttgtatgaacccctttgcctcacgattatcgattaagctcaaggccagatatgtgccatcctctaatagctcaatcattcactcgaacctgttgatggattatataacttgtgattgactcctcaatcacctttggcatggccatgcacttccataatcgacaacatcgaggggcccagagatatctctccataggaggggcaaatcccatattgattatttatattccactacatgtttcatagcatacctgaaaactacttttataactatctaattatggagtagcgtttagcagtccctaagtaagctactacacatgttgagaaccacgataatctcaggtctaaggattcaacaccaatactcaataagatcactgatgacacaacacatatggctcttgcagtgtctcatattgggtctatccaacaacatgtttaccaacatgtgtccacattattaatttggtatctttataccatgatccatgagacatgatcatcaattaatacatgtgctgatcatataaacatatttgttccacatatgatatttgatctgggatcctttagaaatagtaacaaacaacataaagagtctcgtgaaagaatcacatattcattaaccaataaggagttatctatttcaaggaacaatgtcggataaatatgtaaacatagtatgtgatacaattatctctatgattgcctctagggcatatcattaacagccaccgccagcttctcattccatgaagctagctagcagacaatggaagccactgggatgcagctgacgcactcatcttccttttctccccacctccgccgctcccggacttgcattagagcgtcgccgtgcatgtcgcctcgctttgacgccaacctcgccaaatctgccccgctgccgcggcatcgcttccttccatggcagcctcgatgagccatcgggctgtaatttgcggatgccgaggaacccatccgcccacccattttggcccacacgaagagctgctccaccattgctgtggggaggtccaccccgtcacatgcaggccatggcaactagccgacgcagagcgagagagcacaccagtggcaagcagttggtggtgaccatggcacgcggtggccgccagcgcacaggatgaggagatcgagcgtcgatgtcgacagcatggctagaccatgacatggtggctggcgcaaggttcttccgtcatcgaagctctacagtggcatcctagggaacccctgtttaaccttggcaatttatcgaatcctatttgaatgacggcatgttagcgaagctagtttttttttcaattacatagatgcaaatttttttgactatatgttcatcaagtaatgagaaaccataaaacactagtacagatcctcccatcaatgaaggcctctcacataactgggttttgtgttccgtcactccagatttgcccgagacatgcacctaaggagaaaatcgcaatcgggccgaaataaacaccgacgtagatcaactcgtacagatataattgagttgcatatatcaagtgcccatcaccgatgagactcatctgtgacgggcctacgtttaggcccgattgagattatctctacaatctttgtcgggcccaacacttaagcctgcaatggatgagtatcatcggtgacgggcgacaaacacatcccgattaacataaatttaaggcctatcaccaatgagcagttatcgatgacgggcttattggtatgcccgtttgagataactgaacgcccgtgaccgatgttctttcattggccgttactgatatctattgtacactacaaatactccaccccattgttctctgaagttatcccactgttcactattttggtgagaggttgaagggggtgaatttttgtgtatttttccaagaaaaacagaaaattcataaagtcagtgaagaatactaatcaattctcattaatttagtaatacttatcctataagatgtttctctaatattttttcatttttgcaatgatgaatcgaagttggatatatgggaagactgtgaaacgtcatagcaaggagtatagaaatgatgtattaaattttataaatgcagcggaggaggataagaaaagaagaaacaacgattacatgtgttgtccatgtgtggattgcaagaatgagaatatgtttgatagcagagtggacatacatggtcatatgatacaacgaggattcatggagggctacgcatgttgggtgaagcgtggagagcaagaagttacttctgcagatagaagtggtgcaaaaaatcaggaagaagaagatgagcatgatatgtttgtaccttctccattgggcagtgaaatggttgatgtggatcacgatctgctgcaggacatgttacgtgacgttgaggacccagcttacaacaagagagattctatgaagttcagaaggttggtcagtgactcggagacacctctatacgctggatgcagggcaaaacacaccaaattgtcagctaccttggacctaatgaagctgaaggcaagtagtggatggacagacaagagtttcacacaaattttgggaatattgaaggccatgcttcctgatgatatcctaaccaaccggacaaggaattgggcaagggcaagggtgaagaagaatagcgacggaacacttacgttcccaaatgccgaagatcaagcagtgtatcagaaaattgtaagttcaacacatcgcatatgttcaatttgtgtttgtgtctatcgtagtgtcgatttaacctggccttaattgtgcggcaagtcgaccttactgcctagagacagttctcgcaagaggtctcctcacaaagatgggatgatgacatcctcacggtagcgttgggaaacgaagaacaccgtggatggataagcggcattggctccgatattccatggaagcatgggtttccccaatacgcgtggcagtacaagaagaacaaactgacaaaggcggagaaagatgcacgcctcaaggaacaacttatggaggacatcagagctgagctaagctctgaattcgatgagaagttgtcacgggtggaggcacgcatcaggggtgagcaccagcaagggaacgtcgaccccgccgacgctcccagagtagaagtgagccccacggaaaggcgtagcagctgcgcatcaactgaagcggcggaagaacaaccaccagtccctaccgcagtggaccacacaatggtaaaaccaacaaataaagcatatgttgtcttagctcatcaatatgttatgacatattctaagaacatgtatgaatctatcacagggtcccatagagtgcaccctagtcgttagggtgacacaagcatttacacttcctaccgccaagggtcttgcgttcaagcctacaccgaaaacccgagttcatcgggcgtagttgatggccaggcatgctaaagtacaagtggacttagtcaagcccgaatgggtaggctccactctgatgcatccaccaaatgacgaggttttgaccctaggagttgcacatgggacctttatccaatggcccaagcataacattcagataaaatataagtcctaggccaacaccaagtactagacccactacaactcttatatctgcccctcctgccattgaagaaggagatgaagatctccaattgtaatatgatacagattttggggatgagggtttggaagtcgacagcatggcgtactttccccctcctgccaaaaagagcaagaaggcccaatcttctccaccacagcatgaaacaaaaaagaaagctgttgggagggggagaggaagaggaaaggtagaagcctcgcttctagttcccaataagccaaatcttggcaaggcaccatcagctcgtcccacggctccgaccgacttcacattaggcatgccactggttggagacgacatgttagcgaagatgggccctgcttgcaaggagttgcacgggtactacatggagatgtccaacacaaggaggaagcatagagagacctgcatgacgggccatcacgatagacagccattccttgggcctccaagctttattgctgttggtatttcttaatgtcacagataaaatccgcaagcgcacggaagataccgatgtagcacttcacctgggagtattccaaggtatagatttccacaggaacttgtgtgtcatctcttcactaggttcatccaaggacacaaagctaaggtaggctaagggtagagaggatttactagtgagagacagtgtctatagaaagctcagtttaatcctaacgcggtacttcgggcgctggccagtccgctgctcccagatatggctcttcaaagtacccagatagggatgactttagtgttttgagggctatcaccacctctacacctacctcaaacatactgtgggatatgaagcaaataccgaaaattaactacccagataccacgtctacgaagtttaataactactttaatgttagctaaacactaaagcaaccactatattttattggattatagtgatcagtgaccccataagttgattaggaactaaccaagaggtaactctcacagaataaatattaattactcccaatgatatttcgattaaagcagagtacttaacagagtgaaagaaataagaaaaggattaccgacaactccggaattcctccgacttcctctactctactctctccctaattctagtatataatatagtacaatagcgcctcttataatttagctcaagctttaagttgtgttgaaagtgaagtgaaaaactccttttatagggcaagtatgatgattataacgatgcaaaatgtcttaattgccccgcggttgacggtcgttatcgaccagtttcgaccatcaaaccatgtgaagaatggttgcacgttgttgcgagaaatcggtacaagtaagagaggacctcgagttaagtaccgtgaactacagggtttgaaatacagggttaaactctattgtttcctatgcaagagactataaaatgtaatcgcctagaaccaaaagagttggaatggaatgcatcaagaatactaagagtacggaaaagctgtttctggccctcctagaagatagtaccccatatgcatatggttttcttctagcatgactttctctttatggagacaactcttcccgttaagatataacagaaaaatagttttgttgctgctgacttgctaaagtatatacatagagttctctacattggtgtttaccctatcatgcaataggaaacggctggttaatttccattatttttcctaaataagaaaagatcatgccgctatttttttcattccaaggtgttttgagtatcgtaaatgggctatacatgttagactgttagcaaaaatgtactttgtttcaaattagtacttagaattgtaataggtgtatgatagacttagagtcatagtctactctaggttatcccttctttctataaagttaagacccaaagctaatatttagttaagccacgtcatcatttaattgtcagccgttggattacatctgagcggtcctcattgcgttttcgtagcacgtcctcggtcccttcgctcgccccccaccgcatcgccttccacaccggaccccacggctatttgcctccccccagcctcatcgcctattcgcctcctccctggccctggcaacaatgacgacggcggcgacggactctgtcgatgacgacagtgacagcggcggtcgcggacgagtgtggcgacaagggcagcagcggcggcggaggtcacggacgaggacgacggcgatcgagggcagcggcggacacggaagagggaggcagcagcatttgagggcggcagtggacgcggacgagggcagcagcgttggtcacggcgaacgagggctacagcgccggtcttaggcatatttggtactaatatgttctgtgatttatctgttttgcagctctgatgtgtagatgagtagcatatgactctccgtcgcaaatcgataatgcctattgcctgtgattctcccgcatgtctagccgaataattgcatccttcctcacaagcatggtgcagcgccaccaagtctctctctccaaatccaggaaactgcaaggcatcaactgtggcaattaaatcaattatcaattccatcagcacacttgagttttctcagaaatcgatttcttcaacctgcatccggttcctggccacagatgtcttctcacagtgtttgggtatgacttgaggactttatcttcatgtttcctttttctcatgtttttttcttctacttttatctaagcccctttcagcttattgcatcgaggtttggtattgcttgagctaaatcatatttatatgtgcagagcatccgcagatttggttcattggtttcgttcaagcttcactctttcattgtactgttaggtgatgtttgatgttctctttcatgctatatcttgcattcctactttcccgtggattttatagcacttacctctaaatttcgccttcaattttcagttttatttttttctcgaaaacactggagagctgcatttcatttcatttcagttttattttctgtgatgaggttttttttttctttaatgcaaaggtgatttatcaaactttcagaactgcaatatgctattctctgtttaattcttattatcggaatataccatattatgccagtgtcaatcatatcaagcacttttaatattatgccaggggcaatcatatcaagcacttttaatcaaagaacaaatgaacgcaattctcagcagcgtacagtaccaggtatattctgctattctataattgtatcccattaacctgcatttaattttttttctatcttgcaataacaatttgcatgggccttttactaaccatacaaaacacttctacattttgcaaatgaaatttcctatttcatcacacttctacattttgatggtgttttgcctattttcatcaagtagtgttattaccaccctacagggtgactttcctagatcatgtcatcaattatgatgtattctttagttgttgtttacccacaaacaagctctgatgcccaatattcagctacatgttcagctaatgagaatgtgtccaatcataggctaagtgacgtttcagtgttttaagataatttcacattcttatgttggacactcaattaattgtacatgtttttaatttcaggcttgaatatgatctgctaattacacaatatccattgcctccacggtttgaaactatctgctcacacttctatgaaccccgcaatgctcctttactaatcaagtaatcactccagttggtagctagattagggtttgtacgatacttaaaaggagttcagaagcagcacaccacttaaacaggtaaatatacagcagtttttttattagagattcattaattgttggaaattaagatgttcaggaaatcacacattcacacttgacaagttgatagctacttctagctatacaaatgcactatcgctgaattgagatctgctattttcaatgaagaactcccattattcgcaccagactacatgtatatatttgtacaacattcatattgcccttcttcagagttatttgcactgttcctaccctagttgattactttgttgtgtaatgcttgggcatttgtcagcacttaaaatatcatgatcacttcttacaaatcccgcagcaacgcgcggggtatcacctagtttgttaaatagagaagcacatataaccgtatggtaactatagcacatttttttaattagataatagattaaaaacccagtcactacatccaaaagctgtacacaaccaggtgactgtagcacatgcgagggatgattgggcggcagcctagtcggttgatggataccttgatgcgctgtaaccatgctatatcagggaggagcgttcataatcagaactttcagagatgtgggctatggctagactccatttctaaatattgtgcatccatatcgttattactttggatcttgtatggtgttgttccgcgcttgactacctatgttgatttcggtgcatgttttataacaatgcatttgcaacattatacccatatgaatattaatgagctatgttaggactattagaatacgcgtagactacgatagcataaatcaaaattttctaccacgtaaaccaggaaccgtgcaagtagtagatcatagatcgttaccacacgacgcgctgcgcagcgcaagaaagcgctaagaaggcgaaggaaccctcgcgatgtagcgcatcgatgtagaggaagtaattgatcgcaccggctcgaccttctcctcctcgtgcgttctcctcgccgtactcccacaccgatcagcaccgcaaggcaacgacgactctaccggtatctacacatacagggacagaacgccacgcgcagatgtgctagcactcgcacgcggctagggttttttgctcgggaaggagagtggcggctagggtttctcacgtgatgcaatgcctccaccggtcacatctctcacgaatatataggatccatctccaaggcccataggactcctattcggatccctacccgaattaagcacatattggatctccatccaatccccttatttcggcccattaagcgtgcgactctgtaggttcatgcacactcggctgtaacccgaaaactccttttcagtccacatgtcaacagtggcccctagcagaacgtattgactgaccgggcatacacaaagatcataacggttgaacctctagtgtatacttgtataaacccctttgcctcacgatatcgattaagctcaaggctacatatgtgacattctttaatagctcaatcattcactcaaacttgtgatagattacataacttgtgattgactcctcaaccacctttggcatggctatgcacttctataatctataacatcaaggggcccagagatatctctccataggaggggcaaatctcatcttgattattcatatcccactacatgttttatagcatactcgaaaactacttttataactacccaattacggagtagtgtttagcagtccctatataagttactacacatgttgggaaccatgataatcttaggtctaaggattcaacaccaacactaaatgaaatcactgatgacacaacacatatggctcttgcagtatctatctaacaacatgttccccaagatgtgtccatattattaatttagtatctctataccatgatccataagacatgatcatcaattaatacatgtgcttatcattaaaatatatttgttctacatattatatttgatcagggatcctttaaaaatagcaacatacaacgcaaagagtctcatgaaagaatcacatattcattaaccaataatgagttatctatttcaaacaacaatattagataaatatataaacatagtatataatacaaccgtctttatgatttcctttagggcatatcaccaacaaggacatgaagtaacaaatgagtagaattttgcctttgccaagaagatgtatgcacgtattcattataaaatttataatggcagatcttgtatgaacacggctagaaggctagaaattggaaactaattaaggttgaggtggaggattatgttacttccattaagcacaagcatattaattgttttgctactagtcagtaccacacatatggctagaagctttatctaacgcaattttttttgttaggacgtgtgaaatcatatgacaacacatgggaaacaaaatagaataaggccctgtttgattcagattaggattattataatttagattattaggaataaagtgaaacaaacagatagcctattatgatggattattataatctataagccagattactttaatctagtaatctactctaaatgttctttttttagtttattgggttgctaacagctaacaaacagcttataatccagagaaacaaacagcttatagcttattctatatatgttggcttattataattcagcttacagtaatctaactcaacaatctacgttacaataatattaagccgaaacaaacaggtcctaattcagtgtagagtcatttttgtacgtgcacgaaactgcttttccaaatcttgtttcatcttcaggtccatggatcgtcacaggttgtgcatgtatgaaatcaatactgtaacaatatcaccacaggagagtaatacctatgttttgcgcagaaatttcatcgttgaacagtggtttcatcctatttaactgagaattcactacatctattgtgtcacacatttggtctgcagtctgcacctagtacatttatatgaaatagtgggtcaccttctgcgatctgcccattggttcgagtcaagatcttgcaatatacattaa

SEQ ID NO: 60569 - DNA, 5933 bp, Oryza sativa
tttgtctcatgcccctaggccctgtaatccccaaacatgagtagggtattacctcttatcgaaagggcctgaacctgctaaatcctttgtctccgcatccatctacttttaggtctcgcgcgctaccccttttattattgccgaattcatgtttcgacattggcgtgccaggcaggggtacgccgagttatctatcaagaagtgcgatggaacttatctcaggaatcaccggcaccattgttgctccaagatccaatcctgacagggagattgatctcggcgaactcgatagatttaatcttcgatgtcgtcagcttttcctttccaatctgttatttattggattaattctaatcactgcttaatgctattcttctttttattctctattgcttgatgccggcgcaaagtgctcaattgggcatggtaagccgcagctacgcaaggcgaagccgtccactcgtagcgaatccaagtcgtgggcaggcaggacaagcacgaaagttcacgtgacgagatcgctggagatgtacaggacgtgtcaattcaatcgccatgcatggattaattaatccagccatacacgcattcaatattgctggatacgtacagggcaaattgatccatatatagtcattatctctctacttgctaataacaggctaacgatatactttgttgcttgttttgcatatattcgggagctgtacgtggttgtttgcaggacatcgatcaagatctaacagccatctgctgccgagaatacgggcaatatgtacatccataactctacacatgacgtatctcaaaaaaaaaaaaaactctacacatgacgagctatggatcgcttgatcagtcctagcaacacagtgcaacaccaatgactaattttctccgtctcggagtcagtccgatagaggagatcaatctcggcaagttcaacaattcaatctccgacttcgccgggttttttccctttcaacttattgttgtttattagattgatctttaaatttcagattaatctcttggtattttctgttgtttatatgtaatcccacggcgctactgttgccaactagtgtcctcgcctgcacggttggttggtcacaccaccgttgttaggcatccacgtcttcaccgccggcctgcctttgccacagccgattggtgtcttcgcctacatgattggttggttaattaaaccacagttgttgggcgtccacgttttcaccgccggcctgcctccaccgccgccgactagtgtttccacctgcacggctggcctattatgccaccgttgttaggtgtctacgtcctcaccgccggcctgcctccgtcgccgccgactggtgtcctcgcggcgtcaacgacttcaccgtcggcccgccttcgtcaccgccgactagtgtcctcgcctatacggttggttggtcacaccaccgttcatgggcgtccacgtcttcaccgaccggccttcctccatcgccgccgattggtgcccttgcctatacggttggctggtcacaccaccgtccatgggcgtccacgtcttcaccgaccggcttgccttcgccgccgccgactggtgtctctgcctacacggctggcctattatgccgccgttggtgggcatcttcgctttcaccatcgaccgcttcgtcaccgccgactggtgtcttcattgttattgatggacgactttgttcccacattggccacctctgccatcaccaaggggaatattacgaagctaagtcatcattgattttttttatatgatattttccttttcctctgcctccctacatcaactggttcgccgttgactagtgagtcgggggctacatatgttatatcatattttttaacaattttcataatatttatcttgattgcttgcgatataatctgagtacaaaagtgcctatcgagttatggagttctatcttcctatgctttccgtttggtttgtcgatggatggttgccttcgggccgattcctagcacccgggggctcgttggatggaccgagtaaaggtgctaagtattactcaaaaaaattcaaaagcatagagataagataatttattttctgctcttaacaattgcaaaagtacccgagtagtaaactctgatccgtgaaactttgttccattaatgacgaactcatgtcactcgtatgcatgcttgggaagtgcctagaccgactcccggtgcttggggactatgactagtcgggcagagtgtttaaacgtaaggagttatccgctcggggaaattaaaattgacaagaggagaaatatatatttataaatatttgaaaatacttgaatctttctcaagtactgtatttacatcagatactactcatcatatatgtttgttctgcaggatccagatccagatatgcatcaaagggattcatggctttaagcttatctcctatgttacagaaatggatcagttagaacatcaccaccggcttgccgttgtcgccgccgactggtgtcctcgcctatacggttgggtgatcacaccgccgttgttgggcgtcgttttcttcaccgaccggccacctcatccgccgtcgactggtgttttcgcctatacggttggttggtcacaccaccgttgttaggcgtctacgtcttcaccgactgagccttcgccgccgccgactggtgtctccgcctgcacggctggcctattatgccgccgtttgttgggcgtctacgtcttcaccgaccggcttgccttcgccgccgtcgatcggtgtctccgcctgcacggctggcctattatgccgccgttgttgagcgtctacgtcttcaccgaccggcttgccttcgccgccactgactggtgtctccgcctgcacggctggcctattatgccgccgttgttgggtgtctacgtcttcaccaaccgaccgcctcgtccgccgacgactggtgtttccgcctgcacggctggcctattatgccgccgttgctaggcgtctacgtcttcaccgaccggccgcctcgtcctccgctaactggtatttccgcctgcatggctagcctattatgccgccgttgttgggcgtctacctcttcaccgaccggtagcctcgtccgccgccgactagtatttccgcctacacggctggcctgttatgatgccaactgatgctatcttcttcacggctggctacgtcgcaatcactgctaataggtgtcatcatcttcaacgcaagctgtctacgtctgctgctgactagtttcttcacgtccaaggctgcatgattctgccagtgttgattggccttatcttcttcatcgccggtcgtctcgtctgctgctgactagtgcccttgcctctatagctggtttataccgctacaactattgatggacgccatcgtgttcattgttggccgccttatctgacgccgactggtttgtcgcctccacggctgcgcgtcttcgttactattgatgggcatcatcatcatcaccagcttgccttcgccgccgccgattggtgtctccgtcttgatggctggcctattatgctgtcgctgatggactcctttgttttcaccgtctggtttttgccatcgccgactggtgtttctatcttcacgactatgcgtcttcgccaccggtttgcttatgttgccttcgactcgtgttcacttcatcatgactatgcaactttgtcatcatggtggagcgacttcatttttattatcttcggcaccggcaaactctattgccgctacttcgcaagttttgctacttcaccaaccatgacgtctacaagagcttcaacatctcggcatgcgtcaccaaatatgacaccgtgttattttattacaacaagtggtgttccaatcttcaatatttctactcggacatcttcgacatgcatcttcactcaagcaatgactactcgacgacaagaagctacaattctcgactctatgttaagttgtttcccaactaaccaaagggtcgggggctacacaaatacaagactctcaaaattcgacaagttttttgtcaagatgcatcaatcaatcaatcaacaagtcaactctgggagttattatcttcgtctgcgcttcagagccggtcaagattaagtttacatgtctgggagtttggagtcatcaaccaatcaactcagatcagattcaatgagttgaacaacagcatatactttcctctaagtgaagcatctgcaacagatatagcaccaagttctactgccatcttcataaatcaagaggcgttgcatcaatcttcgtcacacaaatgccaacattaagaaaatacttgagcatggatttcttctcaacagtttgatggattgttgttactgacatcatcaccagcacatctacttcatcggccttgatgtctccgtcgttgctaaggggtgaccacgtcctcgccgtcggttgctttttgtcatcaccgactttcatcgccgacttgttatttcgttttcacggttggcctactacgcaactaccgatagaggatttcattgttatcatcggctgctacaccactattgactggatcactgacatcgtcatcttcatcaacatcctgtcaagcctcttcaacatagcccactctacttctattgatgggcaacttcgtcatcatatttgatcatctctattgctgccaatcgtcattaccatcggttgcatttgtcatcgtcgactatttcttgcattttcatgattggaggattttgccatcgtcgttgatgcgcttctacgtcgtcatcgttggcttgttttcatcgccaccgactgatattctcgccttcacggctggcttattatgtcgccgctaatgggcgttttcatcttcttcaccagctgtctcgtctgtctccgactgattattttgtcaccatggctacaaaactctgtcgctattgctgggtgccttcatctttactgctggttgatctaactgctgccaaccggtttcttcgcttccataccgattgcatcagctatcactgatggacaatttcaagtactccaaaaagataagctatatgctcaggggcttacgagctcaagcacaaggatcataccttcaagttggattttgttctagatacaggcaacatgcactcgtagtcctgagattattttctatgctcgaagactggaccaatcattatttcccgtaagggctatcaaacgaatacttgcgccagttgggattcaatttttatatctattttggagtatcccataagggataatcactcagatcagaagctattcatatgagctacacttggtctatatcacccggaagatttattactcgggagcatgctacatgcgtcatcctttaaagggtgtcgaaggcatattttttggcctaggccaaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatacatcttaaaaggtgtcaaacagtaaagctttatatagctaccccgttgacttttttttataagtcaaggtgctttttgggtttttaagcaattgattggatacaatatcattgcttttttgccacaaaagtgtgcatatttattgaccaatattttggattaggctgattatatatttggtcattttccaggcggttggtaaatcctttatgagtttatttactcggattttacaccacatatgccgtatatttccgggtgtggtgaaaccatgtgtcttttagggacttaagcacatatgttaaagcagtgtgcgcatggcgtatgcccaatactttggaaatttctttatttcaccgcata

SEQ ID NO: 60570 - DNA, 2601 bp, Oryza sativa
gtcatgttgagtacatgaaagatgttgtgaaagccaatgaagtgctttcttgccccaaatgtcgtaaaagcaaaggtgtcatggtagattgtgaaaattgtgctaatttggaaaaagaaatttcttatttgaaaaattctttgcaaagattttctgatggtaaaaagaacctcaacatgattttagatcaatttaaggtttgcacacataaccgtggtttagattttaatccttatgctcatcatactagacatcctcctgttgtgttaggtgttggtgctagaagtggtgaaattttggttaaacctgaagataagaacattgtgtttaaatctgctggcatcatctctaccttgagtgcatcatcttcaaaatccaatgttgtgcatgtaaaaccttcatttgttgcttgtgttgctaagccatctgagtctaccaatgtttctaatgatcgtgaaaagtatacttgcttgttttgtgggaaagatggggcatattgttggtttttgtttcagattggctcataaacagaaaaaagagagagagattgcttttgcaaaatcaaagtggcaaaaatctggttgtccctcaaggaagccggtcagaccgctgtgggtcccatggtcagaccggcgaccggtcagaccaactactgagcggtggtcagaccgggcaccggtcagaccggcggtatagcagcggtcagaccagcagtaccacctcggtcagaccggactcggagaaaattttctgaaaattctcaacctatttttgcacgtggatatatgcctattggatcttctggtcatgtgtctcaatattggattcctaaatttttattatcatctaaccccagtactgaggcttcgacttctgctggtgtgtatcctttggtggcaaggaaggagaacgtgtggatcgtgaattctggttgttcgcggcacatgattggtgataaaaattggttctcctccgtcaaaaaggcatccaagactgaatcgattatctttggtgatgcttctactagtgccgttctcgctacaggtttggtaaaggtaaatgagaaatttgaattgaagaacgtagctttagttgaggacttaaagtataatttactttcagtttcataaattgttgatgaagattttgaggttcactttaggaaaactggaagcaaagtttttgattcttgtggtgattctgtgttgaatatttctcgctatggaagagtgtttaaagctgattttgataatcctatttcacctgtgataacatgtttggttgctaagtttgataaagatgtgatgttttggcattgtagacttggacatgttggttttgatcatctcactaggttaagtggtttggatcttgttcgtggtttgcctaaacttaagaaagatcttgatttggtttgtacactgtgtcgtcatgctaagatggttgcttcttcacatgctcctgttgttttttgtgatgacggatgcacagggacagctattacatatggacactgttggtctagctagagtgcaatctgttggaggaaagtggtatgtgttggttattgttgacaatttttctcgatattcttgggttttctttatggcaactaaggacgaaacttttcaaatactttcgtgatttgtttcttcgattggatcttgaatttcctgggtctttgaaaagaattcgaagtgataatggtggtgaatttaaatatgcttcatttgaacaattttgcaacgaaagaggttaattaactaatttggcaataaaacagcaaaagttaaacaataggagcaataatgaacaaagacctgcacaacagcaatagttgtcacatggtatgcaccgtgcacagcaaaatagggggaattgcaggggacaaaggagagaaaaacctaacaagagatgaaagaaaacttcttggacaacaaatattagctcgtcaatctagcagcaattatgttccaactcgtcatcccttcaatgagaatgaatcttataaaaatagctccctccatatccctatcgatcccttaaatcatcatatggctctattggacaacaaaagcatatagcagagtatatcaacgaaacagagcagaacacaagggatgaggaggcaagaagtataataatagaaagaatatatgcagagagaagtaaagagcaattactattgtcctcgtcagatggaggaagcagtacacggtggtggtgctgacaaccctagcaaagttaacccgttcaccctcaccgccaatagccagacaggagcgaccaatcgctgccaggagaacctcgcagcgaagatagaactccatggcaccagattaagtctcaactttgatctctagtagcacgccactatatcaaagagttgcgcaccggatcggccacctcgccatcggccggttcaccaaatcaagcacacttcactggatcgaccccctcgctgtcgtgctagagcaactcgaaaggcaggaggcggtgacgtatgtgtaacaagagggagattgagaggagaggaggatgggaagaaagatggcggccgtcgtaaggcgctgtggaaaggcaggactcttgatttctctc

SEQ ID NO: 60571 - DNA, 584 bp, Oryza sativa
tgagttgatatcagattctagtaataatgttggttaatgccaccgctccggtgttggttaattaaaatatattaaatggtgggttgtgggtgcatggttttgatggtcgcgcccatggcaattaaggaccggttcatgggatgccctagaagaacttatcgtacttaccacaagccattgtgggcaacggctgggcttgtagtgtagctttcctctagttgacgcatacaggcaagggtgggcatgatggagcgggacgggccctgcgacggcctctgtcgcttccggattcacctaggcacgagaggggactgcccgttgcccgctggggatgggggtgaaacctgaggtgtggtgtgcttggctagagggggttatgtgaagggtcctgtcacggcctctttccggtatgtcgtggtggcatgtcagtgcacggtaacatgtcgtggggctgtgtcttgtgggtacagttgtacacctctgatcagagtaaaactattcgaatagccgtgcccgcggttacgggcggtcaaccagattcaccgtgattagtctcacccctagttagctaatgaactggtgta

SEQ ID NO: 60572 - DNA, 26478 bp, Oryza sativa
atttgtacaaggatgggtcttggaacagattgcgaggatgatggaggtggctgatccaagtccaacaggattctatgactgtagatattgatcagtaggaacagggtttcagaatagatgctagatatgcagaattcgccgacaagaacagtgccccctttgtgtgagaggctgacatgtagggcccatgctgcagaggctgctatcactattagtcttgtacttttgttttctgatctaatatatacactccagatgggatgtgaactgtcatacaagatacctgattgttacttgtgtacttgtgtctgtgatgaactgctggctatatgcatactacacctgtttcaaaatataagtgatattggctatacaattcatagataatatctcttagattttgagatggaggtaatatctcttagtacttaatgaatcattttttggggtgatcatgacgaatgatgttattgcaacagcaatgtgcaactccctttgtaacttacccatctcactcaggtgtacataggcaactactgtcaatggttaaataaaagttggctaaggagaatagctgtaactctggtaacatactcaagaatcaattcaaaggtaataacataagtgctttgtcactgagatttgattaaattcacacaagtcattcaaagctgcacacgtatgcgcagacataaccatctgcaacttgcgtgcgacgtagacatttgatctggtgtaaagatttgtcatcagtggacaaaatgttgttataagttgtagaattgcacataaacaaatcatggatcattttcagaatttcttgtgctgactcctaatttgactcttccagcaccctagaggggatcaactggattactatcaagctggtgtccaggtgattcaattcaatgtatctgaatcacctgatgagtgacagggggtgaaactgtaaaaaattccataagaaatccttttcaggtcacctctatgaacagttgtgcgaaaaagatgtgtacaaccattctggatgctgaatgtgacttcccggaaaattatatcaccatcttgaagctaaaatggcactaagagccataccacatgaacagaaaacatccagccatacgaaatatttatgtgtgatatttaatgtgttaggataaccatggaagcggacaaccagaatttgtggcttctctgaccaaggaaactagagttgtgtttagatgtaaagttaataaaatggtttgagctagcagtgatagactagaaacagtccaaaacagaaccaacagaattggtgacacaatggtaaaaagacaaatttgtattgagcaaaggcaccatcgaatatactccctccgtttcaaaatgtttgacaccgttgattttctaacacatgtttgaccgttcgtcttattcaaaaaaatttgtgaaatatgtaaaactatatgtgtacatgaaagtatatttaacaatgaatcaaatgatatgaaaagaataaataattacttaaattttttgaataagacgaatggtcaaacacatactaaaaaatcaacagtgtcaaacattttgaaacgaatggagtagtacacagcaggataaaaaagttgtttgattctgtttgcatctattctgaagacaaacaggtatgtgtgttcatttatctatgatgtgccgcatatgacaaataatcagctggaataaaacatgaatatataacaggaaatatcagaaaccaccccgcaatttacactaaaaagaaccactgcaaaaggagagaaatatgattcagcagtagcagcatagttcagaatgtcacacctcagctatatttgaaatcagcaatgctgatttttcttaaaatacaattgtcttaatacaaagaaattgacagaaacatcatttctggggactacctagtaggctagtacctgctggaggacagcagagggaagcaggactgtgcaaaacacaccaattaggaagatggcagcggaaaaccataccataccagaagcttaagtacctcttggtggatgaatatatcatgtaatagcagcgacacataggtagttagaagtagatgcggcagtatcattttcctctccttccagcccagaaagctgagatgtgtttccactagagcattttctgccaaaatcatcaaatgagaaagaaaatcgcaccacacaaccatgtggataaaatagtacgatcaccatgtaatttaatataaaacgaaaggaaattcgaacctttgtgaaagcaatttctcatcagataaagccttctcaagcctctcctcgaatggtgttgcgtgccaactcaccttttgatcctaattatgtaacaaactatagataagctatttttatatgtacatatgagaaagtaagagaagcagaagcagactttacttctttgtatttgtttgttgagttgggaatgccatttccatcccaccatttaggagtgaaagtatctggttctgtgtctctccagtgagcagcgaccaatccaataataggcctatcttcttctgaactcttagcagaatgagatctgtcacttgtcaagggctcatccctgaacacctttggatttggaggctttaaccactgtgacaagcttgggaattcaacctcagaatcatttcctttgagcaccttctttctgctggaatgaactagcggctcacttttaagacatttctccacagattctgtgcttgaattctctcttctcttattacaggatgatactgaaccctcagaactctggaatagggaacattcattagatattgaaagttcaacagaaaccaaactgtcattctttgcatacttgaaatcctcatctgatatattgggctgacaggattctagtctcaatttttcacagcttccagaggcctcaacagaactcacagcttcatatgtatgctctgaacaagtcctagtattgttctcatttctcagctcttcctggtcaggtgcatgagttgtagctggtgtctgtatctcagcagtcgcttctgaaggagttgaaatgggtaaagatttggattcaaccaggttgatatcatccctacatgtgaaagacggtgaatctaaggcggttaacttgttcccacagttgattgcactgtcatcattgcccacaacctcaacttctatgctcttgcacacagcttcagaatcattctggtttgatgcatcgcactctttccaagaagaactgtcatagttaagcagaaccatcgaaatattaaattaatctattcagtcattgcagcaaaaaggaagccaccagcctcatcagaagttggtaacaggatgaaggcattggcattagtagcgaatagcacaaggttggcatacctcatagcatcaggtaaaatggagctctgatgagaccctgatggagtttggcaagcctcagccttcagcccttccatgaattgtaagtcatcagaaatggcaggaagacatgtcaaatgtgtttgactttggtcagtattttctggcccttttatgatttcatttgtagtttccaccaatgcatcacggtgtatgagcaaacggacctgttgacaccggtgaaagtcagtctgtctaccaaaatcaaacctactggaaaaggaataacaaataaaaaaatcgttattacacctccactctgtaatctgtattgcctaatgtacagcaacaaattcaaattctcatgtagataggttgggtatgacctatgaacagcatcgtacattcaagaccaatggaacaggttgttattccaatttagaaacacaactggtcgcacaattctaacagataaacaacagccacaagggtcaagggatatattagttctttttgaggttagagtaacatgtaagtatctaccacctagagaacaatgctccttcatcattgttgttttatagaaaaatgacgaatataatatagttaaccgatcaaaaggtccttggttgactacgaatcacagtggggatactagttgtcagtcatccaaattctggctcaagtggcatgatacttgagtgagattttcaaaagggcgaagaactagtcatgataaataatgggaagaaattagcggtgaatcggtatgcggaatcggaatacctcgttcttgtgctcctgatccaccttcgtcctctcagtgatcccgttcgctcccaagctcgtactatgctcaaccctcgacccctcatcttcacccaacaaaaaaaatccaaacaaacccaaaaaaagaaaaaagatcagcacgaataaatgacaaaatcgctacatcacaatccagaaatgatcgcgataataagttcaaagagaggcgcaaaaagggaaaaaaaaactctccagaaatgtaccttctcgcaagaatacagcggagagcgcgttcttggacggcggcctcttcctctccccgacctgcctcaccacgaaacacaacacaaacaatcaacccaaaatccgaaatcgaagcaccccgcaacacaccccccaccaacagcttccccgccgccgccgcataccttgggagcgtccaccggcggcgaaacggagggagacgaaaccagctggtcgcgttcacgttcgcgtcgcccctcgccgctgtacccggccacccggaagcagccgagcagccaccccatcatcctccccctcctcctcaccgcgatgccgccgccgccgccgccctcccccgagaagccgagccgtgggcgcggggcgaagctttcatccgcctcgaggaggaggaggagcagcaactgcgccccaagtggcaggcaggaggaggaggcgaaggtttaagcaggaggaggtggtggggatttgaaatttaaaatcgaggcggaggaggcggcggcgagggaaaagaaaaacgaggcctgcggagtttgcgacgaccgcgtgagcctttttcaggggctttttctttaaaattggaaatgaatgattaacacaagatggggtttatcactttatctctctcttttttctctctctctctctctcactggatgggagcgattttagggggtaataaagtgttgcttgtgaaatggattattatgaaattatgattggtgttaattttgccaatatagtggctcaaatacgatatagggggaaataattgggaatgaactgtgtgtggaaggttctagatgttctcaaaagtatcagcgcgagttgcgaaatctcaagatgaaatttagtttgattggaattttttttgttctttttacttcttgtattgtgttttatacttttattgctctctgtatgcttgcttgggtcccaatcacagactagactactccctccatccaaaaaaaaaagacaaaccctgatttccgtacccaacgtttgaccgtccgttttatttaaaaaattatgaaaaaaattaaaaagacaagtcacgcataaaatattaatcatgttttatcatctaacaacaatgaaaatacgaattataaaaaaatttcatataagacggaccgtcaaagttgaacacggaaactcagggtttgacctttttttttggacggagggagtacactttttcaggtttcagtagataaatgcctttgtttggactagtgtcaaactctactagtacttcctttcaaaaaaaaaaaaaaaactctactagtactagtctttttccatctaggaatatgcagcagttcattctagaattgcgttggaattgacctgaaaatttcgataagggtgcaggaaaggtactacagtttaaatttaccccaagattggatgattatcttttgcaaatgaaaaaagtacaccgcaaaaccggatacaacacatccctcaacttataaaaccgtacgaactaagtcttttgacaccgattttatctggcggctgagtcagcataggacccacgttggtcccacatgtcaggatgccacgtcggcaaggcagcctctcccttcttcctctcctttcctcctccccccccccaccccccttttttttttttctctctcccccactcttctctctggactgggtaggccggcagactagttttgccggtcactcccgaccctcgcctcgccgcccactcgcgccgcagccgcaggcacccctcctcctccacaagtagcagatggcgtctcgtcctcctgccaccgcgcgcgcgttccgagagtccagggcggcgttcgatcgattgatttgatttggtccggtgaggcgacgccattgttgcgaccaagaaaccgtggacgcgtggttgtggaacgcggcgtggcgagatgtaggccgtggtggcggccacttctagagcctgggtggcctccccgcggcggcggcatgtcgcctcgtgttcttcttccccgatgacgacgactctgtcgtctctcaatcgatgcacggtcgccggcgtgctgccgctcggcattcgcggcgggcgcatgctgctcgcgcccccacttctgtggaacagcggcgccgcgacgaggaagatggcggtggcgacggccgcggcggcctcgccaccggcggaaggtggcgggaaggcggacggcagcgccgtcgccggcggcgtttcgcggacgatgcagctcggagccatgatcctcgtctggtacctcctcaacatctatttcaacatcttcaacaagctggtctgcacgggcatccctcctgaagcaccggtgcgccgccgccgcgtcgccgcacttcgtgtacatgtcaaccagcgcgttccacgcgacgaaacccagagcaaccttcctttccgcgacgcgccggtgcgcctcccgacccagcgcaaggtctccaatttgcgtgcacgccgagaacgcgacggcggcggcggcgacgatgtcgatgcacacgccactatcatccgccatggcgaagaaaagcaccacagcctcgtcaagaacccgtgcctcgcgtggcttgtcaccatggccgtacaagaaacgagcgcccacgcggaggcgagctcgccgtgtgcgaggtagagctcgacgagcccattgcggacggcggtcgaggccgagctcggccgcgcgtgcctgcacggctggcaccgttctcgctgctgcggcggcggcggcgacgacggtagcggtaatggataaggcgctcggtggcagggcgaggagcggcgaggtcgacgatggccgccgcccacggcgaggtccccgtggaggcggtggtggccgacgcatggaggaagcggagcggagcctgagcgggcaagaggtggttgggcttctcgtcggaggtgtgggttccgaggatgaggcggtgggagcgggtggagtccggcgaccgggagcaaggcgtaggcggcggaggggggagcaaggcggcggcggcggcctccactctcccccagcctctccgcttcggactgaggccgcgtggtcgccccgtccttggcgccgacgaggagaccatgagcaccgccgcgccgagagtctcgcgctcacgccgccgccgtggaggagaagaggacggacggcgacggcgaccctatccctgctcggagccgccgccgtcgacatgagtcgccgccgccgctcctccctcgtctgcacgccgcgccgcgccgctcctcccccgcccgcgtgccgcgctgctcctcacccgcccgcgcgccgcgccgcgctgctcctcccccgctccgccctcgtcgcagccgcagccgccgccgccgccgcctcttcgctcgccgccacgtcgccggccgccggacgtcctcctttcccacgtcgctccggcgacctcttccccacccgccggccggctttgccacttaccgctggatagggatgatgacgtggaggaagggagaggaggggaaagaggtaaggatgatgacgtggcacgctgacatgtggggcccatgtgggtctcactaaaactaggtttaaaacctaaggatctcgggtgcactttttcctttgcaaatttcccttttcctgtactccacatgaaatggcgctaatgcttgtgctaagccggcccatatactatctgcagttgggccatactagctgtggaggggtttccggcccatatactgcctgcctagtactctcacaatcacaaaacacaagaaatttcatttgctcctctggaatctcaaatgccaaaggttcaaaggtatagttcgtgcctctgaagtctgaaccctccatcatctagaatgtgaggcgaaggttcaaattcagtcttcagatatgattgcttgtttcaattactagctagctgcagctaatcctaactcaatctaacagaaatagatgcacttggactacaattcctttattaccatcatcatacacaacaaccaatattcccttcaagacatacagatacaggtggatgagcagcattctgatcctatgatcattttaacatatgctcacaaacagctatggacgtatactacaatctgaatataaatcaactatggacaaaagcttgtgaagcagcgcaaaacggaggtaaggtcgcacctttgttacctcggtcactttactatatctttgaggagcatgtgtggaattagatctctgtggcttgagctgctcgcgatcccgctagggctcgttactacgtctggtgtggtttgatattcccaggtttccatcctagttcacgagctctttcttcccacaaagcagtcagtttcctttgttcaaccaatgcttctgatgatttttcccgggcttcttcacatgtatccatacctgaactgcatttgtcagcctccttttgatattgtgaagctaattttttcgcctccagcaattttacatctgcttgctgctgagcttgtgttgcctcttcttctctctgcttcagttcttctatgagtagctccgtgaaactcttctctgtttcttcaccagacgcacggctcttaacatccttgaattgtttggaacagtctgcaaatatcaaaagtaaccacaatcagtgaaactgcagcctctaaacaactgcaaaacatgtctataaaagataaatttcaaaaggtgattgtcatgtttattgcaagcttagatcaaatgaggtaacaatgttcattgtcaagataatgattcagggaagaattagagttgctacgatagaggctaaggtcactgaaacaattctcatgaggctgtgtttggcacagcaagttcccatctcctcccctcgttttccgcgcgcacgcttttcaaactgctaaacggtgcgttttttgcaaaaaaaaagtttctatacgaaagttgcttaaaaaatcatattgacccatttttgaaaaaaaaagctaatacttaattaataacgtgctaatggaccgctccgttttccgtgtgtagaagattggttcctatctagcccaagcgaactcagcctgttaagcctccaattctttttggactttgttatttcatactactactaggtattatgaatgagcagctaaagagtttcaaacatttgttatttcatcaagaatactcacaaaagtattaaacctttcatttgttagaggagaaacctaaaagagcactacaaaactattcttccttgtcattcatcatagcccgaatcgatgtaggagaaaaggtaaacacatcacaaaatatttcctttcgtaagcaacggcagtccatctgacgcttgtaaaaaatcataacactacaacagcagaagcaacgaaacaggtagggattggctcacgttgatcattaagtaacaatcttgtataacaaactaacacccatagtaacaaagtagtatccttttttagcatacccacgagctatatgttcaattcaatcttgtccagcatccaactttctttccaccactaaaatctaattgagctcctaagtaactccaaaattattttctccctcagttttcagcaaaatcttaaagttaagtggaacagattctgccaaacaatcactaattcagccatcacaagcccaacacaatttttttttcagacaaggaacgctaaactcaacaacatagagaagctacagatctccgaatctacacgctcatatcgtgctacttggttgccaacctatcatcaactaaactaaattcctttgcgacatgtcaatagcaaaatgtaaagctactacaagaagccgcgatgctaagctctgaatactaaagaaaagaaggaaagcacaaaaaaaaaggaatagagatatcggatccgagcagcgggcgggtaatggctggatgaatgagctcccgcatgtcaacaagatctgggaggagagtgagcaccgacacggaccttcggggagcgcgagcagcgggcgggcgtcgcagtcgcagtcgcacgcgggacacgcccccgtggagcggccgagcgcctcgctggcgtgccagtagagctgcgggccgacgatgtaggcggcgaggccgagccccagcagcgccaccaccgcggtcaccagagccgggctggggccccacgacgaggaggaggaggttgagccgcccgccatcgccgacgccgcgcgcgcgcgcgaggatggctgctgctggtatacagttgggtgtctcggcggaggggaggcggcggcgcggggaggttaaaggagtaggagtgtggggggagtggagatggaccggacgcggtcggtggaggtgggatgggagtgtggaagtggagagtgcagacgggcccgaacacgatatgagatgggatgggatcgtgggatggtggtgggttcggcggcagccggcctggacgaacgcagttgtgagttgtgtttgaccaagtcagccaaacaggtaacagggtccaaggtttaagcaaaaagcacaccgaattccgcggaaaatgagtggttttttatgctctcaagtctcaatgtcttggttaccctcaacctattcgggactataacataagtataagttatgatttgtttgcgcaaggatggctaagaaattcttcctccggattaataatatttatcgttttggataagagtacgatcttaaaaaaaaaagtaactttaacaactatttcctattataatatacatagaaatatcaacaaatatatagttttcttgaagtatttttttagaaattatttatagtcaactattttaaagtttgactttacccttattcgaaacggctgatattatcagctcggagggagtagttggtcacaagtgtgacatgttagctctaaattcgagattgtgatgtatgagtcccaagggtaagaaagtgtggtatgatacagttgtggtagcgaaataaacacatgcctgagaaaatgtagcatgactaaaatgtgacgtagtaaaatgaagcaatcaaccagacaccctctaatcgtgcacgtgcaatagacgtatccgcataacacatcacacgagacataaatccatttaaaatttattgtgctttttcacaatataaatcacacatgaaaaggaaatttttataaaagaacgataacaacaagcagtcaaagtgagatatgttgtaactgcagcttcatggtgagatcataagctcaaagtgttgttgtgactaggggatgcaactggtatggatacttttcgtctgtttagacttttttcgattcaaatttttttatcggaaacaaaaacgaatataataataacactatcggccggtcggaatcagaaaacactctatgtgggaccaggacatatattactattatagagctagttatatgccattcttatttagaaaatatcgtgtaaatataccatgtgacatggattatatatactgctatccagttcatcgctcaattttctacacacctttactatgacaaatttcatagacaattcattcttatgtctatgctcttatgctaacatcgaggtttcgcagtctcgacgaaatctgaatggattctgttaatttcgaatattttgaggcggctcgaaatatgcatctgataacagttttatgtgaaaatagtagaaattcgttcagaattaacaaaaaatatgaatgtctctattgggctcgaaactcacttgccaatctcgaaaacctggttaacatgcgtggaacttgggagtagattttcgacacgctaaggctctctttggcacaactcctaattcaagaatttttttagctgagaatttctggcttcataaagccatggatatccacgattgcgttgataatattttagactaatgtttctattttaggtaaaatttaaaaattttaaactactataatttagtaacatataaattttaaatcaaacacaaataagatatctatacgccatagctatatggtgaatggtcctaggcttcaacgcggcttaggctgtgtttggatccaaactttcaactttttccatcacatcaacccgtcatacacataacttttcagtcacatcgtactaatttcaaccaaaacttataactttggacacagccttggaccgtttcatcgttgccagatcaccactcgtcgatctctatgcaagtggaccccctatcctcaaaacacccgtaaaaaaaaatccaaaatcaattgaggaaaaagaggatcgcgccggccgatacctccatcgtctccaaaaactccaaacccccgcttgaaacccacgacgacgaccaccaccaccaccacggatcattccgccgccgccgtcgccgccgcgcgcctcccctccagtcaacgctagaacccgccctcgacctgccatggacccatctcccggcctccagcgccggcccgcggcggccgcggccgcggcggtgaggggggaaggcgcggagcctccccgcgggcagcgcgtcctccacggcgacatcgacccgccccccagggcgcggccggcggtgcagaagctggccatcgccgccatcgtggtgctcgggtgcctccagttcctccccgccacccacttccgcgaccccgccgatccccagcggaactggatccccttcgaccgctcgcgcaagccggtggtatggatacgatacgatacgatacggccgctgctgcgcttcaccccccccccccctactgcctctctcactctcgcttcatatagctctactcttttgtccattaatttttgccatgtttgagctccgggagtaccatttctggaatggtgatacaccagttacattatcatgctcaggctgttacattttcacggtgtaatggaatattttcttttaatatgcctttttcccccttatcctggaggtgaaaattgggtttgatattgaaatgcgaaatgtgtgaacaagacatttttggtacttcctccgtccccctaatataagagattttggcatttgcttgcactgtttgactattcgtcttattaaaaaatttagaattattatttattttatttgtgacttactttattatccaaagtactttaagcacaactttttgttttttatatttacacaaattttttgaataagacgagtggtcaaacagtgcaagcaaaatgtcaaaatccgttatatttggggacggagggagtagttggtggcagcgtgacttaaactgggattgctgtgtcatgctagatatctcaggagacggtattgttttggtcagagttaggggaaaagacaaatttcttgatgtactgatggttccttttgcaggatttgcccgatgaggttggaagcgttaatgtcttttcttggataagctgtctggatcttcggactcttgctgtgctgacaaattccaccatatccagctcaaggttctgtttgatttcagcatttgtaactaatgcatatttcaaataactatagtgatagcaaaaggataaactcttttgctattggatattattattcagtgttcatttgcactgttaatgatatggaactaatgacgaaatctgttttcattctcaagtttttgttttctgatgtaattgtctttgtttaacagtgatccccataacatatccttcaatttcttaatacctgaaagaggcacagataaatcgccctactacaagctaaaagcagtactgcctgattcgaatgttactgttgctaggtgagggggaaaaaaactaaaactctacttttatcctgggcattgttgcaccctgattcctgtttcgttacattacagtcaaaagaaaattgaggacaagctaaacgttgccactccagaaggaaacctcttttggtcattccccaatgaattgtcacccatcattattggaacgactcaattctcgcaaaagagatatgtctatatctcagcggactcaattgtaaaggtacttacacttctctatatgtgatcatttactcaaacctgtcattgagttctctgaaaaaattaataattgaagtattgaacctgtataaactatcatgcgagcattagtgccagggacagttccatgcaattgctgatctaattgcttgttcacctttttcaatcatttcaacttgtgatagtgaaccataattctgatttttatgtggaatacattgaatacaaatctaccaagtttcttcaaagacatcactttgcttggctagcattatcagaagttttttttataaaaaaagtcaagagtatggaactaaatctgtgattccatgactggtgcaacagttgcttcaaatagtcaattaggaaacaaaaccctgcatatgtaagtgagtagtaattgagtatattgccatggctgtgttctttgatgaaggacatagaagcttttgagcattgaaatgttgtgtatccaactcaaacatacaaaaaccatacatatgtttgggttaacttatgttaatcgtcaatctcctcccagggaaaaattgaagatcttggtcgcatcgatttaggcacttatgctattgctgctgttgaagattgtaccaagcgcattggtgactatgttagtatagatgttctgaatgccgttcagaaaacagctccgaaaaatttggtgtataccgaaccttatgacaaggatgcatgcttacttgattttgatgtgcttgtggtggagccacgcaaactacggaaggaccttattgattctatcatggtgtggttcagggctttcagtctagccaatccaaggtcagtgactcacattctgtattgggcaacatccaccattgccagatcaccatgcactcaaactcattcaaatagcgcactgtttgtctgtggactttccatttttcagggatcaaattaggttggcaataacattggccttgtatgacaattatctgaagctcccttccaattggaagcgcgcagatgctaactcagacatactgaactacaacgggccaaagaatgtttgctctgaaggtggacgtcagcttcaagaagaaggcaatggcgatgagtggcaactgtaccttgatcagaaatcccttgccgtacttagttaactgaacaatggcatttcatccaacaacctgcacggttctctgttgcttggttgttgggagctgacgaccaccgtgagaaatacgcttcttgttaacctgtcacttgctcgtgaaaggattgtgttttgatgttgtactcagtagactgatttgtttctgctaagcttaaagaatgttcgtttcagaggaatataaacttcagttcagccttgttttgcttcctcctttctcttgcatttgacatatcctgtacaacactacaacttgactacacaagtccattcgagtatccagctgctgacattcttgatggcactcttttgacctgcgcacaaggctgaatccgagacttagccgcgctcaattgttccactaacatagaaaagctgctcaagctggcataatttagtttctacattattgccattacataatttacagctagattgctagtactatggtacatgctagtatatcacagcgtacatcacaggaaatcccagactggaatggtgtactggctttgatccgtggcttggtgacccagttgaggattgctgctaagaaactgcaatgactggatgtccggaggtggggcctacacgaaaacacggcatgcgacctactattaatttttgttaagcaattttatatgatcaaaaaacaaaggttaattccactacaagaaaagtatcaaatgagatcatgggacagagtgataacaaaaggttgatttaactataacacacctacatgaaaatcttcaagggaaatatgtgtatactcaacgaacacttgtagtcttagcctagtaattgctaatggaatctgtgaaagtgaaatcccttgggaagggaacatgggtgtaagttataacaatcacctgggggatttgtggaccgctatgaaagggtggttgctgtagatgaggttgctggagaggagcaggtgctggttcctgcaactgttttggagttcaaatttgcaagttataagaagaacaaaattgacacttctcttcagccattcatcaatgtagtcaatgctccaattacctgcccaaatggtgatatgccaggaaatccctgaagagagctaagtccgaattgctgtgcaatatacggtgcctgtatatgtgaagcaacaatattcagtacatgggtcatacagagttcaactacaaactacagttatcaccgtctgcactctgttcatcaaaactggggtttaggactggagaaagcagaaagcaaatataaatgttacctgcattatatggcttgttgcaagaaattgactggttggagttctcagatgatttggaatgtcatttgatattgtaggaggatcaaccctaagcggaacttcagcctcctcaggctccggtagacctacaacattttaataagatcaatccttgatctatataaaatctagttctgaagaagcttggatgaagaacaaaccttgtctaccctttttcttcttatttgattgaagaggactttgctgctgccgacgcgtatctacatttttaattttcttactacttactctgcgagtttcactgttgctggcttcattcggaaacaaatttggctgttgaactttcagtatagtgctcaatgaagatttatcatgtaactttgcttgcaatagaagttcaacttgctctataaactgatcacattggctctccatgtatgtataagcttcaatattttcggcagcttttgctgcaattttgtagaacgttcgatacaacatgctgtatcgtttagacaacaagaacctgggatcttcatctacagcttcaaaaccatagttctccctcggagattcactctgagcatcctttctccatcttttcaaaatgtagtgtggtggaagttctttaatatttcttacctcaagaactttcagtacatggcaacatggaatacctgtgaattcaaatttcttacagctacaaacaaccatacattctgatgagtcaaatctaacaaaatggtcacggggcctgtttttgacagttacctcatactcagatattggtccaatctcaccacagcaataagccatgcaagtcaaggtcagttcaaattccaacctgaacatctcaaaaagtgtaggagtatatgcattagcagcttgccaaagcatccgcagaggtgctactctctgtgccatttgaaccccaaggtagtcagcttgttgttcagctaggcgtttgttctccaaaagtttgtcataattgttaaagaaggatgggaaatccgtttctttctttagaagatctgccagtatagcatcagtgttattatcacttcggagtgcggctgcaatatctgcacagaatgaatcacgtccataaggtaaagcccatctttctctatctgcatacaatttacctagccactcattgtcctttagattgtacttatctgagaggatttcccagcttgacaagaaatccccctcctcctcatagccatacaaccacatgctaaaatcgtctgcaaaagtttccgaggcttggaaggcatcccttaatatcttagtggcatttttatataaatgaatcagtgaaaagcgctgggtggtccttggccaaacagaagcaactgcttcactgattgctgtagattgatcgatcataactgtttttggttgcttgccactcattgcagatttgaaagtttcaaacaaccatttgaaggattcaactgattcatcataaaccaatgctgcaccaaatatgactggctgcttatgatggttaacaccaataaacaacaatagaggcctactatgatcacttgtgctatatcttgtgtcaacacacagtacatcaccaaagtagtggtaatccagaatcgacttaacatctgcccagaatacatttgtcaactggtcatcttcatccacttggatggcataaaagaaagaaggatgttcacctttcttcctctgcaaatattcataaattgcctgggtatcacctaattgcatatcttttgtgtgccttgtccttacataatttttataatcatttggtatcaaaacaactcttggtggatctggaggctgctgtaactttgctaataacttatgtgatctcagaacctggatgtccaccaaaggagtttcaagatcatgattatgatcagccacatactcagtcactacatatttgccactcacagtgattttaatagtcatgtgtgccagacaaccagttcttgtttctggccgtggcttcttgggatcagtactgacacttttagagcggaatccctctttagaacagacatatgcccgagattttgtagtatttgttgctgttttttccaaccatccttttcggacgctgaaccccacagttccagcataggtgacatagcagtcataggccttgtcttcattcaggaaaaccattccaacttttggttctcctccaggtccagcaactacttccatttctggatctggttctccttcaattatttcatcttctttactctcaccctggaccaaagaaaacaactgtatgtgttaaagcaatgaggaatcgaatataaagaagtggttcatttggaatttttttggggttcattaggaattaataatgtaaagtttaaagtataagccattgttcccttttgttacccaatcaaaaataagacggaggacacaaacaattagcttcaatgcagcattgcagagaaaaaacttttcaaataaacatacatcatttcacaagtgggtcttaccttatcttcttttttgagattttgcttttcaagacgtttagagcgcctttccgaaggttgctgcagtggttgccaattcatgaatataagaaaatacaacaagatggcataaatgaaatatctatgtggaaccaatatagaattaatgtatagtttgtgcagcagatgccaagaagtgtcacagaatacacagtttgttttgatattaaccccagagaagtgaacaattacattggtatgcaataaaagatttgtgtattgctaataattcctagttcagtaacaaacacaaactgtgcaaactacaaatgaagtgatagtgcattctttcaaaaaaaaaaaggaaatttatatgccagtttgcaagtgagtatatcaagtgcagtgagttgtaaactgagttgtgtgacctctaacttctgaggtactaactgctagataccagatgtgtactattttggctcttctcattggctaattaatcacgtactaaaatggaaaaaaaatacaaacagagcatcagcaatatccattagtaacatggaagggaagttaccgtcagtccttcgcttgacagaaatctacctccatcaccacgttttcgtctttcagccaaagcttgatgtgaggcgatctgaaaacgacaagcatatacttaccaagtgaaactagttaaccgatgtgcatgtaccaactactgttggtatatatccagacaattcaacacttgtagcacatgcttatgtgttgacatttctagcacaaatgtatatatcctcacatgcttttgttgaaatttgaaaaactatctgaaatccttaaatatgatcaaccttgcatgcatcacgtatgaaaatgtgtgtgcatgacctagcgacataaatatcttatattgcctgggcacaatggtcagcttccaatcactacaagaaaaatgacagcatatatttctatccaaagctatatattgttcctgatttccagttgtgggctacagcgctttgtcgctttcctatttggatcactatccagttgagcgactgctaatcattttgagacaacattgagttcaaaactcttgacatatatatatgctcatttgcataaataaagcatagctacctgtgcagcttctattaagtgtgtgactagtacaaaaaaataacttccttccctttctatgttaaaagacatgacgaccagtaaaatgtcacgtatcaagcttcttactttccatcttatcagtgttcagtggtgcctacatacattcaaatctaccccctcagtaatttatattcatctttgtcacagctaataactaactccaaatattttaccttggcaggccttgccgaaacaggtctgctctgtcgctttgagaggtacttactaactatcttcttcctctcctcattagtgtactgtgatgccctcaaaccgagttccctcagcacacgtgcctgcagggcattgccctcggcatctgctttcctcggccttcccctccctctcttttcctgcacttccacttgtacctcctcttccatttcctcctccccttcccctttctgctcctcaacatcatcaccatcttgcgccaccacctcgtcctccttttcggcctccaattcgacaacaggcttctcatccttctctgtaacatcctttttagtcctacccctcttagaacccctcatcttgcgcgcctcttgcccgttatttgggactgctgtcccgacacccttctccgcagagctctccacttcgatcacctctgagttatttttcacagggttgggattcctcttattattggcgcccctcttcctcttgcctgcagcaccatcctgcacctcctcctctttcaactcatccaaaccatttgccttgttcctccgattggcgtaatttcctctggagcagaggaacctctgcatgatcatgacgccattaccaaccgatcggcgattggagcccgtgcgcgccttgaaccccaccctctcgccgtatccgtagtagaaccccttggcggcgtgcacggattcgaactccatccccatcaccggcaccgccgcggccacctccccctccccctccccgcacggcgccacctccacctcgtggttgtgctccaccaccagcttcgacaccctccacttccccccgaccgcgtccttcttcaccacctccatcatcgccctgcacctctcctccacccccacccccacccccacccccgccgccgacgaaggcgctgcctcctcctcctcctcctcctcatcagcatcagcagcgtccccgccctgacggagcgaggggtccgcgtccgcggcggcggaggcggcggcgtggtcagccatgagcggggggggcgaggcgaggctagggttgggggggatttgaaatggcgcggggatttgggcggcaagcgggcggcgcggggggattatatagtgatcggagatgggaggggagatcgggtgtggggaggaggcgtcttgccttggctgcggcggccggcgagaggaggcgagagagtgtggggggagctgggtgtggatgcggggcgagaggggatccgagggagaccgagaggcatctactactccgagatgcgggtacacgggctctgtgactgacagtggtggcccacaggggggtatggcccgcgtggcagtgggggtggacttgccggtgagtgtgacgttttagataggcggcggtggggctcgtggcggcgaccggaggtgggcgacagtgtggtgccagtgggggcgcgacgcgtgtcccgaggcatagtggtgtgggtttaaaaggattaggatgccggatttgtgcgggtcccaagcgtcagtgggttggggctagtgatactgtggtacaagtggacaactggatggcaattgtccgatcaaggtttatactcatgcttatcggctaaaatttgaatttttaatcttaaattttgaattgtttcaaggtttttttcattaatttttattttttatcttttacttttatatcgctaagaacacatatataaaagttttattcacaaattattttttttacaaatatgtttcgcttattcgaaatgatggctagcctagctgggctaaatataatttcgtttatttaccggatataatttcgtttatttacaaatataattatatcaggcctttagctgcctagctgggccgtcagagaattttaacgaggaaaaggtccactttgactccctttaaaataggccgaatctaattcgtacccctccaccgaaaatcagataagacaacttccctaactattgaaaccagtgcaatttgactccctcagcggttttgaagagtggttttgctgacgtggcgctgatgtgacggtgctaacctggtcttcatcccatgtggcgcctatgtggcattaaaattaaaaattatatgagggacccacttgtcattaaaataaaaaaatattgtggagcccacctatcatcctttctctctccaacccttcttcctcctccctctctctctcccccttgtctctctcttttctttcctcttccgtggtggcggcggcaggcggcgctacccttgcagagacagcgggaaatggctcccactaccgggggcggaggcggctgggcgttcggggacatcagtaccgtccgattttcttgacccactgccatccctagttgtcgtcgcgtgcttgacgtggacggtggcgacggtggacttgatggcgatggtggtcgcggcagcggcggtcgtaggtggtgacgatgaggcgtggcgcgcagtgatgcttcccgtcactagctgtgcaccctcgatcggttagggttttgtgggtggagttggcggtggtagcgaacctcgtgccgtgtgccgccccggcctccaccctctatttatgtggcgcagggtgacaaggcccaccagccattgggctgggcgcccccgatcagggcgcaggtcaagatccccgttgtgccgttgggcccaacggggaggggatctatctaacatgaagtagcccgtcctgaaggcctgggtgaggtcggaggcggtggagacggtcgccatgatgacgccgtaggcggcgagcccagtgaccacgccgccgtccttgagccccacccacgcgccgaatgcgaggaccaccaccttgccgaaggtggtcgcaatgttcatgtcgatgacgccggtgacgtacgtgttgcagaaggcgagcaccagcgcgacgaggcaggcgacggcgacgtggtggtactttcagctcggtgtagaggcgcagtacaacaatggtggacatgaccgacaggaccacatacccggcgacggcggccacgctgggcatccggtcacggacgaacacttgcttctgccgccggtcgtcgaagctctccgccgaaaaatcggacggcactgacgtccccgaacgcctagccgcctccgcccccggcagtggaagccatttcccctctctctgcaagggtagcgccatccgccgccaccacggaagaggaaagaaaagagctacaaggaagagagagggaggaggaagaagggttggagagtgaaaggatgataggtgggctccacaatatctttttttatttgaatgacaagtgggtccctcatatattttttaattttaatgccacataggcactacatgggatgaagatcaggtcagcaccaccacatcagcaccacatcagcaaaaccacccttcaaaaccattaagggagttaaattgcactagtttcaatagttggggagttgtcttatctggtttttcaattgagggtacgaattagatacggcctatttttaaggaagttaaagtggactttttccttctaatgaaccggtgattaggccggccgtcttggctgaatcagctggcatccgtccatggcccatctgcaaatggcccaatacaagctaaaatagaggggcccgcctacaaatttaacatatgccctctaaaaaaacaatttaacatgcgtaatttctgcatctcaatagacaattgaacatttgggatttcatttctgtttcattagtctttccctgaccattccgtgtaagctgcagtgtctgaactctgaaacacttccataatcttcccatcccaggcttgcacagaagatttcaaccggaaaacacactgaacttgcagtgctgatcattctccgaaaacgcagcggttcagttcagatgttacaaaaaaacccacttgtttccagtaggcttagccaaatcatcatgccgaggcaatcgaacagcactaatctactagagacgagacgaaacaaaaaataaagcaccagaatattttatctcaaaagagcattcaacttgccatattgcatattcgggttgctgtctgaaccatccctgtcatcgtctgccgcccagcccgccccgttacatacgttgtagaaaaacgaaggaaaaattctggtaaaatcgacggaaaactaacggaaacatcaccacactgcatgaccaagaggcttcgtttgtttgaaacaaaatcatcaatttaaatcagcctttcacacagcaagtgcatggctgatcgcattctttaaccccttttccctgcttcatcctcaccttggttatcttgagaggcacgaaagcatcgaaaatacgcaaatattgtgtacgtacgtctcgatcaaccaggatgaagcttccaagtaatacctggctaaccagcgcataaatatgccgatctcgcgaggccgctgcatgcaaacctgcaacacacaagaacaggactgagttgctgatcatgcgcttctcccgtctcgttttttttttattgtttggtgagacgagggattagcgacggtttcgatcgttttgttttgttttgttttgttctacagtgagccaagtacaggtcgatccgttggtgttgggtttaggccctgtttctttcagcttgggattattataatctagattatttggactaaactgaaagaaacagacaacttattgaagtagcttattataatttggagcccagcttattataatctgataagctcatttaggtgagctttttccagattattgggtgaaaaattatccaccatgccaccccactctctctttagacttgcaaacccaataatctaggctctaataatctagaaaagaaacaactaaccgcttattctactacagattataacaatctagtttatagtaatctgactcaataatttagattataataatcccaagctgaaagaaacatggccttaatataattaagcggcttattcgtagcacttctgccgttaatttgctagtggtgatattgccgcatgcttcatcaatttaccagtgaatcatcagctctgcgcttttcagcttcttaggtcccggccgtttgaactagggcggctgatggattatggctgaaattgatttcgtgatcattatttgagggaaaaagtatgaattacccccctaactatcgcggtcgtccgaaattcccccctgaaccacaaaaccggacatttttcacccccaactatacaaaccggacgaattacccccctcgacctaaatccgcggtggttttggtctacgtggcgtacgcgtggcagtccagtcagcattctatttattaaaaaaatgtgggacccacctgtcattctcctcccactcttcctctctcctctccctcactcttcctctctctcttctctcactctctgtctcactcaacctctctctcacgcccacggcgagtagggcggaggggcggcggcagcggtgagcgcggcggcgagtgaggaagggtggagggacggcggcggcggcgaagtgagcgcggcggcggaggaggcgaggcggcggcggcgaggcgagcgtggcggcggaggaggcgaggcggcggcgaggcagggcggcggcgagtgaggaagggcggagggacggcggcggcggcgaagcgagcgtggcggcggacgaggcgaggcggtggcaaggcagggcggcggtggcgaggcgagcgcggcggcgaacgaggcgaggtggcggcgaggcagggcggaggcagggcggcggcggggcggaggaggcgaggtggcggcgaggcagggcgaaggggcatcggcagcgaggcagggcggaagggcggcagcggcggcaaagcgagcgcggcggcggaggtccacgccggcgacgggatgag

SEQ ID NO: 60573 - DNA, 32369 bp, Oryza sativa
aaaagcagttttgaaaaaaacgatttgattgattgattgttggatgttaccttgtttgaaccggccttgtcccttatataggggttggtcttgctatgtacaggccctcctccacgtccaacttagggtagaaaccatggaaacccgagcaaggaaacttgagacccaacaaaaacagactcgggctcggactctgccggtcagacgggccacacatcggcccccaaggaggaaaaccggcaggaattctatatttggcaattcttcctatttcaactctaggtgccaaatttgggtgtaaacacatgccccctgccttttttgtgaacatcgtgaatctaaaggcatagaacatgttgtcttagggtgataatctaattaccggccataggacttcctaagcatcttgccaaacactcgagaagtatttcccattgattgctctctgaaaatgctctccttgaagtgtctccaaaaaatacacatttcctcgaactatcccgcatactcgataaggaccttcccaactaggagaccacttaccgaactccttagatcgagaacccaaaggcaaaattgtcttccaaaccaagtctcccacttgaaacaactttgcttttacccttttgttgtacgccttagccaccctcttcttttctttttctatttcttccaaagccttcaaacgcttgtcgatgacgtcgtcaagattaactcccatcaaggtcttgtagtcttcaaccgacaaatcgccttgcttgatataccgaagagagccaagatttacctcaaccggcaaaatagcttcttgtccataaacaaacataaaaggagtgactttagtagcaccatgtttagatatcctatgtgcccataatgcctcagaaagcacctcatgccacttctttgggtgttcctcaatcttctttttgactaatttcaacaatgtcttattactcgactcggcttgtccattaattagcctgagcgtagtaaggagaagaactcaacaatttaataccataagattcggtaaaattcttcacttccttagacataaaagaagctccttgatccatagtcaatgtttgcggaataccgaatctatgaacaatatgcttcaaaataaaatcaattacatgtgtatgagtcatattcttgagcggcacagcttcggcccacttggtgaagtaatctgttgcaactagcacggaccgatgcccttttgatgacgaaggataaacttgaccaatgaaatacaaagcccaacctcggaacggccacgatttgatgatgggattcaacatggcggcggcgccaattgaacattgccgaaccgttgacaagcttcgcatcccctataatacttgaagcaatcatcaatcatcttcggccaatagaaccccgctctcctaagcaaccaattcatcttatgggccgattgatgagttccacaaattccctcatgaaattctcctgtagcaactttagattgatatcgtctaagcacttcaacaatacaccatctatattttggcgatatagctctccagcaagaaaattgcttgccgccgaatgttccgatcaaccttaaggataggatctttcaaatatccaatcaaaggaattatcaaaacttcttctatttcctgggtacaaacgtctgaatttacaattaattcggcctctaaatccatcaagatgtgccccccagcatcctgcccagagccggtcagaccgcacatgcaaggccgctcagaccgcataggcaggctggtcagaccggcggtactgagtcggtcagaccgcaagttgtcaccggtcagacagaccgcccctggtctgaaactttgccaatttcgtccaatgatttacaaccaagcaccggcttttccaatatcagaaacactcctttctttacattatagccagacgcttgttgagctagaccatttcctctaaaattctcacctctagcaatatgtctgatagcaaaatcatcaaaattggtaataatatccaagcattgatcaagatacctatttagtgacccatcaaagcacttgtaaactccggcaccttgttgcaccaccaattctgagtcacagtcacgctcggaatttctatccaaaattccaaacgcttacatgtgtgtaaaccctcgtccaggaatcagccgaggcacacaataacaaatcgataatagagtgcaattattactctaattaataagcgaatataaagtcattacagaggtagatagttactctcaaacaataaagttctaagcagcggaaaataagataaacggcgcaggcgactccattccacaagcagcttgaccaggactacacctaattctccacaccttcagcatcactgttgaactcctcctctgatgaatgattgcaaggtgagtatatgacatactcagcaagccacgcagcaaatatgcaagtgcaagggataacaaaggatggcataatatagtctcatttgcataaatggcatttaatgaatacttcagaatttaatcaaacagtaaagtatttaattaatcaatattaatccatcgcaatacaacatacccgttgcataggcccaaccatcctgaacaaccaatcccggctgcacagttctatctccaaacaaggaatataccattccaaaccaggagctaaacaagttattaccaattacagcatcatttattacggtgagatgtgtgaaactaatgacgaaagacattgttagacccgcccataactgctggcatgactattcgaatagttttactctggccagaggtgtaacactgtacccacaagacacaacctcaacatcatgtcaaccatgcgtcgcgatacttaacaagtacccaaaaagagattgtgacaataccctctgtataacacaattcaaagcagtgcaccgttcctggatcataatcacccccttaaaaataaggcatggactccccagcgacccccgtgggcttatctccgccacttcatagtctggcgctctacaatgaaccatactatacaaaaagtaaagccattgcccatgctggcttgtggttggcacagttaatgtttcacaaccgaaaatcgtgaaccggtccttaattgtcatgagcacgaccattaaaaccatgtgctcacaaaccaccattatcaattttagttgactaattaattaattaaccaatcacgatgaaccatcgtgagctatcattaagccatcattaaataatagtgaatcataaattatcccatgtatatgagctagtgtctctaagcatgtgtaacaccctgaaaattcgaccgacaaaatcaaaactctaaaaatacggattttcaaaaaactttttaaattaattgcatcatgccgatcttattcgtctattttatctggatttgatctcgaagattattaatcgtgagtaaagaatagttaattatgaataaatcgtaaaaacaaaattggtaaaatacatacaaattaaaataaatattaggtggggatagaaataaataaaatattatcgcgaccatatttggatcaattaaatttaaatacgatggaataagaattaaccctaattaaaactcaaataaattatataaaaataaaatatgagtaatattaatctagggtgaattcattagttaagataacacaaatattgagtaaaatgcatatatgcaaaattaggaattgtggaatcaaatttatatggaaaatacactaaaatcgggttaattagaaaatggcactgttcattgcacctcaggtgttcaacgcggtcccctaacccagctcctcctctttcccctctctctgtcgccaccgtcaccgcgccgtcgccgtcgcgtcctgccccgcgccgcgcttgcatcccatcgccgcctcgcgccgcgcgccaccactgccgcgccgtcgccgtctccatcccgtcgccgcgtgcgcgttccatcgccgcctcgagccgtgccgctgccgctgccacgccgtgagcccgcgtcgcgccgcgccgtcccatcgttgcggtcacgccgtgccgccgtgtcgccgcccatcgcatcccgccccgagccgcgcgccatcgctgtcgccgttgccatcgacgtcccgtcgccgcgcgcgtcccatcgccactgccgcgccgcgcgccgtctcgtcgcctcgcgccgcgagcccgccgcctcgcgccccgtgccgcgctgctccccgggccccgtgccgccgttgctaccgcgccgcgccgcccgttccatcgcctcgccgcctgtcaccgtcgccatgcgccccgcgccgcgccgcgcgccgccgctgccgctcacccgtcgcgtcgcctcgctccgcgcgcccccacctcgcgccccgcgccgccgtcgcgtctcccctctcccctcttccccttatctctgcccctctcctatataaaccccactattcccactctttccctccatcctcacctcctctcctctacccactccaccacgccgccgcctccacgccgccgcgtcgtcgcatagagccgctgcgacgccgccacgacgccgccgcgccgcgccgcgccttggccgtgccgcgtttcccgccgccgtcgcagtcgccgtgcgccgccgccgtcgccgccaccgtgcgccgccgccattgccgttgccgccggtaagccgtgccaccgccgtctttttcctttcctcagccggtcgcggtaggcaggacgagagagaggaggagaaggagccgaaagagaatacaggaagagaagggaagaaagaaaggagccgggaggagagaagagaaggaaaaaaaggaaagaaaagagaggccggcagagaagagaaagagagggagagaaaaaggagagaaaaagaaagagagggagagaaaaaggggagaaaaagaaagagagggagagaaaagagagaaaaagaaaaaagaggagagaaaaagagggaaaatagaaaagaagaaaaggagaaaaaaagaagggaaattgggggagaaattaggaggaattatgtcacaccctgaaaatcataaatatataaattgttgtttaaatggaattttttttgaaataattttaaaagccttgaagagaagatctaattttaattaataaattccaatataaaatagggccagataaaattttattaaatactttgcttaattctataattcctagatttttctgggatttatttgagctaaggaagtatttttaataaatggaattgcatttaagaaataatttaaattgaaaaatgttttaaaaagtcttcttttggctttgggccgaaagtcggcccaaaacctctcttctctctctccacggcccagtccggcccagtccgccgccgcgcgcgcgcccttgctcgctgacaggtggggtccacctgtcaggttcgtcatccccgagccgccgtcgcctggccgaaaccctagcgcgccgccgccgccgttcccttccaaatccggccgttcctttccttctccggccgaatcaaaagaggggaaatgatctccgggatctcctctaccttttctccgttggaatcttcggctaaaacgttttggaagttcgtggaatcgagttcgattcggatcggcctctttccttcaagccacgaagtttccttctcgtcgccggccgccgtgggccttcgccgccgcctcctagcccatttaaaaggctccccggtgtctcctctactcgccgccaccctcgccttcgcctctcgtcgcccgtagagctctagcgccgtgtgccctaacgccgccgtcgccgccgtcgctccagccgtgcgccgccgccgttccagacgtcgccgtcactcgggaaggtcgtcgtcatggtcgccaagtcgtcgccgtcctcgtccgccgcttcgtcaccgtcggaaaccgccggagcatcgtcgccgtcgtcaagccgcagtccgccgccgttccttcgtcgtcgccgtcgccgtccgttggtcttccgccgctcccttggtcgccggtgagttcgccgtgccgtccgctacctgttggtgccctccgttcgtgccgtagtgccgccgtttgccggcgagcttgcgccgtccgagctgtcgagccgccgagccgccgccgccggtggtgacgtcatcgctgacgtcatcgtccccgtttcccgtgagccgccatggacccgatcgatctcggccgtccgttttggatcaagtcgatctcggccgtccgttcccgtgaatcgccgccgtgcgcccggtccaccgcgaaaccctagcccgctgacgcaataaatcccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccgaagagtccgttttcgccggagaagagtttgaagagttccaaggccagcaaggcaagtcacacagatcccaaacaaccctttgagcatgttgatcctatttaaagctattgtttttattcaaatattgcatttattttcgaatgtcattgggtggaattaacctattgtttgttatagcccttttgttcttgattactttattccttgataccttgggttattataatttgactagttgagctttgtttatattggttcaactagatgtattagatataattgcttagccctgcttagaaacattagcacactattgggataacttatgactcactattatttaaagatggcttaatgatagttcacgatggtcaatcgtgattggttaattaattaatgtgccaactaaaacctgataatggtgggttgtgagcacatggttttgagagtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgagggtcgctggggagtccatgccttgtttataagggggtgattaagatccaggaaaggtgcgctgtaatggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattagctcctggtttggaatggtatattcctggtttggagatagaactgtgcagccggggcggttgttcagaatggttgggcctatacaacagggtacgttgtatagtgttggattaatattgtttaattattacttaacagttttattaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcttgtggagtggagccgtctgcaccgtttatcttattttccgctgcttagatctttattgattgagaggaactatctacctctgtaatgacattttattcgcttattaattagagtaataattgtactctattatcaatttgttattgtgtgcctcggctgattcctggacgagggctcacacacatgtaagcgttttgaattttggatagaaattccgggcgtgacaagttaggaaataaaatggtcagggttaatcatagattatttttggaaattcctcgagcgtaatagtatttcggtcgaaattccgagttaattataaaaatatgtttcttgaacagattagattaaaattggtagtaatttagatataattagtagctaaacaattagatgaattcttatagattattatagattatttttggtaatctctataagtcatcggttcacggtagaaattcggatttaattactaggaatcttagccgtgtatcatatttaatcgtttagtcatagactaaattaagttgtataatatttctaggatttcgttcgatatttagctcgtaatagaaatttctaacctattatatggatacaatgctcggggagagtaaattaaaaacttatgacaacgaaataattatacccgcaaaatagtttaaatcaaaattgggtttgccgtagttcgcagatagtaaagttaataaaaaggaatcgactttcgcattcgactttcatttggatttatttggatttttatttgaattctaaccgaattcaaatcaatttttgcacgtaactatagagcccgagggagttgcggatccaagcgaaggccaagacccgcaagactttgagcaaggcaagtcatcactattccttgaacatgttgatcctaattgcgaaattgttttgtttacaaacaaagttgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggtaattacctttgggaaggtaattgagatgcggcatgtggagacatgagcgccacattgccatgatgttgatgacatgatttgtgaaaggagaaataaaattaaacaattgttttcgactggggcggacggagaatttgggttgtatctggaaaaggctagtaccgtccccagtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtgtgtgagagagagaacttaacttgaaccataatttaatatgcgtgtgagacttctctttccccgggagcgccagaactcctctcactgctagaaacatggacgcctagagtgcatgaggatttaagttcatggagcgggtactggcaatgcgaggttatcgaaaagctttgccgtgacgcgtctcatgtgttgggacgaggctcatgtgttgggcagtcgcggagtgcgggtaaaatgtacatccactgtagtgtgagtaaaccaaatctattcgaacagccgtgctcgcggttattgagcaccgggacatgtattacacttggctagactctaaattctttaacttgtgtgggatgggatattacatgatgatttttatgctgatggagccacttcctgagaggcgggaatgtggatgtcctcagaaaaccataacgactcaatggcgggaagctatccttgggatcacaatggatggtggacagaaccgtcattgttaaatatgaacactggtaataaaacttgatcagtctatgctaggtcttaggcttgtgaaaataattacaaaacttgcttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatacctactaccaggagggagatgaagacgatggcactcagtaggtcttagtacggtcgttgcctgtggcaatggcatgccgctgcctgaattccgctgccttatctatttctgcttttggatgtattccggaccgctcggtccgatgatttaagactatgcctgcgggcttatgatgtaataattcgaattagacactcgtgtatgtgcacttggtattccagctatgaattcgtgcgtaccagatctgatccagggaaatggtactgtttacacgattgactcctgttataaaaacgggggtccacagcatggctaagcatcctaagcactttagctaaaaccatataatgttctagctaatccaattattaaccaagtgacaaagtataggtaagcaataacaaaggcaataggttccacccaatgacattcaaaaataaatgcaatagttgaatagaaacaatagctttaaacaggatcaacatgctcaaagggtcttttgggatctgtgtgacttgccttgctggccttggaactcttcaaagtcttctcctgcaaattcggactctccgggaatgtcggaatctaagcaaaaaagagcaaaatcaccaaaaaagcacataaacaatcatgaacagtacatgtggatatttttaacatgtagatctcaattttataaaaatttagagacttgaaccaactaaatctgagctaagatgacttagttatgaatttttaaagattaaaccggattaaatcatttatatagattttaattgaattatgacgcaataaagaattatttttgaaaaggaaaagatatttattgcatcagcggtcttgggtttacagtggaccgggtgcacggggatggtctacggaacgaacggccgtgatctaatcttatccaaaacaaacggccgagatcgaatcggtctaccgcgggtctacggctgacgcggtgctgacgttggcgatgacgtcatcaccggcggtggcttggcaactcacgctcgccggagaacgacggcgcggcgacgcaaacggagggcaccaacaggtagcgggcgacgcggcgaactcaccgagggcttagacgatggcgaacgacaacggacggcgacggcggtgaggttgaagctgcggcggcgttcgggtcaacgatgatggcggtgctccggcggtcttcggcggaaacagagggcgggacgaggacggcgacgacttggcgatcccgacggcggccttcccgaccgacgacgacgaccggagtggcggcggcgcacggctggactcccttcggcggcggcggagcacgggctctagtgcctagggcgctacgagcgacggcgagctaaagcgagggtggcggcggatagaggaggtcccgggagtccttatataggggctaggagcggtgacggaggcccacggcgaccggcgacggcgatggaaagtttagggttcgggaggaaaaacgaatccgaatcgagctcgaatcccacgatttccaaacgaaactagatgatgtttctataggagaaaagatagaggagatcaacgggatcatttcccctctaccaatttgatcggatcgggaacgacgcggccgaatttggaaggaggcggcggtggcttgcgtgcggcgggctagggtgcggctggcccgaggaggacgacgaccctgacaggtgggacccccacctgtcagggggagagagagagggagagcggcggctcggctcggcgggctaactacaccggggcgctagcaggccgaggagagagagaggggttttgggccgactttcggcccaaagccaaaagaggacttttaaaacctttttcattttaaattattcatgaaatgcaattccatttattaaaaatactttcttggctcaaataaatcctagaattatctaggaactatagaatcaaatgaagtatttaataaaattttatctggcccacttttatattggaatttattatttaataattagatcttttcttctagacttttaaaatcatttctaataattccaattaaacaacaatttatacatttgggatttttagggtgtgaaaaacctacccccttcaacataatctcgtcctcgagattcggaagagctggcgaaaagatgcggatgggctgactttaattcatcttcttgttcccaggtagcttcttcttccgagtgattactccattggaccttacagaaacggataactcagttcctggttcttctttcatctatctccaagatacggattagttgatcgcaccagctcgaccttctcctcctcgtgcgttcacctcgctgtactcccacgccgataagcaccgcaaactagcggcgcctctaccggtatccacacgtacagggacggaacgccacgcgcagatgtgctagcacccgcgcgcagctagggttttgcttggggagggatgtgacggctagggtttctcacgtgatgcaatgcctctgccggtcacacccctcacgaatataaaggattcatcactcgggcctccaaggtccgtaggactcctattcggatccctatccgaattaagctcattttggatctctatccaatccccttattccgacccattaagcatgcgaccctgtaggttcatatatactcggctgtaacccgaaaactccttttcggtccacgcatcaatagcggcccctagcagaatatattgacccaccgggcatacataaaaatcatattttctgaacctctagtgtatacttgtatgaacccctttgcatcacgattatcgattaagctcaaggctagatatgtgccatcctctaatagctcaatcattcactcgaatctgttgatggattatataacttgtgattgactcctcattcacctttggcatggccatgcacttccataatctacaacattgaggggcccagagatatctctccataggaggggcaaatcccatcttgattattcatatcccactacatgtttcatagcatacccgaaaactacttttataactacccaattatggagtagcgtttagcagtccctaagtaagctactacacatgttgagaaccatgataatctcaggtctaaggattcaacatcaacactcaatgagatcactgatgacacaatacatatggctcttgcagtgtctcatgttgggtctatccaacaacatattcaccaacatgtgtccacattattaatttggtatctttataccatgatccatgagacatgatcatcaattaatacatgtgctgatcatataaacacatttgttccacatatgatatttgatttgggatcctttagaaatagtaacaaacaacataaagagtctcatgaaagaatcacatattcattaaccaataaggagttatctatttcaaggaacaatgtcggataaatatgtaaacatagtatgtgatacaatcatctctatgattgcaactagggcatatcactaacagtctcccacttgcactagagtcaatcatgaatgtatcttacgcccattgccctagtgtgtgcctgatgcttaggttgagggagtggctttgtcaacggatctgcaacattgaaatccgtatgtattttgcatatcttcacaactcctcttcccactatctcgcgaatgaggtgataccgccataaaatgttggacttttgatgcgatctaggctccttggcttgcgcaatagcaccactattatcgcaataaaggtccatagggctagaagcactagtcatcacacctagttgaaaaacgaatttctttatccaaacagcctcctttgctgcttcagaagcggcaatgtattcggcttctgttatagaatcaaccactgtatcttgcttggaactcttccaactcacagcgcctccattcaggcagaacacaaatccagactgcgatctaaaatcatctttgtcggtttggaagcttgcgtcagtgtaaccttttacaacgagctcttcctgtcctccatagactaggaacatatccttagttcttctcaagtacttcaggatattctttacagctatccagtgactctcacctggatctgattggtatcggcttgttgcactaagtgcatatgaaacatctggatgtgtacatagcatagcatacataatggatccgattgccgaggcatatggaatcacactcatcttgtttcgctcatcagtcgtttgaggacactgattcttgccaagattaatgccatgtgacatcggtaagaaacctttcttagaatcttgcatattgaacctcttcaacaccttgtcaatatatgtactctggcttaatccaattagcctctttgatctatctctatagatccttatgcccagaatatatgctgcttcccctaagtccttcattgaaaaactatttttcaacgatgtcttaacggattcaagcataggaatatcattcccaatcaataatatgtcatctacatataggacaaggcttttcttcgtttttgacaaagcccacgccttgactacttcgtcaaaacgaatattccaactccgagatgcttgctttaacccataaatggatttttgcaatttgcatatctttttagctgattgtggatcaacaaatcccttgagttgtgtcatgtacacatcctcatcgatatttccattgacgaaagctgttttgacatccatttgccatatctcataatcgaaataggcagttatcgctaaaacaatctgaatagattttagcatggcgactagcgagaaagtttcatcataatcaacaccttgaatttgtctgaaacctttcgccaccaatcgtgccttgtagatgtgaacatttccatctacatctgtctttttcttaaagacccatttccactcaatggcttttacaccatcaggtggatcaaccaagttccaaacttgattgacatgcatggattctatttcggatttcatggctccaagtcccaccattgcttcctcataggtagttggttcatcgttttctaacaacaatatatcacgttgtcctgtagttaataacgcatacctcgcaggtgtacaccgtatcctttcggaccttcgtgaagctggtgcttccacaactggttcaacaacaacttgttcaacctgttgaacaacatcttgctcagcttgtggttgtgtggacgttgaagcgttttccagtgtttcctaaatttcttcaagtcgcaccatgctcccactattctttcttaaaataaactctttttccaagaaaacaccatgtcgggcgacaaacactttgccctcttcccgattataaaaataatatcctttcgtttccttaggataccccacaaagaagcatttatctgatttaggtgtgagtttgtccgattgcaaacgttttacatagacctcacagccccaaatctttaggaaagacaaactgggacgcttccctgtccatatctcatatggtgtcttattcactgattttgatggaaccttgtttagtgtgaacgcagctttctctagagcgtaagcccaaaagcttagcggcagatcagtttggctcatcattgatcgcactatgtctaacaatgtacgattcctccgttcagacaccccattccactgaggcgttcctggtggagtgagttgtggaacaattccacactcctttagatgattgccaaattcaaggctcaagtactctccaccacgatcagatcgtagatacttgattgtcttgcccaaatgattttgtactcagacttatgcttcattaagtagacataaccatatctactaaagtcatcggtaaaggtaataaagtacccaaaaccacctctggcagttgagctcattggtccacatacatcagtatgtactagtcccaatagttcacttgccctttcactttgacccgtgaaaggtgcctttgtcattttgtcaagtaaacaagattaacatgtctcaaatgattcaaaatcaaacgagtgtagaagtccatctctatgaagcttctccatgcgtttctcatttatatgacccaggcgacaatgccaaataaaagtgggattcaaatcattaggacgtcgccgttttgcattaatgttatagaccgaacatccatcaagattcacaatgtataagccattcatcatgggtgcatggaaatagaaaatgtcattataatagactgaacaaccattgtccacagatctaaaaccataaccctctgcttgcaaacaagaagcagagataacgttcttacacaaagctggaatgcaataacaattatttaactccaaaactaatcctgacggtaaagataatggcatagtgccgaccgcaacagcagcaactcttgctccattgcccacgcgaatatccacttcgcctcttgctaagctcctacttctttttagcccctgcaacgatttgcatatgtgagcaactgatccggtatcaaatacccaagaatcagtagaggaagtagcaagattaatttctataacattaatacctgaggtgaaactctttccatcctgctgcttctgcttgagctactctaggtatttcttacagtttctcttccaatgacctgtctccttgcaaaagaagcactctgcatccttagcgggccctgtcttttgaaccttggtcttagagttgctagtactcgtgatctcatcagagtttagctttctcttttgaccactcttcttgttgttgggcttgctcttatgcataaccatcacatggttggagtttttcttaatgctttccttcgcagtctttagcatcccatgcaattctgccaaggtcttattcaggttgttcatgttgaaattcattatgaacggctcaaagctgggagggagcgactggagaatcaaatcagtagccaactcttggctaaggggaaagccaagcttatccagactctcggtataaccaatcattttgatcatatgtgggctcactggattaccttctgcaagcctgcacgcaaacaaggacttttaggtattaaacctctcagctcttgcttggtcctcaaacatgttacatagtcccgtgattatcgtatgagcatccaatgcctcatattgcctttgaagctcaggggacatagtagcaagcatgagacagcttatatcaaagtattcattgcatcgcatttcatgctccctacgttgagcagcacgagcattgttgggcaagtcagctagaaaaggttgtgtaagcacaaactctttgtgctcttgcctgagaacaattctcaggttgcgataccaatccatgaagtttattccagtcaacttctctttctcaagaatagaccgcaagttaaaattggatggtgcaggagctgccatgatctacaatagaaatatatgtatgcaaagtcagcaccatgtttacatttaacctttcattaaacaatttaacaaaagatactcccactatgtattgtgaaacaaaattccctctagtaacatagtgagtcaagatcctcattttattagtgtctagtgagctttggcatcacagctatacaactatcaaaataggtaagcaacaccttactaatcacatcatatgtgactcttgtgttgttgggtgacatctccatgtccaacccaacctatgccccaaggtccaaaactgttttgataaccttgtcaagtaaactaataatctccgcatatagatgtccgacatctatcctattttatcatgataaaaagtgacactttgctatggcaaacccatcacttatgatcacaaccgtaataggtgcaattattggaagagcataaactacacttaatttttctgagggaatctatcctaccatgtcatatcaaatatacaaacaacaataaagtaagatagatataaaaaccccaagcgaaatctaaggggcaacgcacacggcggtcccacgggtttcagggcagcgccctgaaaaggtcacggggtacatagatctcatctacgattcgccatgtgaaaaccttaacagcgtaatcaaattatgccaaaaccgagtcaatctcactggctcgtttttctcattggcgtgcagttccagtggacatcggactatccgatgaacacaattgcactcggccttggtgagtactagacattccagtgaagtcaccaacacacataccgattgatcttatcaacccatgcggctaccagttcatctcatgttccgatcacctaagaacacatatacaacataatagatctcatctactacatccgcatatcaattatatgcaatgatctagatcataaactatacaaggcggctctgataccactgttgggatacgcgtaggctatgatagcatagatcaaaattttctatcgcgtaaaccaggaaccatgaagtgttagatcatagatcgttaccactcgacgtgctgcgcagcggaagaagacactgagaagttgaaggaactctcgcgaagtagcgcgcgtcgatgtagaggaagtagtcgatcgcaccggctcgaccttctcctcctcgtgcgttctcctcgccgtactcccacgccgatcagcaccgcaaaccagcggcgcctctaccggtatccacacatacagggacggaacgccacgcgcagatgtgctagcacccgcgcgtggctagggtttttctcggggagggaagtgatggctagggtttctcacgtgatgcaatgtatccgccggtcacacccctcacgaatatataggatccatcactcgggcctccaaggcccgtaggactcctattcggatccctatccgaattaagctcatattggatctctatccaatccccttattccggcccattaagcatgcgaccctgtaggttcatatatactcggctgtaacccgaaaactcctttttggtccacgcgtcaacagcagcccctagcataacgtattgacccaccgggcatacataaagatcatatcggctgaacctctagtgtatacttgtatgaacccctttgcctcacgattatcgattaagctcaaggccagatatgtgccatcctctaatagctcaatcattcactcgaacctgttgatggattatataacttgtgattgactcctcaatcacctttggcatggccatgcacttccataatcgacaacatcgaggggcccagagatatctctccataggaggggcaaatcccatattgattatttatattccactacatgtttcatagcatacctgaaaactacttttataactatctaattatggagtagcgtttagcagtccctaagtaagctactacacatgttgagaaccacgataatctcaggtctaaggattcaacaccaatactcaataagatcactgatgacacaacacatatggctcttgcagtgtctcatattgggtctatccaacaacatgtttaccaacatgtgtccacattattaatttggtatctttataccatgatccatgagacatgatcatcaattaatacatgtgctgatcatataaacatatttgttccacatatgatatttgatctgggatcctttagaaatagtaacaaacaacataaagagtctcgtgaaagaatcacatattcattaaccaataaggagttatctatttcaaggaacaatgtcggataaatatgtaaacatagtatgtgatacaattatctctatgattgcctctagggcatatcattaacagccaccgccagcttctcattccatgaagctagctagcagacaatggaagccactgggatgcagctgacgcactcatcttccttttctccccacctccgccgctcccggacttgcattagagcgtcgccgtgcatgtcgcctcgctttgacgccaacctcgccaaatctgccccgctgccgcggcatcgcttccttccatggcagcctcgatgagccatcgggctgtaatttgcggatgccgaggaacccatccgcccacccattttggcccacacgaagagctgctccaccattgctgtggggaggtccaccccgtcacatgcaggccatggcaactagccgacgcagagcgagagagcacaccagtggcaagcagttggtggtgaccatggcacgcggtggccgccagcgcacaggatgaggagatcgagcgtcgatgtcgacagcatggctagaccatgacatggtggctggcgcaaggttcttccgtcatcgaagctctacagtggcatcctagggaacccctgtttaaccttggcaatttatcgaatcctatttgaatgacggcatgttagcgaagctagtttttttttcaattacatagatgcaaatttttttgactatatgttcatcaagtaatgagaaaccataaaacactagtacagatcctcccatcaatgaaggcctctcacataactgggttttgtgttccgtcactccagatttgcccgagacatgcacctaaggagaaaatcgcaatcgggccgaaataaacaccgacgtagatcaactcgtacagatataattgagttgcatatatcaagtgcccatcaccgatgagactcatctgtgacgggcctacgtttaggcccgattgagattatctctacaatctttgtcgggcccaacacttaagcctgcaatggatgagtatcatcggtgacgggcgacaaacacatcccgattaacataaatttaaggcctatcaccaatgagcagttatcgatgacgggcttattggtatgcccgtttgagataactgaacgcccgtgaccgatgttctttcattggccgttactgatatctattgtacactacaaatactccaccccattgttctctgaagttatcccactgttcactattttggtgagaggttgaagggggtgaatttttgtgtatttttccaagaaaaacagaaaattcataaagtcagtgaagaatactaatcaattctcattaatttagtaatacttatcctataagatgtttctctaatattttttcatttttgcaatgatgaatcgaagttggatatatgggaagactgtgaaacgtcatagcaaggagtatagaaatgatgtattaaattttataaatgcagcggaggaggataagaaaagaagaaacaacgattacatgtgttgtccatgtgtggattgcaagaatgagaatatgtttgatagcagagtggacatacatggtcatatgatacaacgaggattcatggagggctacgcatgttgggtgaagcgtggagagcaagaagttacttctgcagatagaagtggtgcaaaaaatcaggaagaagaagatgagcatgatatgtttgtaccttctccattgggcagtgaaatggttgatgtggatcacgatctgctgcaggacatgttacgtgacgttgaggacccagcttacaacaagagagattctatgaagttcagaaggttggtcagtgactcggagacacctctatacgctggatgcagggcaaaacacaccaaattgtcagctaccttggacctaatgaagctgaaggcaagtagtggatggacagacaagagtttcacacaaattttgggaatattgaaggccatgcttcctgatgatatcctaaccaaccggacaaggaattgggcaagggcaagggtgaagaagaatagcgacggaacacttacgttcccaaatgccgaagatcaagcagtgtatcagaaaattgtaagttcaacacatcgcatatgttcaatttgtgtttgtgtctatcgtagtgtcgatttaacctggccttaattgtgcggcaagtcgaccttactgcctagagacagttctcgcaagaggtctcctcacaaagatgggatgatgacatcctcacggtagcgttgggaaacgaagaacaccgtggatggataagcggcattggctccgatattccatggaagcatgggtttccccaatacgcgtggcagtacaagaagaacaaactgacaaaggcggagaaagatgcacgcctcaaggaacaacttatggaggacatcagagctgagctaagctctgaattcgatgagaagttgtcacgggtggaggcacgcatcaggggtgagcaccagcaagggaacgtcgaccccgccgacgctcccagagtagaagtgagccccacggaaaggcgtagcagctgcgcatcaactgaagcggcggaagaacaaccaccagtccctaccgcagtggaccacacaatggtaaaaccaacaaataaagcatatgttgtcttagctcatcaatatgttatgacatattctaagaacatgtatgaatctatcacagggtcccatagagtgcaccctagtcgttagggtgacacaagcatttacacttcctaccgccaagggtcttgcgttcaagcctacaccgaaaacccgagttcatcgggcgtagttgatggccaggcatgctaaagtacaagtggacttagtcaagcccgaatgggtaggctccactctgatgcatccaccaaatgacgaggttttgaccctaggagttgcacatgggacctttatccaatggcccaagcataacattcagataaaatataagtcctaggccaacaccaagtactagacccactacaactcttatatctgcccctcctgccattgaagaaggagatgaagatctccaattgtaatatgatacagattttggggatgagggtttggaagtcgacagcatggcgtactttccccctcctgccaaaaagagcaagaaggcccaatcttctccaccacagcatgaaacaaaaaagaaagctgttgggagggggagaggaagaggaaaggtagaagcctcgcttctagttcccaataagccaaatcttggcaaggcaccatcagctcgtcccacggctccgaccgacttcacattaggcatgccactggttggagacgacatgttagcgaagatgggccctgcttgcaaggagttgcacgggtactacatggagatgtccaacacaaggaggaagcatagagagacctgcatgacgggccatcacgatagacagccattccttgggcctccaagctttattgctgttggtatttcttaatgtcacagataaaatccgcaagcgcacggaagataccgatgtagcacttcacctgggagtattccaaggtatagatttccacaggaacttgtgtgtcatctcttcactaggttcatccaaggacacaaagctaaggtaggctaagggtagagaggatttactagtgagagacagtgtctatagaaagctcagtttaatcctaacgcggtacttcgggcgctggccagtccgctgctcccagatatggctcttcaaagtacccagatagggatgactttagtgttttgagggctatcaccacctctacacctacctcaaacatactgtgggatatgaagcaaataccgaaaattaactacccagataccacgtctacgaagtttaataactactttaatgttagctaaacactaaagcaaccactatattttattggattatagtgatcagtgaccccataagttgattaggaactaaccaagaggtaactctcacagaataaatattaattactcccaatgatatttcgattaaagcagagtacttaacagagtgaaagaaataagaaaaggattaccgacaactccggaattcctccgacttcctctactctactctctccctaattctagtatataatatagtacaatagcgcctcttataatttagctcaagctttaagttgtgttgaaagtgaagtgaaaaactccttttatagggcaagtatgatgattataacgatgcaaaatgtcttaattgccccgcggttgacggtcgttatcgaccagtttcgaccatcaaaccatgtgaagaatggttgcacgttgttgcgagaaatcggtacaagtaagagaggacctcgagttaagtaccgtgaactacagggtttgaaatacagggttaaactctattgtttcctatgcaagagactataaaatgtaatcgcctagaaccaaaagagttggaatggaatgcatcaagaatactaagagtacggaaaagctgtttctggccctcctagaagatagtaccccatatgcatatggttttcttctagcatgactttctctttatggagacaactcttcccgttaagatataacagaaaaatagttttgttgctgctgacttgctaaagtatatacatagagttctctacattggtgtttaccctatcatgcaataggaaacggctggttaatttccattatttttcctaaataagaaaagatcatgccgctatttttttcattccaaggtgttttgagtatcgtaaatgggctatacatgttagactgttagcaaaaatgtactttgtttcaaattagtacttagaattgtaataggtgtatgatagacttagagtcatagtctactctaggttatcccttctttctataaagttaagacccaaagctaatatttagttaagccacgtcatcatttaattgtcagccgttggattacatctgagcggtcctcattgcgttttcgtagcacgtcctcggtcccttcgctcgccccccaccgcatcgccttccacaccggaccccacggctatttgcctccccccagcctcatcgcctattcgcctcctccctggccctggcaacaatgacgacggcggcgacggactctgtcgatgacgacagtgacagcggcggtcgcggacgagtgtggcgacaagggcagcagcggcggcggaggtcacggacgaggacgacggcgatcgagggcagcggcggacacggaagagggaggcagcagcatttgagggcggcagtggacgcggacgagggcagcagcgttggtcacggcgaacgagggctacagcgccggtcttaggcatatttggtactaatatgttctgtgatttatctgttttgcagctctgatgtgtagatgagtagcatatgactctccgtcgcaaatcgataatgcctattgcctgtgattctcccgcatgtctagccgaataattgcatccttcctcacaagcatggtgcagcgccaccaagtctctctctccaaatccaggaaactgcaaggcatcaactgtggcaattaaatcaattatcaattccatcagcacacttgagttttctcagaaatcgatttcttcaacctgcatccggttcctggccacagatgtcttctcacagtgtttgggtatgacttgaggactttatcttcatgtttcctttttctcatgtttttttcttctacttttatctaagcccctttcagcttattgcatcgaggtttggtattgcttgagctaaatcatatttatatgtgcagagcatccgcagatttggttcattggtttcgttcaagcttcactctttcattgtactgttaggtgatgtttgatgttctctttcatgctatatcttgcattcctactttcccgtggattttatagcacttacctctaaatttcgccttcaattttcagttttatttttttctcgaaaacactggagagctgcatttcatttcatttcagttttattttctgtgatgaggttttttttttctttaatgcaaaggtgatttatcaaactttcagaactgcaatatgctattctctgtttaattcttattatcggaatataccatattatgccagtgtcaatcatatcaagcacttttaatattatgccaggggcaatcatatcaagcacttttaatcaaagaacaaatgaacgcaattctcagcagcgtacagtaccaggtatattctgctattctataattgtatcccattaacctgcatttaattttttttctatcttgcaataacaatttgcatgggccttttactaaccatacaaaacacttctacattttgcaaatgaaatttcctatttcatcacacttctacattttgatggtgttttgcctattttcatcaagtagtgttattaccaccctacagggtgactttcctagatcatgtcatcaattatgatgtattctttagttgttgtttacccacaaacaagctctgatgcccaatattcagctacatgttcagctaatgagaatgtgtccaatcataggctaagtgacgtttcagtgttttaagataatttcacattcttatgttggacactcaattaattgtacatgtttttaatttcaggcttgaatatgatctgctaattacacaatatccattgcctccacggtttgaaactatctgctcacacttctatgaaccccgcaatgctcctttactaatcaagtaatcactccagttggtagctagattagggtttgtacgatacttaaaaggagttcagaagcagcacaccacttaaacaggtaaatatacagcagtttttttattagagattcattaattgttggaaattaagatgttcaggaaatcacacattcacacttgacaagttgatagctacttctagctatacaaatgcactatcgctgaattgagatctgctattttcaatgaagaactcccattattcgcaccagactacatgtatatatttgtacaacattcatattgcccttcttcagagttatttgcactgttcctaccctagttgattactttgttgtgtaatgcttgggcatttgtcagcacttaaaatatcatgatcacttcttacaaatcccgcagcaacgcgcggggtatcacctagtttgttaaatagagaagcacatataaccgtatggtaactatagcacatttttttaattagataatagattaaaaacccagtcactacatccaaaagctgtacacaaccaggtgactgtagcacatgcgagggatgattgggcggcagcctagtcggttgatggataccttgatgcgctgtaaccatgctatatcagggaggagcgttcataatcagaactttcagagatgtgggctatggctagactccatttctaaatattgtgcatccatatcgttattactttggatcttgtatggtgttgttccgcgcttgactacctatgttgatttcggtgcatgttttataacaatgcatttgcaacattatacccatatgaatattaatgagctatgttaggactattagaatacgcgtagactacgatagcataaatcaaaattttctaccacgtaaaccaggaaccgtgcaagtagtagatcatagatcgttaccacacgacgcgctgcgcagcgcaagaaagcgctaagaaggcgaaggaaccctcgcgatgtagcgcatcgatgtagaggaagtaattgatcgcaccggctcgaccttctcctcctcgtgcgttctcctcgccgtactcccacaccgatcagcaccgcaaggcaacgacgactctaccggtatctacacatacagggacagaacgccacgcgcagatgtgctagcactcgcacgcggctagggttttttgctcgggaaggagagtggcggctagggtttctcacgtgatgcaatgcctccaccggtcacatctctcacgaatatataggatccatctccaaggcccataggactcctattcggatccctacccgaattaagcacatattggatctccatccaatccccttatttcggcccattaagcgtgcgactctgtaggttcatgcacactcggctgtaacccgaaaactccttttcagtccacatgtcaacagtggcccctagcagaacgtattgactgaccgggcatacacaaagatcataacggttgaacctctagtgtatacttgtataaacccctttgcctcacgatatcgattaagctcaaggctacatatgtgacattctttaatagctcaatcattcactcaaacttgtgatagattacataacttgtgattgactcctcaaccacctttggcatggctatgcacttctataatctataacatcaaggggcccagagatatctctccataggaggggcaaatctcatcttgattattcatatcccactacatgttttatagcatactcgaaaactacttttataactacccaattacggagtagtgtttagcagtccctatataagttactacacatgttgggaaccatgataatcttaggtctaaggattcaacaccaacactaaatgaaatcactgatgacacaacacatatggctcttgcagtatctatctaacaacatgttccccaagatgtgtccatattattaatttagtatctctataccatgatccataagacatgatcatcaattaatacatgtgcttatcattaaaatatatttgttctacatattatatttgatcagggatcctttaaaaatagcaacatacaacgcaaagagtctcatgaaagaatcacatattcattaaccaataatgagttatctatttcaaacaacaatattagataaatatataaacatagtatataatacaaccgtctttatgatttcctttagggcatatcaccaacaaggacatgaagtaacaaatgagtagaattttgcctttgccaagaagatgtatgcacgtattcattataaaatttataatggcagatcttgtatgaacacggctagaaggctagaaattggaaactaattaaggttgaggtggaggattatgttacttccattaagcacaagcatattaattgttttgctactagtcagtaccacacatatggctagaagctttatctaacgcaattttttttgttaggacgtgtgaaatcatatgacaacacatgggaaacaaaatagaataaggccctgtttgattcagattaggattattataatttagattattaggaataaagtgaaacaaacagatagcctattatgatggattattataatctataagccagattactttaatctagtaatctactctaaatgttctttttttagtttattgggttgctaacagctaacaaacagcttataatccagagaaacaaacagcttatagcttattctatatatgttggcttattataattcagcttacagtaatctaactcaacaatctacgttacaataatattaagccgaaacaaacaggtcctaattcagtgtagagtcatttttgtacgtgcacgaaactgcttttccaaatcttgtttcatcttcaggtccatggatcgtcacaggttgtgcatgtatgaaatcaatactgtaacaatatcaccacaggagagtaatacctatgttttgcgcagaaatttcatcgttgaacagtggtttcatcctatttaactgagaattcactacatctattgtgtcacacatttggtctgcagtctgcacctagtacatttatatgaaatagtgggtcaccttctgcgatctgccaattgctccgagtcaagatcttgccaatatacattaagagcctattcgcttttgatgtcatttttaaccatattatttttggtaaagttgctaaaaaaatgtctacgtttagcttgttgccaaaattggtaaatacataagaaatcctaccaaaattttgatactattatcatcttaccaaaattttgttactgctaaaatttggtactccctccatcccataatataagagattttgagtttttgcttgcaatatttgaccattcgtcttattaaaaaaaatttaaaattattatttattttatttgtgacttgctttattatctacagtattttaagcataacttttcgttttttatatttgcaaaaaaaattgaataagacgagtggtcaaaaactcaaaatctcttatattgtgggacggagggagtaagatttattttagatataatctaaatatgccctaaaacagaaactataaattagagatcagtagaattgaaaacttcacatgatggaccagatgtttctggagtccatcaaagatctaccgacttcttcatcgtcggctagccagtgggcggactagtacatttcctgtgcatcgacaattaacgtctacctacttttggatcatagcgaaaaaagtcggatcggggattaaccttgtgcagggttagcgatctcgaaattatgttttttcgggggagggtagaactgaaatttctgaaacatcggaaaattgatggccgaatttattttaaaatataacgaatttaaataaacttttatcaaattcacaggaaattggaaaaagatgaaaattttggatgagatttttgcttgccggtggggaaatttctgaaatttcgaaccgaaatttcaatcactaacctagtgaggtcgtcggttcacggtccaccagttcaccagttagatgacataattattctttcactttaattaattttaacagtgcgaaatataatactttaccctttgatatctagtaaatttcacttgcacagctggttacgtggaaacgcgcggtacgcttaccgtatgtcatcatgccatgcacgaggtcatgggttcaactccccacttttgcaacatttcgctagagaaccatccggtttgatggttttccactggttcacatgcatgaacggaatttcctacaaaccgtactgcgccaggctttggttctagtttaactgtcggttcggtctggttttttctactatattagtttaaccgcgtgctcggtccgtttttttctactatattaggacagcagtagcttatatatcagccggcatactgtttgtgttgcaaaaggagacctcactgatctcctgggaaagacaaagaagtgatacacaatggctgacaatgtcgatgatgactctcaatgggtggaagtggtgatgatcaatagttatgccctatttatggggtacttgtccatggccatcagagggatgggcttcctggtggttttgtggactaccttcatcctcctcggtggcttcgtctccatgctcgagaaggacttctggagtctcaccgtcatcaccctcgcacaaacaactgggttagtgatctatatttaacttgctcctcaagcttcatttgctgcttattaattcgttgtctccttttttttttttgtttctggtaataaatttgagaaaggagaaaaggcttttggagcttggaacttcgaaaaaaagctccttgactcactcctccgcatcatttctgatgttcatgtagttttatccggaatatataagaatttgtgatgcaaaggaattacataggaattaacactagcagtcctatagaaacacgttgtcagtaattagaaagagcacaggttaattgcttgacgggagtcaataataaaatcagcgcgaaaatagtgctgattgaggaaaatgtacaccgttggcgaatggcgatagatgttttgctcctccttgtccagatagctgatcaatgatctgctccaataatttccatgatgacagcactgatgtcagagattccaggacagctgtgacgtcaaagagcgacagggagggacagaataataaagatgaagtaatgggcgtggttgactggctaaccacgactgtgtttaggtcacactgaagtttaaaagcttggttgaaattagtatgatgtgatagaaaagttgtgtgtgtataaaaggtttaatgtgatagaaagttggaagtttggaaaaaaactttagaactaaacagggcccaaaattctttgggatctattctttcttcctctcttctaaattttactctcatgtttttcatgcgcacgccttctaaattatgtgtttttacgcatatttttagaaaagttgctttaaaaattatattaatatattttcaaataaaatgtaggtaatacttaattaatcatcactactggatagctttactcccggttggtaaccccctatagtcctggttatgcaaccgggactacgaatccaggattaaagatgctcatctttagtcctgggtaaaataactagagtaaaaattcattttctagtcccggcactaaccaggactaaagatggagccaggccaggtccatttgctctctttttcctttttcattgtttttaacattaaatattgatttcactctgtcggtgacatggaaccgggagtatcatgactagaggcttgaggcagacacaatcgcccacgtagcctggcaccctcggggggcgtcgggcccgagggtgatgcgttcgccctcctcttagtccccccgagggggtcggtccacacccccct

SEQ ID NO: 60574 - DNA, 5858 bp, Oryza sativa
  unsure (1)..(5858): unsure at all n locations
cgcgtatgaatgcatgactgcccaccncancannattagctatttagctcaataaactcgcgtttgaaagttatcaggagtaaatgtcaaaataattggttcgccatggagcacttatccttctaactctaatcctcgccgtgagttgcacttggattctctctctataatcatcatatcttactctcaacacagatactcgtaccacagaaaagacagtttgggatggttaaaaatccggttgggtctcaattgggagaataaccgtcacgccattagaggttgtgtattacatttgctattttgatcgaattcaatccccaaaagcaaccacaaagtatactagtgcaaattagaacaacaaaggctagctatgctgattcaacggtttcttagcggtgcaaacatgatcatgcatttatgctaagctttggagctgtggggtgtgaatgatactgatcattatcttctattctgtggataattcagtgcactcctgtattagtatactatcatttgaagatttctgcaatcaatgtactaatattaattgtgcaataacaaagtttaagctgcctttgcccatactcttgtatgattgagttgaatgcttcatctcatgaattgcactaactggaaaatagccgtctttaactggtgctgggaacatccttaatgcatttcttattgtgatagtgtttttttctcatcaatttactccagttttcagaagctctgaagtcctgccaatggtacactacgtacgatacgtacatatggcacttctctgcttctaaaatgagcatgctccatgcattaggtggccttccatggaagatttggcattagattatttgccggatgcaagtagttctatgtaactggaaagacgctaagctttattagctcaataaacttgagttcgacaattatcaggagtaagcacgtgtcaaaataattggtttgccatggagcacttacccttctaactgcacattactaaatggtaagaggctactccatctgggagttgaggggcaatacggaattatttgatcgtgtagtagtagtagtgcaatcaaaagagctatttaccccccaaattcttgtgcgttttggagtgaattgaataattcctgtcatgagtcttactggttggcctggccatataatctggtgcttattaattttatcccatgttattagttccttaaattacatgtcatagccagaacttgctatattttgggacataagtagtatgcatgacgtgcaggagcaaagcatttatttgcggaagagggcatatatcgcttggtacaagttaagtatgcacggcctgctatatatagcttgctaaaatgctaataatacaaattcaagagcacaactttggttccgaagcactaccttaaacattaagcataacaccatgtgcacaaaattaaagatgatttgattctggggagtttgagatagattcaaaacaggactctttgaatcaccgaacaccggcccatgccctgatgcattttattggcctggagctctgaaatcttcccatcggtgaacttgtttattccaagtcgtctgcgggacagaccatctctgatagcttccttgttagctcgatctgtccacaaggagcacacgtcgatctcttgaagatttcgaagcgctcaaccatctcagccagcatggtcacgcttctggttgaagagaagccttgcaccactgctcatacaaggcccacagggaatcatctgaagcaaaggtccttctcttctgccacaaacatcaccttacctacagggcatacaggcagaggtggatcatactacaaagtaactagcaaagtgctcgtattttgttacgggattagaagaaaaaaaagaagaagaagttggtattgtatgttcccatgaaaaatttatatcgcttcatcattctattccttaagatcaatccaataatataatcgtaaaggaattaattaaagaggaagcagatcgattaccatgggcgtcgatgtgggaggataggcccctcctgaaggaggagatgatcgaggggaatcggatccgatttgcaccgcctgaagccgcaggacgtaggaggagcaaagacgccatcagcaacacctgacctagcaccgccaatgtcgacaggatctggatattgcggcgtgattggggatttgtgatctcggcaactcgcgggctcccatcggatggcctaataagccaaagaaaaagcctaattttaaattttcaaacttaattttaagattgattttgagatatttttaatgtagttttttttgggtgaatagccaattcagtccttcaacttttgctcaggggttgaattagtccttgatgttttataatgtccaaacaaagaccctaaagattatcatgcggcttaatatagttcttagacccacttaaaacgccacgtgtacatgccacgtcattcgtgcatgtaaaataatatttaaatgtccattttaacatttaattttctatcaaataaagaaaagaaaaacaagaagaagcaatcataaaacaaagaaaaatgtcaattttttagctatcaatgctacatatttttgccaatggccaaaaacttttttttgtgtgttttctcaatagtttttctttatttcctatgaaaacgtaagggtgtaaatgacatttaaatattgaatttgcatgcatagatgatgtgacatgtacacatggcatgtttagagggactaaggactatattgaatcacacaatgaacttaaggtacttgtttggacaatatgaaatgtcagggactaaattgatccttaagcgaaaggtcaaggatcatgttgggtattcaccccttttttttagtattggcttttaaatcaccaagaacatatacataaaaatttttacctataaattcatttttattcccttataagccgttttgatttattaggaaaaaagccaaacgatgaggcctgcggtttctccccttttctaaaaaaaaattggcaacaatatatatattcatcctctatgggtttcctaaactgaatgtagaaagtgaaaatatatatactgatgtacctccgatccaagaaaagtctaaaactgattctctataatcaaaaggtgggccctccgttaaaccacaaccgaaactcgataaaccacaatcaactgtttccgcaattggagttacattatgagggacactataaattttgaggtgaaggatgtcaactgtgattgatattaccgagcaatttacactgcgattgttattgtacagaggtcgtactgtattctcgagtcacgatgataatcaattggataggtaatcttcgttgggacttaattgggacgaaccatcagctgtacttgtacctgtagcctgtggttgtgtattcaattttttgttttgattgaattcccccaaaagcaacaaaatatactagtgcaaactgcaaagtagtttaaggtaagctgtcttgattcaacagttctttgcaatacaaacatgattatgcaattggattgatgttagtattccatggaaaatctggatcagctttggggtgtggatgacaatcatcatcaacatatcatctgctctggatgggcgatatgatgtcatggatattcagtacactccagtgttgtgcaatcaatgtactaacagtagttgtgcaataactaagttacgctgcctttgccatgcatactcttgtctgattgagttgaaatgcttcatgtcatgaattgcattcattggggtaatagttgtctttaactggtgctggaagatccataatgcatttgttttattgcgatatttgggattttctctcatcaatttactcctgtgtttagaagctcaaaaattatgtgaatgatatacacatgtatgttaccattgcttctaaatgaacatgctccatgcagcatgtgatgtgaccctccatggaaaattcggcatttgattatttgttggatgcaaataattttatgtaactgcaaagacttgtctgtgcaaattatcaagagtaaatgtcaaaataaatggttcaccaaggggcaccagatttaattaggagaataatcatcagctgccactagtgtgcttataattttaagtcactaatttgggatggttaatcatggttgggacttaattggtaaaataatcatcaactgtacttgtacctttagccagtagaggttatgccaatcgaagattctgcactgaatgttgtagtagcagtaatagtgcaactagaagggttaagatttacccccaaactccttgtatgttttaatgattcatgtcatgaatctcacttgttggtcttacaaatctgctgttgattaatttaatccagttttagccaccttaaattacatgattggtacaatacttatctcaccattgttatttctgaattgaatgagtatgctgattactgcaggcagatcattctgctttagatcccaggaaggcgtctaaggaaagatgctttatttgaggatggctgctgatttgtgtgtgcacaagaggcggatgtaggagatatcatgactgtggaaacacaggtcattaatgttaggtcggtgaatgtagaaaagaaaagttggtgcattattatagtatatatagactccctttttatgatggtttgctggttcatctagaaagagcgtaatgcaaggatcttcgaacaacgttcgtactcagtggcacgggtgtataatgatataagggaggaaatcatcatttggaaggaagcaaggatttttcgagagtgtgattaatggaaacccttgccctgtctttgtctttttgggctgatatcggtttggttgtcaccccgccttgacagcttaatgtctatcttgtaaacactagtaaacctccttttcctcttaataaaatttggtcgggaaaaaaataatagtatagaagaaaagatgaagatgagtattatcaatccaatgaaggaaaccatacatatgaaaccaataaaacgaaaagagggacaagtatttatagtcagctgtagaaatcagacttgcttgacaaatttgaaggaaggccggttggggtttgctccagtgatttccctgaacgcacgctccatggcgtcccatggataagttgctttcagctcctcatcccggaggtatatctccacgcagatgctttggaggctcaggaggtgctgcataccctccggtgttacgtgaatgcccgactcacaattccggaaccacagatggaggctttggagcttgggcatcacccctgcctggaactgcagccttgaggcaacgtgttcacccacacgcagcttgagtttcaggagagcagggaataatgannnnnnnnnnnnnnnnnnnnnnnnnnnnnctcttgtcttgagtcctactctcagctcgaggtcggcgagggagggtagttcaccaagaaggtcaacctcgctactcgatgtctccgatacctccagcaacacatgttggaggttacggagagtaccgttgatccatcgaggtactttggagaagcaccaaccgtgtagtattagtctctcgatactttgaggaaaaatgggtaatgagcccagcaggtcaacatcacctaaggtagcaggtgggacatgaatttgcaaactcctgagttcatccagttttccaatggaagaccccagagcataaaggctaaggatctcatcgtcccgccacctgttaacagagatgtttaggtcccttagatttttcagctcaccaatggcctccatgccttgataagntngatcagcaagtcactcactcattttttt

SEQ ID NO: 60575 - DNA, 11717 bp, Oryza sativa
  unsure (1)..(11717): unsure at all n locations
aggtatgatgactgctggacacnacntcatnacaagtttggatttctctcacgttgatggtatgtcacctctagaattcagtgatgtttgaactggacttaaatacttgctgggaatatttacttcgttgctgcgagtagcatctagttgatttgtttctgaatattaaagtatagatgttcatgaaacacttgttagaaacaacagtgtattacctttcacgggctgactcacatatccctttttgtagataatttcagcaattgcaggaggaataacagatttgtcttttaatgcaattggttatacttggcagatcttgaactgctttctaacggcatcatattcggtattgtttttgttcattttaacaaaaacctgattacatatgcagcctattcttgaactgttattcccagttgtttcaaattcctaaaccatgatgtagccagttttcagtatattcatttctaaagtgctccacaattattttaactaatgaactgtttttctcagcttacattacggcatgtaatggacagtgccaagcaagccaccaaatctgggaatttgaatgagttatcaatggttttactgaataatattctttcagtaccacttgggattatcctcgtgcttggtttcaatgaagtggagtacctttttgaaacgtaagcaaacttcactcgtttgttctgatgtgaacccaatagacttggtttgttctgaggttcataacgtgaacctagtagactacatgggagctgtggaatctccatttatttcacaaaaaaacctctttcatgaaagttttctttctatgcttccttaggcatgtcaatggcaagttaatggtgtctaacagaatcggtaatggtaatgacctccacacatgtcaataaggcatgtctggacactagaaacaaaaaggtgatgtataggattaaataggttgtcaactagtaatgcatcggtacttaggatccttctgaattacatgcaaacctatcttcttgttgcagccacatctcctgacaaaaccagtatttacttaatctggtggcataatgtatttacaatgtgaatgaattttcaggcctctcttaaggatgcccatgttttggatagtcattactgctagtggagttttggggcttgctatcagctttacttctatgtggtttcttcaccagtcaagtgcaacaacatataggtactgaatgaattgtagtggctttttaaaaaatgtttatcttcatgtgctctgtcttcatgaatttctaatgtcaatattgctcctgatatagtcttgtgggctcccttaataagatccctctctctattgctggaatccttctcttcaaagtgcggacgagcatggagaattctttcagcattttgtttggtaggcttttttttaataacaagggaaaaggtactatgttatagatatcacattcactaataagattcatacccattatcgtgcaggtttattggcaggagtattcttcgccagagccaaattgcttaataactctcagtcctagtcgtaggccaagctttataggttatacaaggcagaattattctagtcagtcagattcagaacaggatgctcgctcggattatgttcctgggaaatttgtgcagatgtaaagatccttctccagctaacaagaagagagattggcaacacatttgttactatggggccatggggctgcttcagttctttttcctcgaaatcagtatggaccccctgttgtcgctctcgtggttgtggtatacgtcctcactttcacttacgatcgaaaggccgataatactcaaatgcaggcagtttgggggaaaaaaaacaattgacgggtcgccgcatttgtaatgttgtgaaattgcagcggttggatcgaaatgggattggtgtttttgtgcgttgcacggctgcttggcctgctgctgtgttgagtatactgtatatacttgtgcagtttaattttgtgttgcccttccctatatgttcttctacaccgtgtagggctgaaggaaaatgcccaagctcctcatgtgcagaactcaaactcatgggatacagtgatactagtgcagaatttgaactgacctgacttgtcccaaatttcttctgattcactttattctcctggttgttctggaatttctgctctgcaaactgcctcttacatttgagaatctcagccaaatttctgccttgcaaactgctcctacatatagtctcagacactggactgaaacatgaattaagccccccaaaaaaaaggggtgaaaaaaacatttgaacctcccagcctagcacggccaacaaggccaaagcggtgagcttcagatgatcagatcttcggtctgacacactcccaatgccagcatggccccactcacgatttagagcagctagcgattcatgttaaacagattcaccgtagcacgtatagacaacacataatttgcatgcagtgaaaatgattctgtaagctcatttcttcatgaatatattctcccttttacaattgataaaacctgaactttgtgctacatacaacctgataaactaaagaatacagctaagttgtaaaatctgactgtatgatcctgaaatcctctgtattatcatcctataatggcaaaagtagacacctcattgcaagaattccagtgtctgtcacaaaaaaattccggcttctgtacacttagactcaagaatggccacaccaagatgacgagccatttctcctaaactcttcacatggcgctggaagaacatcatgtgcctctccatacacagactcgcaatgccatctatcctgacgctttatcactgtcaagctaacgtttctgaagcaaatcccttcatacaccgcaccgtgcactgcctccagcatcggtgcgcgctgtaaatccacaccgacaacgtctctgatgcgcacatcactgatctttggcagcgcacttcggtcatacttgtcatctgaatgatcatccgcacctcggctgaatcttataggcaccttgaccttctccatcctgacattctctatggtgatgttggttatgtagccacctcgtcctacatcggtttttatcctcaccgcttgcgcggaattccatacgtgcaggtcgcgaatgatgacatttgatattccaccggacatctcgctcccaaatcccacacctgagcatgttggagttgtgcctgaaaccctctggatgatgatgtttgagcttggtttccctaccgagatgccgtactgatcccagccactcttgacagcaaccagatcatctccactctcaatgtaacagtcttcaatacaaacttctgaactcgaatctgccattatacatcaatggaaaatgtcatggatagccatgcatgctcttcgcagtttgaggttttataatgaagttatcaccagtttgaagcataagtatgttctaattcaaatttgtagtgctaaaaatggcgataaagcagtatctaactacgtcagcttctaaagagcaaacaaataggaccacttcttttatcatatgaagtacagcaatcaatgatggtccagagttggaattaacattgcgtaaaagaggaacaccctctaggagcatgtacctggatcaatgccatcagtgtttggagcattcaagggagctagtacagttaagttccttatcaccacgtttctgaaagaaaaaaaaacaacatgttcactttatatgattccaatataatgaatatcaagagggcaagtgcaattgtttattcgctgtacaaacataacaaactgacctgcagtagacgggatgcactgtccaaaacggggagttgcgtagagtgatattggagatcatgatgttggttgagtccactagctcaataagatggcctcttgtgtggttcaacgttcgattccaccataggtcccaccaaatcctgccttggccatctatggtcccattgttacctaacatgtgttttcgaaaactgattacctaacatgtaaaggggggcacatgcaagttacaagtcaacgctagttcttcacatgtatgatatgctatacctctaaacataataatgttttatgtaattatgtttatgttgtcattataatgacttaattcagcacatacaactttgctaattgatcagaactgaaatagacatagctaataaaacaacttctgtacccgtaataacaacatcatccaggccctctccatggatgaggctgatgtggcgtggtcctaatctttcccgcccacgcccatacgacggcaatggggctatgagaggccattcttccggatcctgtacattacagtccaaagcaccagtcaatgctatgcagatttccattcaacatatgcaacactatgaagtgctggagactgttcttcttaaataccaatacaaataatttaatcaagaatctagggtatggtccccctaccccgtcaagattgattgttcttcctgctttcatgttggtatcattatgagtagaacgatctacactacttttttattcatgcatctgtcttctgtgcgattgatgatcgttcgattgcctttggttccacccaattcccataagaaactatatggcgcgatggttcgggaactggcattagacttaagtaaaatgctaggctgcaattttcagttggttcactcactccaactgaccagttttcacttttcacagtaagttgttcttggttctacaacaagcatttgaatggtgttttttttttttgccaaaaagactaattggacacctggccatgattgtattagaatattaaggtgattctgctgtgagtgcaagtggcatcatgtcaaaggcatagcatctaattaaagcccttaattactgttactaatttatggcctctatcccaacaactttctgcctcaaacatgaatgcagcactccgtacccccatacgccatacgagggaatccatggagcaaattctactccctactactacaaggtagaagtagtagcaaccaattgcatgaacaccactctacaattaatttataggcaccaaaaatgtggaatatttagttcctgtaggaagctccaaacaagcactgcagaattgtctacaaatcttttagcataagcagataaagacggcagaagaagcaaagtacaaaagcagaatcagggtgtggtcagtccaagcagcagtaaggacaaagcaaaggcacatgagagtagaataacattttggtaggctgcctggtagtggtagcagaagccacaagaaaccagacagtccaagcatgtgattccaacccacccatgtcctctctctcatgtttcaatgaaccattggcatgtgagatgagagatgtgacaacacacaaccgctgagccaagtttcacaatgcaaagtacagatgatacaatccagcaagaacaggaaccagcctagtaactgatatcctaatgctgtacttagagatttttttccagtgcaaatattaatttcacttcgcatatcaacatgattatccacaatcggatgaacagaatcaggatttgatttccatatatgcttaagtcaacgaactcttgttgcaactgctagaagccatggatcataaactaataaagaaaaaaaaagaaatcgaagggaaaaagaaaacgaaaaagggaagatgaattgatggatcacctgggagccgaggatgattgcaccgtggtgcaggaagagcgtgaagcggctggtgaggttaaagctccccgtgacccacctccccggcggcacctccagcctcgcgccgccgcctcccgccctcgcctccagcgccgccaccgcgcgccggaacgccgccgtgttggacgtgaccccgtcccccacggccccgaactcctccaccgacgccgacgccgcgcgccgccccgacgaccccccgcggtagaaccccgcgcagctgtccctgtccctgtccccgtcgacgcgtgcagtagcaggggcgacgagggcggcgagcggcgcggcggcggggaggcgggtgagggcgaggtaggaggaggcgaggaggagggcggcggcggcgacggggaggaggcgcgggcgcgggctgggcgtgggctgatgggcggtggcgtgaggaagcatcgcgtcgcatcaatggcgccgcgcgcgcatgtggcgggcgcgccgaggccaacacgaaagacaaagctaagctaggggaagaggacacaaaagctttttttttttttcaaacgactctagtgcaaaaatttagagactatagtagtatatcaacaaaatgtggatcataaacattttaaatcttatgagaatttcttgggatttgaattagttctatatgggatagtttcctagatgaaatttgtatgattagaatggtccgacccagtattaatatagcagaacctccgacctatagtatatgagtaaatttttatttgtgtttatgtctctcttaaaaagtattatacccctccatcagtgtgttctacaaaatgttattaataaaaacatagataatattgcttattctttagaaaggtcaatgtgggagagattcaccatacgaattgtctcatttgataagggaaatgtgagcaagagagagaattgttgttactagcacgacacaacacatggtgttcgttagttgcatttgtttagcgcacgagaagtcaaggatgcatcctcaacacagatatgtagagcataataccttgtatcgatgcgaattcgtttcttaagaccacattgtacccgtggttccatagctaccaaaaacaaaccatgaagaaagcatggaaactatagtgagggttcagggtgcctccatcctccctaattcttccacatgcatcgtggaggagagatgcggataacgatccacataagtaacactcaatttttttaaaaaaatattggctttccttagataccttacttgaacagatggattattatttttatgtagagaatccaaacaacatattagttatttataaattttaccatcgctaagatttatctagacatggtgtcattcgatatcattaaacactgcctgcacggttttgcctgatctagacttgattttgattttagagtaaattgtattggcggtacacaaacttgttaggtgggtgcaatttagtacataaatttataaaatgttcgtttcagtacacgaacttgtctagtttatgcgaacgaggaccagaataacttggaaatattaattttatgaagctgacgttgattaggatctaacgtgcgtacgtttagtgagtatacacaagaaatgctatatttataaatttggtctctactttatccttcatcatggaaatgatgaatttcatatatttctaacccttatatcatttcttgaattttttttaatccttttctcctatcactatatactattctattttttattgaagatgtgtatatctaatagcaaccttctcatatatatatatatatgtctatatagtatcctaatctgcttctaaatctaagattagacatgtagtgtccttttcgtcttcttccacatgcaccagacaagttcatgcaccaaaacgagcattttgcaagttcgtgcactaaattgcacccacctgacaagttcgtgtaccggcactgcaatttactcttgattttagattttgctaaaatagacattatattcattaaaaaatttgcaatgttggttatatttaactattagagccatattataattattgtgtcttttaaagatttcaagaacagactcataatatatgatttgttgcttcttcgatgtatgccttctggaacagagttaatatctaagataagaagaaacatgttactactagattttaaagaaatgtgggtacaaaaaaggaatggttgcaatgagaatggatgctactcgatagtggccactttgccgcgcatctcatttttagttggacacgggtggctagcgcgatcgtgtgtgtcggcggatggctagtttatctcaaatagcagttgtaagattacaagctctcaattcatatatttataaacaaaagatcaattatgtcatcgcatcttggttagaaaaaaaaacaaatgattgattttcgtatgcaccgatcggtcattgaatattgaaaattatatatgtgttgtgtaggtaattagcagcaaccagcttgtaaagcgagagaattgaagtgagggaaggaaattcgctttccttgtacggatggaccgacggaggaagaagaagggaaagcaagtcagttgtagaaatgggccgtgaaaggccaggagaaaaggcccaaccatcccgagcacctaacaattaattgggctggacggcctgcttcgggagaaagttgggcctcccctatctggcccatccagtatattggtagtatatgtacatgttgggccggcgtctcttgtttttctgtgggatccttttctgtgtgtttctgttcggaataagttcactttgactccctaaagtgacccgaatctaatccatgaccctaaaccgcaagaccggatatctggacccccaaactattgaaaccgatgcaatttgactcccttggcggttttggagagcggcttctctaacgtggcgctgacgcggtggtgttgacctagtctgtgtgctgacgtggcgcttaggtgacatttcaattaaaaacatatatgtgggacccgtttgttattcacacacacaaaattgtgggtcccactgacatgtgggttccacatgtcatcctctccctttcttcttcctcccctcctcctcccttctctctttctttctccctctccccttcggccgtccgccgggagcaagcggcggcgggcgggagctgaagcggtggcggcgggacgagagaacgcgaacacggggaacgccgccgagctgaagtggtgctgcctcgccgattgccacacggccaatcgaacagtgtgggcgcgggcgcgagttatcggagtgaccatttcgtgcgtcgatttgacatgcctttgttgctgttgatttgaccaaacgttgaaggaacaattatagatttaccacttattctaatcggtaccgtaaagacaataactgtaacttaaaaaaaaagcaaacataccattaaaattattattcgagtggcatctttataaaattaaaaaaaatcagtgacagatttacaaatgtccctattattttactggagtagttagtataatttttaatttattttttttaaaaagaaacaggacctgttggttcgttcgttggtctgtgtcttgttgtctgaagcctcaagcagaggagagagagagagagaggcagcgaccgacgaggcaccctccctgacttgaccaaatcaaccatcgtctcaattcgacaccacacggagacgaccattctcttggtctctcccccaaattccaattccaatttcatcatcttcttcgtctacctccagctcgcctcgcttcccccaccaattgcttacgtacgactactcctccacgccccaaatccaaaattccccaatccgatctctcgcctaccaccaagctcatctcgtttcgttagctacctaccaaattaataagggtagctacagacagcgtagcggacgaggaatccaaatcaaatccaatcctcaatcgaagaaatggagtgcgagccggaggagctgcaattcctgggcatggtgggtatctacagggaggcggcgtccatcctgcgcgcccaccggccgctcttcgcccgcatcgccgccgccttcgtcctcccgctctccctcctcttcctcctccacatcgccatctcccacgccctcttctcccacatcgactccgacgactccgccctcgactccgccgccccgggcacccccgcccagcgccgcctcctccaccgcctcgccgacgactggctcgccctcctcctcttcaaggccgcctacctcctcgccctcctcctcttctccctcctctccaccgccgccgccgtcttctccgtcgcctccgtctactccgccaagcacgacgccctctccttccccagggtcctctccgtcgtcccccgcgtctggcgccgcctcgccgccaccttcctcgccgccttcctcctcctcttcgcctaccacctcctcttcgtcgccgtcttcgtcgccctcctcgtcgccgccgactccggatcgggcctcgccgcgctgctcgccttcctcctcgccctcgcctacatcgcgggcctcgtctacctcagcgtcgtctggcacctcgccagcgtcgtctccgtcctcgaggactacaagggattcgaggccatgcgcaagagcaaggcgctcatacagggcaagctctggaccgcctccgccatcttcttcgtcctcaacgtcgtcttcatcgtcgtcgaggtcgccttccgggcgtgggtggtgcgcggggccacccacggcctcgcgccggctcaaggctcctcctgggcctcgccatgctcgccgcgctctgcgctgtcgtgatgctggcgctcgtggtgcagacggtggtgtacctggtgtgcaagagctaccaccacgagagcatcgacaagagcaacctctccgaccacctcgaggtctacctcggcgagtacgtcccgctcaaggccagcgacgtccagatggagcaattcaacctctgatcatcaaccctccgctccatccgatccgatcgctgtgagttgcgcttggattatatctctgtaatcatcatatttttattctcatcaacacagatactcataccacaaaaacacagtttgggatggctcaaaatcaggctggatctcaattgggagaataacctgtcagctgtatttgtaccagtagacattaaaggttgtgtattgcattttctgttttgatcgaattcaatcccaaaaagcaacaacaaagtatactagtgcaaattagaacaacaaaggctagctacgttgattcaacggtttcttagctgtgaaaacatgatcatgcattcatgctaagctttggataattcagtgcgctcctgtattactagtacactactatcatttgaaggttatgcaatcaatgttctgatactagttgtgcagtaacaaagtttaagttgcttttacccatatgattgagtcgaatgcttcatctcgtgaattgcactaactgggaaataatcgtcattaactggtgctgggaagatcctcgatgcatttttcagtgtgatattgtttttttttctctcaccaatttgcttcagtattcagaagctctaaagtcatgcggatggcacactatactacacacatatggcaccattgcttctaaatgaacatgctccatgcattaagtggccttccatggataattcggcattagattatttgccagacgcaaatagttttatgcaaactgaaggcgctaggtttattagctatttagcttaaataaactccgtttgaaaattatcaagagtaaaatgtaaaaataattggttgccattggacaactattcttctaactctaatccttcgcctgaagtgcacttgnatatctctctctataatcaatataatctaactttcacacagatacttctaccacaaaaaaaaacatttgggaatgttaaaaaacccggtgggt

SEQ ID NO: 60576 - DNA, 789 bp, Oryza sativa
aaaaatctatttggggtttattcgacggtcagtcgggaatttgtcaggtgatatgcactaagtcgtgtctaggttgatgggggcaatttcatgcgtatcattatagctatgcatttattttatgcattaatttattgattagccagttgcatcagtatcctcatttgagttcatgaaaaatgttctatgcataaaaatcatcatgctcgagtatttatttgagtcatttgttgctttgtttaatttggatttgagcatgaattggttcctatcccttgtctactttagatgtcagtcctattcctcgatcgcaagcgccgctccgagcttcagagtcgccgcccttagctttattgccttcttagtctgtttgcttgctagttttctgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgttttcttccttttctcatatttctacctatccccttcagatggagacaaggaatggttcacgcgactccaacaatgccagtggcagcgaagagccgatcgatggagcacgtgccaacggtgcatctgacaacaatccgtccccaccgcctaagaacccaacaattgctcaggtgttggacaatcagactcagatgatgacaatgatgatgcaacagatgcagcaacagtaccatcaggtgttgc

SEQ ID NO: 60577 - DNA, 581 bp, Oryza sativa
tgctgcgtatgatggtgtgtgtgcccaattaaggcatcattcgtttaatcccaatgagagagggaatggaggagatttattcacaactattatggtgtagaattattccccttcaatctccttcaatcatcttcaatgccctccaaaccgaacaaggcctaaacgcagcattcccacactaaaaagggcgcacatgtacaagcttatttttacttttatgagtaaattttataaaatcccagttttaattagggtatccgtattgtaatccctgtgaattgccattttttttcatgtaaccctatgtttgggggtaaaacgtttaaagaaactccatatttatgtaaaatgcatgtatttcatcattatatatgggaaaaagtacgaattaacccccgaactatcgcggtcatctgaattacccccctaaaccacaaaaccggacatttttcaccccgaactatacaaactggacgaattacccccctcgacccaatccacggtggttttggtctacgtgggcgtacgcgtggcagtccaatcagcattctatataaaaaatgtggggcctacatgacata

SEQ ID NO: 60578 - DNA, 595 bp, Oryza sativa
cttttaatgcatgattaattctacgtgctatcaattctagtcacattcttatatgacgtacactgataggcaacttttgggagaggaaatctccaacttcacagttagagatctgcagcttctccagaaccaagttgagatgagcctacattccataagaaataaaaaggtataatattgataatacccttttctcgactaataaataaataatcttttcctaattaaatggcgatatatctattgtctctttactaggatcaacttttggcagaggagattctaaaactcaatgaaaaggttgtacttgcatcttcttcttcttgatgaaatagctcatgatttaattggtatcagttcttacatctatacactgttcatgattgaggtaaaattacacgaatatatatcgctctatacttttaattgtaggggtctcttgttcaaaaggagaacagtgaacttcgcaagaagttcaacattgctcatcaacgcaacatagaattacacaagaaggtaaagtttctattcgatctactcgaaacatacaaaaatgtcgtagaatattattgatatataaatatacaatttacat

SEQ ID NO: 60579 - DNA, 13985 bp, Oryza sativa
  unsure (1)..(13985): unsure at all n locations
ccgtgttgtttacganctctgctanagcncaccaagcattccgacaaatatgatattcacaggcacccaaactttgattagcttccaagttagtggttcagttgggataacaccagagagcgatagagtggacactatagtcacagatacaatgttctgcagcaaaagaccatcaagagattatcaatgggtacaacaagcagcagaagcacgacacagaaataaatgtaatatattgtttgagaggtaaacaatcagaaaaaaagtaacatacctgataaagcatcagaaatattccagcactgaaaccatagccagataagatatacttattaactaaaatcatgctgcaggatgatatgcaataggcaagaccagatagaagagcctgattctgtatctttgggagactgaggaaatgtgaaggcctatctctgtctttttcagccttaccatcttccaagtcagtgttgtcaatacagaaggatcttgttatagatctggagaaaatatgatccagaaaacacaacataatgtgttagattccacgatacttccaaaacattttcattcaaatagacaagaataatgttttcacatggtattttcagttttttttcccattgctgaatcgtcacaccacatgattatgttgaaccgaacaagaatatttttatatgtaaacgaaaacattatatgtaagttgggatggagggcatgtaattgatggaaaatccactttatactttgaatacaatggcaacaagtggataaaagaacattggtcaagggaagcttacatgcctgttcccaacttctctcctcaaaggactcccaagtgcactgtatcctctaacctgatcccggaaaatactcttttcaccattcacaagaggacttgttacagtctctggcgtatttttcctaggagaggcatctgaatccacaggaatggctatagaaggagttctacaagataaaaaggatgccattagcaataattcaattatgtaagatatatgtaggactcttccttatatacagcatgccatgttctattgggtttcatctcatcaaatatctcaaagtgaactcaaacctcatgatccagcaagcaaatgaaatatatggtacttaagaatgctttgtccagaaggataaattgcaagcatatgcatttcccaaaagagtcaaaattctgttctagaaataacatgaaaaaggtcttgtgctgttaattcacacaatcaaattatcatcgctgcataacacattttttttcaaagcaattgttgaaacccaacccccacagaggcacaggcatcaaccggcttgattttgaaacatcagtagcgcattcgatggctgtcatatgaaataactatttgcttgtaaaggatgtctcatggttttgagacatggaaattctctatcagattgaagtgctgtgatctaggaagcaactccaaggttatcccgattgagcaaactgaccaaataaagtccggctatcacattcatccgccagcctcatacacacgctacagctattttgctgaacatctaatatgctcaactctgcaaaagtgcattatcagaataacggtatggtgaaccgaagtatgaattactaaatttaatcaatcatgtggggtacacgggtaaattggtgaaaacaagcgagttgaggcacgcatactactgtttcacttcccaaacatttagtttcattctattttgggaaatattgaacctaccctctaaacaatgaatgagctcttggcaagatagtggaaaccaaatcaatagctatggtcaacagaagagtgagaatctactactaccaataaaggaaacaagttcgttacatcagccattaggtagtaattaaccacacgcccatttactaacaaaacaaagttgttaaacatgggccattcactcgtttatactctcatcagccaaatgactaatactgtgcgatcaaaccatgagacaagtgtagccgcaaccctgtcaaatctcaatacatttctcatatgcaagccattcccgcttgtttgttagtttgagacttgggaggagttaaaaaaaaacaaaaaaagaggagaaacaaactagctgaggttccatatccatccatccctacacgcttccaaattacagaaaatatgaaacccggagagagagagagaaagctattgcaccgagacattcctgatgaaatccgtagctccccacaccgaaatggatcagcaaccaaaaaaaaaaaaacacttccccgaaacgaaacaaactctattagagcaatcgaaccacctcccgtactaaaaagttccctaatccaaacccagctagttataaaccgcattagtcaacctcctcgtcttcgaagggagcggcggcggcggcggaggtgaaagccgccaccaccggggctggaagcctggagcaggagccgcaaaagttgttgccgtacaggggaagaggagagagagagaggtcgatcggaggctgacctggtggagcccatggcgccgccggagccgggcggcggcggcgaagaatggcgcggcggaggaggagaggagaggaggcgtctgaaattttgcgaggcggcgacgactcgggagtaacggaggagggggggattcgctttaaaatatccggcggcctctctctctctgacgggtgggccccacctgtcgggtctcgggcgcagctgcttcgctgtggcttcctcgacaccccgagccgcctggtacttcgtgccgctgacctgcgggacccacgtggtaccgggcccacgtggcggtggcgggggataaggctgggcgttgccctggtcgcgtcgactccgcgtggcgtttggagttgggcgagccgtgcgaatgtcgtggcgttgactggagcccagcgatagcagtagcaggctttgcgtgacctgaccatggaggatgggctttgacctcattttgtttgcttcagattcagatttgtttcacacatctctttcatcttgcgtctgattatgaattactactactgtttagtttaggttaggacatcaggtggaagcaaattactttgaaatttaaacaagtagtaccaagattagtactaatccagctatagaatggagtggcaggaatctgtggaggttgacttaacattggtttagtattttctttccaatacaaggacgttatgagctaccacatatgccatagattccattgattatactgtcctaacatcagataaacacgacgtcaatcatatgcattatccaaatctcagttttgctttgcttgtgctaactatcttctgttgagaatggatacatacataccaaagatgtttgtttggttaagttgcagtattaattaggtcacttaataattgattattagttgtacaagaaatgtcatactattatatacatcatatttttgtttaatttaatgggggcgcagaacgattgagtttggttttgaaggtgaaattaattactccttacaattcatcaacgatgcatgtaatagcaagcactaaagttctatttaaaaaatccatcgcatacataaccggtgaatcaataaaagtagaaaaaacaacactatggtatcattcactgttttatcagcatgggaaaagaaaaggaaaaaggaaaaggagaaagaaaagctttcctggaggatctcgtcgcagcgagaagcagatgtcggcggcccatttacacgggcctctcatccggcccacgaaccagcccaattaggaggcaggcccgacacgatacaacttatcgtctcctcttcccctctcgtctcgtgtcgtgtcgtcttctccaacccatccaaaccaaagccgcggcggcgcgaggaggcagcgagagctagggtttggggcggcggaggggagatgtcgcggacgctggtgcagccggtggggcagaagcggctgacgaacgtggcggtggtgcggctccgtaagcacgggcagcggttcgagatcgcgtgcttcccgaacaaggtgctgtcatggcggacgcgggtggagaaggacatcgacgaggtgctccaatcccacaccgtctactccaacgtctccaagggcgtcctcgccaagtccaaggacctcctcaaggccttctccaccgacgaccacaccgccatctgcctcgagatcctcgacaagggcgagctccaggtctccggcaaggagcgcgaggcccagctctcctcccagttccacgagatcgccaccatcgtcatggacaagaccatcaacccggagacacgccgcccctacaccatcaccatgatcgagcgcctcatgcacgacgtccacttcgccgtcgaccccaacctcacttccaaggagcaggtctgctattcgaatttttttattccaatagaggaatactaatagggcttgctattcgatttgttaactactaccatctgctgctgcctgcttttatactgacaaaatagaaaccagcatcgttaataaacatgttatcgcaccattgggcttcagatacaactgatatagttagtgatattgacattgtgttaaatcaattgagttacttggtttcctgtttctctttacaatttaatatatggagatcatggtttaattgtttaagcacaaatttccatgtccttatttgcattctagcgtaataactttgtgtgtgtggtttggtacctgcggtcgcatttatttaacttggatcttcaattcttcttcaatcacggtaagaaatgtgcacacccagtttaggattttctgggccaaccaattgtattttaacatctagtttcttcagacacagaaccaatgatagtgtaaataacagaatatgcacaaaaagaatgtgtgaatgtaggtgaacatacctgcttgcttgcatatacaaattagacactccataaacctcgtgtcttgtggactagtgcttattggcttagcgaaggacactaatgtgatgaatcgttcctgtaagctcccagtggactattcctctgcatttgctccaattggtaggaaatagtctgttaggcatttagccccagaggcccagacttgatgacatggctgagtcaaaccaaacatcatggctgaataggaaacttagatcactagaaatatctctgtctctcatcatctgtagaactggtagcatgactaaaaaaggtaatggtacctctaaatgtttcttagttgtgtatcgcttgcaacaattctgttctaccttctttctacagttgatcaaccttgcagtgacagtgagtcaatttcttataataacatcatactttttgtgaataaatcagtaggaaacaggcatgacaataccgacaacataatatgttcatatttgttttgattacctatggtttcttcattgcacaggcactgagagttattaagaacctaatttattatgataacctatgatttcttcattgtgcaggcactgaaagttattaagaagctaacagagcatttccccataaagcgtgcaccattgagggtgcgcttcactgcaccaaagtcaaaatttgcaagccttacagagaagcttgaagagtggaatgctaatgttatttcaaaggacgagtctggtagccagccctctgttgtaagtgctttcttccagctattactatttcactgattatgattcgcttgtcatcagtgttccctgcatgactagagtctagaggcatttcgcaaatcatattggagctcatgttttcatccacaatgttatgaagctgttaaaagattttttttttgctgtcttttggaagttgttacattcagatttatgctgctttatgccacttaatatttttaggctgcaataaatttatgctgctttatgccacttaaatatttgtagaatttagtggaatccttcagaagcttgtcctaggatagtaggctttttttcattgataaatggattgtcatatactgctatgacttggttgttagccgtgctagtcagaagcttgatccctattgcattgttcattcttctgtgaaattatttcctataggagcactaccatcctgtcatgcttaactttataaccattatgtttgtcccatgtgtacgatgtttttcaggtgtgtgagattgagccatctattctacggtcatgtgaggagagattgaaggatgtgcaggggagggtggaagtactctcagtgtcagcgcacgcagaaggtggctcttctgtggatcaatatgaaaacactgaagaatctcaatcagtgcctgcagtggagattgatcctgttgctcggataggtgaggccatgcagaaacagtccatctcaagtgagccagaaaatcctgggcagggacaaggcaagcagcagagaagatgcaaagaatgtgacgtgcttgtggaggacaagttgtatagggagcattgcaaatctgggtggcacaagcacaactacacacgccacaagaacggccttcctccactcagccaggaggagtgcttggtggaaatggaattagccgactccaagagggacctaaaagactatgatttctgaggtgaattccctgtagttccacaatgatattgtgtctgtattctaataactttgtctgacttctggctaacattttggttcaacatgttatcttctaggctgatatggtaaacattccgtgtggtacatggagatgcagtgtttttgtctgaggagaaaggttgtctgtttgatgctgtatagggaagcagggaagggaatatttgtgtaaccgcaatgtacgctacttgcaatctactgaaatggagtggtctatccacattgtctaaccgccaaagagtagcagaaacctggttgttgctgtatagctgggccagtaaatctggtggcagttttgaatgttgcttattctgtaatgggatgctatgctatgctatgtgagactacatgttagtatatcatgtttcttgctctcattcctgtggacagaagtgaatgaaaatttggagatcgattttgcaatctacaatgtgccgattttgctagcgattgtttctgggatttgtggagtcgattgctgtaggattgatctcgtttgattcgatcttggaatagtcggcacgaaacaaatgaaacaggcatacatgttggttgcgttgaactggtttttaactcaatgttgtgtgtcatactcttgtcgctgaagaaaatagtgcagtaactgaaacaacagaacttaaacaaaacaacagtgcatccagactatcacacaaacagcaatgcttaaacagaacatcatcatgccaaaaaaaaaaagagaaaaaactttgagccaactaggcaagacgaggagatacaataagtacattaggagtatgatgactaaattcttgagcaaattaagcggcggtaaataatcgcgcgaaaaattgaaatgaaaaactcccgcctctctgcctccaaaacaaaaccaaatccaaatcttcttctccacagtcgtcgccgccaccgcggccgccgcccgtcgccgcggttgcgctgtgggctgcggttgacgaggagggagggaggtcgcgatgccgatcgagctaccgcgggggctgcccttcgccgtggacacgtggacggccgcctccgccgtcaagcgccaccgcttcctgacccacgcccaccgcgaccacatcgccggcatcaccgccaccaacgtcgccgccgtctacgcctcccgcctcaccatcctcatcgcctgccacatcttcccccaggtaaccttcattcacaaatggataattatctcaaatcaccaacaaaatcaaattattaccactccaattcaaagctcgatcgcgccgacgccttcgtggaggtggagctgggcgcgccggtgctcgtcccggaccccgacggcgacttcaccgtcaccgccttcgacgccaaccactgccccggcgccgtcatgttcctcttcgagggcgcctccttcggccgcgtccttcacaccggcgactgccgcctcacccccgacttccgcttcctcgccgccgactacgtcttcctcgactgcaccttcgccgcctgctctcttcactttccctccaaggacgactccatccgccaggtgaggtcaacattgctgctgctgctgaatcactgacaactcttctcctcaactgtaactctacatttttgctctctcatgatttcaggtcatcaattgcatctggaagcaccccaatgcaccggtggtttatctcgtgtccgacatgcttggccaagaggagatactcatggaggtgtcaaaggtgtttggatccaagatttatgtagacagggacaagaattcagagtgttatcacaccctctccctcgtcgcgccggagatcctcaccgacgactcgtcgtctcgcttccaggtgattggtttccccaggttgtcggagcgagcaacggagatgctcgcgttggcacgggcgaagcaccagcctgagccactcatcatcagggcttcttcgcaatggtacgcgtactatgagccaccagagggatcgaccaagaggaaaccggcactgacagagccaatgcgcgatgaattcggggtgtggcacgtctgcttctcgatgcattcgtcccgcgaagagctggagcaggcgttgcggttcatccagcccaaatgggtcatctccacaacccctccatgtatggcgatcgagctgtcctatgtcaagaagcactgcttcgcgtcccggttacgcaatgatgatcccctctggaagctgctcaggttgtctgatggaaattctgcagtttcaggatcaccactggctgtaccaactgtagagatgatcaagaaatgtgaggaggaagaggtcacttgttctgtcaaggactctttcagttctgatggtatcaggatgcgggatcaagaaccaactctggaagactttgaaatcaacgtggagccacctgtgacactgttcgggatagcgaggtttggattgacagaggaacctgaattgtggaaggatgagcatgagagtgtcgaaatcgacgagcttaaagtgcagatggagaattcagctacagaatgtgagcagtggaaggatggcatatctgtcttaggctctgaagtaattgattcagttgaaattgtggccaaagagcaggactcagcaatagaatctgaacagttgaaagattgcgaacctaaagatggaaccaaagcaactgatgtaactgaagttgaagtgaatgagcacacatcatgtacagaatctgtactttggaaaatggacagaagtgatgagtgtgtgacaactaagagaggtgaatttgaagctgaagaacagaaattcactggcagataccagttttggaaaatatgcaagcccaaggagatggagggtgctaaattgactgtacaaggtaaaaacactgttgaagcacttgatcaggttttggccatcgatcgtctagcctacttgcatgacaacaaccaagaggtaacaaaagagggtattgctccatcagaaactgatcaggagaactctaaagttcctgacaagggaagcagtgactcctcgaatgctattggatcatcaaaaggtctgaatgccaacctgagaaagctgtacaggtcgatgaacgtgccggttcctcgtcccctgccctcattagttgagctcatggcagcctcaaagcgaccaagggtttctcctgctgtgcagctgtaggcctatcatagattcatctgttgtttccggcctctactttcagtcattatttgagttagacctgtcattcaagaatacttccattgtaacagcgatgctatagcataataatatactataattgttcttaatagctaactaatttgaatgaaaataccatgcttacaaagttgcaagcttgcaaccttcaggaactttgggcagtaaggattgttgcctcctgccttgtttgggaatatataatgatttcataattcaacagcatcacgaacgattttcttgatacagaacttcacatccaagattgcaaacaatattcaacagggaaaagagcttttggtctgtgagaaactcatccagtgaaagatatacataaatttaaggagcatggtgaatttttgaggccaactagatagctacaggctgtgtcaaacagcccttgttttcacaacaggacgatacttttcagggatagcatttatatgttgatcgtatttgccacttgaaaccagcaaaaccagcgactcagccgtggaagcttcaagggagaagttattttcatcaattttggagagataaaccccagccttgcgtacctcccctttctgtagtaactttccaactaaagcatttagcattcgggagttagctgtacaaccattcttctccaaagaaagaaataaatcatccaactcttctagcaacccttgttctatcaaacttttcatcattaaccagtaggtcacaacattcggcactaaacctctagccaagagagaagcaaacagatccttagcttcatcatgcctgccacctttaagtaacgcatcaatcataatgttaaaagtcctattctctaggtggaaatcaatcaaatataggttctgaaaaattcggagagcatcatcagtgcaattgttttggcaaagtcctagaagtattatgttgtatgtgccgatatcaaactttatcccacttttaatcatccaaagatagagttcttttgcggctgcagttcttctagcctgaaacaacccctggaggattgtgctataggtaacaatgccaggattaacacccttgcttgccatctgtctgaaaagagaaaatgcatcctctatcctaccgttcttacagtaaccattaatcatggtattataggtaacttcgttaggtttcaccccatctaacaccataccttcaagtaactttgctgcttcatccaccttaccatgtaagcaatatccatctatgagtgtgttgtatgtaatgacatcacgctgcacatctacacgtaccatcaagtcaaatatgtttttggctcttgcaaccattccttctttgcataggtggttcaacaatgtgttgaagaaaatgttgttgggacagatgcctcgaccgatcatttcaacagctaactcctcagccttgtcccannnnnnnnnnnnnnnnnnnnnnngaattaagtttctaaaaacaacagcatcaggagttagtccttcagagatgagcctgccaaattgggccatagcatcatccactttacctaccatgcagagcgcgtccattactattccgtaggtgactgtatcaggattcaatccttgcctcctcattttgctaaataaaagcatggcatcatctacttttccatgtttagtgtatgtgcctattaatatgttaaagatgtagtgatcaggttgaataccgtttcgtaccatcatatccaatagatgatgcatcttaacaagagatccttcagtagcatacccatgaagcagagtaccgtaggtagcactgttaggcttgtggcccctcttgaccatagagtcaaagatctttctagcttccatggatcttccattcttgcagagatagcccatcaacgtgttataagtgaatacatctggttcaacaccatccctgcacatccttttgaaaaccccaatagcgtcattgggctttcctgatgagcaatatccatgcaaaagactattgtgcgtgatgcgattaggcatagcaccattcttaaccatcctaacaaggaccacagcggccttgtccattgctcgagccttggaaagggcagagataatcgagttgtaagtcacaacatcaggcgacaacccctgatccagcatttgatcaaataggtgataagctgtgtccagctgacgaccctctctaagcaagccgttgatgactgtgttgtatgaaaccacgtcgggtgggtatcctcctctggtatcatcagccaccatcatggtgtggagcaggtggagagcttgttgactccggttttcatcacagaggcccttgagaaggatggtgtaggagaagacattgggtgtgcaacccagaacaggcattcgtcgcagcgcaatgtccattgcttcgctggtcctctttttgtcgcagagagccttgagcagaggactgaaggtgattgcttccgccgtccatccagacctaatgacacggccgagggcggcgaaagcgaggtccaagtggccgacgcggctgcagcagtcaatgacgacgctgtaggtgattaagttaggaggcaccttgggtcgggccaccatcaccatgcggcggaagagggagatggcgacggctgggctgtgacgcgcggcgtcggagagggcgcgattcaggtcgacgatgctgctggtggtgggtcggtgaagcaattcatcgaacgcgtggtgggcgtggtggctatcagtgccagcagcagccgcttcttgtcgaccttgcagcttcatgaggttgaagcgggagaccttggtgccgtccggggcgctgaggacgcggcgggacatggccgccgccgccgggccgagctagttgaaggaggagagatggcggaaattggggaggaaagatgcaagttgctcagctgctgctgctgctgctgggagagagagagagagagagagagagagagatagagcggcatgtggtgcgggaatggcggaggaaacaatcggcgacggccggcgaggaggtggccgccgactcgccgaggccggccggagttccgccacaaagttggcttttttttttccagagggtgacatgatttatatcagtaacacgtgatttgttatcaataatattgtttctcaataacttaaccgtgctcccctcatttcaaaaaactccataaacttggacttaaatctttatataatttaagcacttataggacattgatggtaatacacgatattttatgtaaaggacacgaattaagatttacctgaaaacttactctatcgctacacaagtcttatttgaattacgcgcaaaattatcctgaggctgatttaaccatcgttatatctgcggtcttaccgggactagcaaccggtctaaccgctggttcacctgtggtctaaccgccacctggtctgaccgactagacagtgtcggtctgacctcactactcgaaccaaaatccgattttagccaccgtcatttcacaaaagcaatttccctttcctttttctgtttatgggtaaattaaaataaaaaccaaccaaatgtccatcttttcaaaaaaaaaaaaagagcaagaataaatctcacaagtttatgaaaatagatggttttacaaccaaagactgtttcttgaaccattgaagaaacagaaagcaaaatcccagcagttttaaaaatcgttttctttggttcaggttttgtcaaagttttaccttttttttagttattttcaaaacaggaagttggtgatctgtaaaacaggcagtagtatcaaaacttacaccctgattgtaagtgctcattttttattaatccaaaatcgcgttaagtttctttttaccataaaaaaaaatctttccaaagaacttttcagataagaaactttttttctcaaatttgtaaaattcaactaaaacacctttgttcttgtgacacctagaacaagaaagcacatcatcagatttcacaatattctccatatgcttaacacgatctaaagcatctttcaattcatctcattcaaaaaaacactttgagcaattttagaaacaaaaacatcctgtgttgttaaccctttttgcactcaaacattacaaagatcttgcaaaaaacaactttgtattttttttcccaaacgtttttcatcaaaatcaactcatcacaacacgaatatgcaaagcaaatccaagagcaaaagaaaactccaagtttttaaatttt

SEQ ID NO: 60580 - DNA, 31054 bp, Oryza sativa
agtcgtcgtcgtcgtcgctgtcgtccggcgactactcctccggggctaggatcctcgacaagctcctgtcacaggcctggctgcgggagcagcacgagctcatcaggcagctcgtcgggtcgtccaccgacctgatggacaagctgctgcagacgctccggtgcacggggacccgcgaccgcggcgttcgggagcacgccgcgaggatcgtggcgcacctcgccggcgagatcacgctcgccaggttcccgcaagggatccggtgcatatactcgctgctcaccaccccgagaaaccagcagcaagacgacgacaacgacgacgacgacgacgacagcgcccagtcctccgatcactacaagaagctcatggtgcagggcctcgtcatcctccacaagctagccgccgcggagcacaaccggcggatcatcatcaacagcacccagggacggcagctgctctccatggccatggcgcccgtcagcgccgacctgctccaccgcatcgaccacgaagcgtggaacgacatcgtcgcctgctcgctgcagctcatgtgccggctcgtcaccgcccccggcgagaccggcgacaagctgcgttcccaggtgctgaacgacaaggacgccatcggcaccatggagaggatcctcaactgcgacggatgcaacgagaagaggctctatattctcgccattaacatcctcacgcagcttcccatggcggcgaagaacaaggtggtggacgaggcttcgagcatgagcgtcgagagcagaaggaaattcaccaagctacttctactcatctataccgacgaagagaaggacgcctttatgagacaaatggcaggtgaagcattggcaatgctgtccgaacgaagcaagagcgacgccacaatcatcttgaaagcaagtgacagcactctcaaggacctcaccgcaatgctcttggatgtaaatagcaacagaggatacagaatatgtgcagctgaaatcctggagcatctgtacattcgatacaccaagcaagatggctatctcaacaatctgacggaagccatgaaagatgtgttgccaaaggtgatcaatatcgaataaatgaatatattatttagtttgtttcatgttgattaactaataagagcaatgtctgtaacaatatatatatatatatatatatatatatatatatatatatatatatatcttgctgttcgtttcaggtgctcggagaaatttttcttgtgtcatggacgcataaagaaaagcaaccaggaatgacagaacaaggaacagagggagttaatttctcggcacaaaaagctgacattgaaagtcaagatcccgttgcttgtcaacatgaaaaggttaaagaggaaaacgaaaaggttaaagaggaaaatgaaaaagttaaagagcaagatgaaaaggttaaagagcaaactgtggatatgaaactttatgcagctttactgtcacttagtgaggcaatatttcaaagattggtcaatgatgataaagatttggctgaactgactgataaaattgccccaggaggaggcactgcatttagcttcgccggaaagctcaaggagatggtagaaggaaacagtgaacaagcaacagccaattgcctgagaatgctgaagattactaccaggatgatcatatcattgataaatctcaatggagccaaagtcggagcagacctggagagcttgatgcattctctgttaaaagcttcagaaaagatgttggaactggagggcttcatgattttctctagcagcgatcgtaccgaaagcacgaatcctgccaacattctcgcttccctcgtgaaagaagcacaggagcttctggagaagaagaggcaggcacaaactacacccgctccatcaatggagaccagctgattgagtaaacagactatcaacacgatcgtatgctgatctgcagactgttggcagtaatacctggaaactgacaccgtacaatccctgaaaactgtctctgtaatctgtatgtgtgctgaaacttatctatcttgtcaattgtcccatctatttcaaaaactttcaagttgaactttacaacaaactgttgagctttattggcagttcgtataatatcctcttggaacagtagataaaacctatctgaagaggtgaagaggccaaggatctgcatcaacctactgcacattcagtacttgctcacctatgttaggggtgaaacaactattacataattcgggtattttgtatgcattttaaaacaagttggataatcagagacaccaattctgatgtactcgtctaataaatttatccaggacttcggacggaactcagcccatctgaagtattcagttagtttgttaggctttgttagatagggttgttagtcaattagaatcaatcaatcaagaaagttaaatctatatctagtcctcccttctatgtccatcctcattcaagctctgggacagggaggctgcaggcctcgcccttcgccctcccgtcgagcaccccaattcaatctacgcacacaatatcttggtatcagattcaagcgatcctttcctagctttcaccgtggctgccatcatgacgacctccatggccttcgtcattcatccatggccatgcagaacgccatcacagagatcaaggatgggctcgacaaagtgacaaaatcggtattggccctccgcgcggggtttgaggcaaagaaggtgcggggagaaacaacgacgatgacgacgacgccgtctctgtcggccacgtggtcggaggtggaattgctgcaagccactcgctgatgtggcgccactttctcagccgttgtccttatccaaggctgtggtagtggtgccatgcctcgtcatagtccagtctattattcaacccctgtgctacatccgtagtctagagaggttgtgtaatatctataaaagtgaagatacaagatataggatgggactctcttctcattcttcattctatcatcctcaagcacaagtccaacaatgagcagcccccctcctctttatgtagctataatgcacatatggacggtttagatgtgggcccaattagtgtatatatagaaggtttccatgttgcatatatggaaggtttcttgacactcctcccttgggtactcaccgtgtgatgtctatgcctcatcaaaactccagaaaacccagtgggaaaaaattgaagaaagagtacatagcgtacgcttgcaatgtcgcacggattgcctctttaaaaacctggataagaaacttttgggaaaacttatctaaggaaaaaagagtacaatgcacccaattctttgttcaatcattctagattgattttgggtacttgatttctatatcaagattctgtaatgagtcggcgaaattctccccctaaattttgcatttctctaagtctcattattccgatttcttggacacacctattcaaaagatgtcaataatgagttagtggacaaatctgcaggacttatgcattacttagttcgttgcttctatgcaattgatgcacatagaagagcttggggttcatgtgcttagtgagtttgctcctcaagtaactcatttgcatatatgcgacatatactgctttagtttcataaatggtggggggttgagatagttttcaaactgcgattgctgttgcaggtaaccatctctcaaaaccatacctagactttgaataattcaacgatgcttagttcggtttagttcaactggccaagtattcttgtgctgctacgacacactcgtgtttgggaattttgtcccaatttggcggtaattaattattctaaagccatgcaccatgaacatttctatatgtggttggactgatgtactagacttccatctgtcgtatgcctttagctgcaagcgtaagtatgatttggatttggccaaatatttcaaattaaacataaattcaaaacgaacgagtttgtttcttcaattattttctagtttattctattctttatgtgttggttcgggacctagtacttcttcatgtactattatgcaagtgttcgatccaagctcctgaaatgcattcattaattctatcgtcaatgcttaccaacattcaggttgatttcttcttttcaacttctagttcattaattccattcaaatcctggttgactgctaatgagttttgttgtctaaaagagacattacccataataggtctcattgccaacttctactggttgcatgaggctctatgcgagtatccatggacatacaaggagatgattttcatatgcttcttcttcttcttcttattgcttaatgcctcttgatgtgggcatgtaccaatgttagtgtgcactccagcagttggttttcttccttgatgggaaggtgcggtacacctattttgaggtttcgtgccgtttgctagatctcaactagccccccttctattcgatggggtactttttgtgactttgagtatgatagtccctcttgccctgttttcaccagacgtctccagttactttaggggcatgaggagccggagtttcttgtccaattgtttcttttgttcgaggcctctagacatgatgagggatacctttgctttcttcggtatttcaccctcctccggtgcattaattcatgcaacttagtcaaactcttcgaaatcataaaagtatttacaaagtgattttggcagtttcaattctttctgcatactacattcactactagtgcggtgtaacatgtattagtccctttctactatcatatttgctgacatatcctatttaggggttcattctctccaagcctcgaacaaggatactttgctgactgaatttcagtacattgacttcaagcctctcgtgacattgatggtacaaggtttaccatatcattgatttcttgcttgctcaacggccctcatgtcacatttttgaaggggcatttctattcagcacttatgtacctgctacttcccaactacagcagcatattttggttcaaaaaacagaacaaaaagttgagcccagtgagtacagctacacatagaagaacaaatttttgtgtaataatacattggaagatggcctatatcatgatagtcaataaaacatgcatgtatttgttctgaattcacaattaaaacaaattggattggatgaatttctaatgttctgttaccttctcaagcatataagcttactacagaagccttaaaagccatgttttaggtggggctttcctttgctgtgggaaagaatgtgcaacctctttgtacaaactgtagttaatgctggccaataaaaatagatgggggtagagtgctggcttatgctacttgtagcttttcatttttctcatgcatgattttcatggacgactatccattttgtattgtttttccgttgttgcattcgaccttaggtataggaggcatccaggagtccctcatctatacagcagtatattaaaaagttccatggaaatttaaaagcaggaacttgcacttcttcagtatgcaatcatgatttccactaatttagttgtctattcagatttcagaagatgacagatggatctactgcctggttggaggattaaaccatctttgctatcctaatcgatgttaaagagagcttcttcaatcctataaactcataatctctcgctaaggcatgtgaagttgtaacaagaccaatggacgacgattagcccaagcagaagtgtcccacccttttcttccgcctttctctactgcaaaaatagattgaaagatgctagaaaagaagcgttcttggtaatacaggaacatgaggaaaataaatagactataagctgctttgacatgggtgagtacacctgttatttttatgcaggtcctattttttttatcaaataaactttgcctcatattcatatcattaacggtttggaccatcatcaaaatgcatgtaattggacagttttactctatgtggtgctaatatgagctatcacagttattttatgccaaagtattgcacaatgaacaagttaatggttaaatacgataaggaaaaataatttcggctatgagaacatgttccagcaacaaaataattatgaagagtctatgacccaagcttgggaatatgttattgctgaaacaaatatgatatcttgtttggtcaaatcattacaaggttccctcccttcctctattatcttaacctccagcctaaccggtccctctctttctattccaccgttgggcccagcagtcatccaggtgagctggtgtcttgaggccctctcacccatgctgctgcttaggtatgagccgaaccagttgtgccacgtccaaccatttaatgcgttgtgcctgcctatcttctccctccagctacaaaaccattacttttcagttcattacatgaataagcaaaaaaagaacattattagagttgtcgaattagacttatgactgaattgaaggttgattaagcctgaagactaaaacaaaccattttaagagtaaaccttcaacaacaacaacatttatgttagcatacttagaacaggataaatattatgtgccttccatcacatttcaaatatctatatataaactaataatataaagatacaattctattattgacaatggttttgacttttgataatgcccttctgataggatatgtgtaatttttccaaatttactaatttaaacaaataaagaaattgtatacaaaataacctcatgccagtaaagagacccatgctgggctcccatatggcaaccaagcaattaaggcaaatcgattacactttcaatatttgagcttctacacatgaggcatcagaatgtctggtatcatgcttcagattcctcgtgctagttctttccaccgaactagagatttctcatgccaattcacaattgaattcccatctggttgtctgttcaggcagttaacaagacattccccacttttatgctacaacaagggcctcatcctatatacctatacaaatcatcctcactaatatgaatttgctgccatgaggtgcagccacgtcacttaaattgtttcagccgttagatgagcatctatcaacaatagcaaccgtcagatcaaaagatcaaaagctcagatagcatactggtacatgtccatttatttggcccatcccaaccgccgcttccattacggcccattgcatttgcaccagccgcctctcccaaaattttctccgatcaccacagccatcgcttcgcctccgtcttccgctctggcgccctcccatctcctcccaaccctagcgcgcgcgttcagagttccacaccgcgcacacgccgccacctgcatttctctcgtgtcgtctgcgctccgctcgcaccacctagcaatccccgatcccctgcggcgcatccaagggaaacgccccgcgtctcatccctttcccctccccggcgacaggcaggggaatcgacggccaccgcctcagtccgcttcgtctttgggtcttccctgcctaccgccgacaaccaccaacgagcagcttttcatgttttccatgaaaacaattacttcctgtagctgtagcgtaacagccaaatcaccgttgcccttcattgaaatatgaatattagtcgatggtaacgcccgtctacaaaagttgattgccttgcatttttcatagtcacacgccggaatcagcagtctcttttccgttgcattggcgacctgcagcaaggtgccatttttgttccacccatcctccttccttgctatacactttcttatttgtttgtctccttcacctgtccttcctgcagaattgcctcttgctttctctaaactttccttcacaatgtgctgtacgcctttacatgtgcaattttcttaacattttctctcttttttctgtgtatgtacattctgattcggctacctatcggggttgtgggggaggtaaaggtaaatcctgatgcccaattttactgcaggtgagagaatcataccaattaaaggtattttgctgttctggagcaatcgatcaagtaattcgttacttttaggggtgtcaaccttatgtatgtatgatttgcaaagctgtccatcattgttttattatatatactcatatagctagagattttgtaggcgaatttcttatgtctttgatacttgacatattttgtaacgtgaaccttccatcgccacaaactactatgtgcacggttgttttttcctggtaaaacactaaaacatgaatggtctcagctcatcaccagacaattggatggaaggaataaaccgaatccggtctcttcctcttcaagcttacattggtggaaatattgaagggcttcatcttacatgatctcactggtacgtaaacttgagttcagcatataaatatagtagtatgtgttttctcaatgtttacaaccactgcatagcacagcaccatttggtttcatgaagctcactcactgtatcgattagcatctggttatccaagaacaattcaagttattatggctttacctagccatgtgttgtctacacatttttttgtttaatctatgattacaatcaactgcacaattttcctttttttcccttcctgcacatgtcgtttagtctgtaaacaatagaaatcccctgtcaacttataggtgagtctgttagattgctatgtcgcatattatatccccatcaacatatatgattatgtcagttcattggcttctctttttttctttaaaaaaaagctatttcataatcctacaatatgctattccacaatgttccgcagcaacgcgcagggtaccatctagtttactaggaaaatagtccctattttgtttctttggatacacagtgtgtacttatcttgctatcgaactacttgctctctctaaaccttaatttgtaaactaaggcctctgagtgttttcagtcatatgcctatgttgaaaacaaatagttggcttaagcgtgcacatttgaaaattggttttcataggcgagccacgagcagcttaagccactttcttgtgaaaataaaattttaataaataacacatatctatacataacttttccatataaaattggatgaagattaactttataataaaattttagatcttgacgagacctacaactttgtagttgataaccttttcatttgagaatttgttagaggccgaaacattcattacaagatctcatatatatttttataaaatatcatatatatctttcaaacatcaaagttatagggctcgatcagatctacaactttggtactaatgacctttttatttaagatcatttagaggaccaaataagcgtttcaagtcttgtagatgtaatgttttagaaaatagtgtgatggtaagaatagatgtgtgtggactatgggtcttgagttcgagtccttaacaccacacatgtgcgtacatagagaaataaagaaaatgatgtggcttgtgacttggtgtataaatgtgtatagacgcctactcaaattcaaaatgtgtatagaaattatcatagttgggcagtccagctatgataatctctagttccatagacaccaagaggggggcgggtcactcaaccacttatcaaaatgggttttgaccatctgcaaagatcgatcatttatgtagcactggctttcactcattttttaagcatgggcaagggaggcatctggaaattggttttcatggctgctatgaaggagacttgagagttgaatctcctgttcagcaattgcgctcatcatcgatcacctccaactgcgatgaagtcattcccattaaagcggaagcgcccagcatgtgtcgctctctttgatcatgaaatccaccaataccagttaggtgatctttctcttgctttattccttcatcttgccttccatgtcatccaaggattttgtttcaagagttgtgcgtgagaggagcacataccactattactatgtgggaactatatacaaatgttaacttagacgaactttggaaggatactaacacagcacaagagcaattagctgatttttggaaaaggttagctatggagctttaaactggtatggatggaaaatttccatttggcattgtgcagcttgaacacatttcaattatgttatataggtttgatgcatcttaattttttagtcccctccagaaactttgcattaaaattgtgcatattttcatttcaatatcagagaccaagagttgattcttccactatggtctcactttttatatgacagaaccaccataactactagaaccgtcaaaccaaaaccatatataccacgaattttaatttgcacttggcttcttgatgtactacactactgaaaaagaatgttttcacaggtggccaaaatggctctatatatgcaggtggccacaggttctgcctgcaactaaaagtctgcgaagatagattgatatagttgtgatatgggcctcgtttctagtagtgcaacatgcacatgggctcgtttttattgtgcctgtaattatgtaaggcaagtgaaaaattgaattcacataacaataatgttggcaaagaagaggttcatcttgcttcgctacagatataaaaaaggagtgtgttgtagacccaataaaacaatagtacaatgctagctgacatgaaggtttttccccaagcaactttttttacatgccctcgctccattttgaaattatcagaaaaccgatgtttgagtactggattggatggcctcggggacatcagtttctatttcagatacaggcatacagctacagtttttgtgatagctgagtgcacacaaacctcaccgagtcgacaccgcacactgacatcaacctgagaagaacaaacaatcgttgatgccactgtgatcttaagtgtgggttgtggtggtgactctacgcgagcatcatctctgaatctctgtacacacaaacatttgcttgtgaaatgcttacccttgcacctgatattacaacggccaccaacgacaggaaaatgttttaccgacagacaacaacctactgcaagatgtgatggtgtaacaatatggcctagccgtattgttttgctccatgggaaaaaatgtactacagcctttctttgaaccaacacgacacaagtgatcaagcattgggccgggttcacctgatatcactcacggcgtaacatgagtaatgtgttaatccaacttggcctagtgacaaatcgatcctgggcagtagtttctggtgtgactgtcactactacaaaaatcgtttttctgtacaagggggtcggtaggttccatggccgcttgtggcggcgcctgcaaaaaccgcccccccgggggcgggttgattagccacatgcgaagatccattatcgcatgcggctgcttaagacagccgcatgcgataataggtctattttcgcatgcggctggcttaagggaccgcatgcgatgatcggccatatatgctcctccaggcctgagcttgaccatttgaaaacgaagctttctctctcctaaagcaagcaccaattagggggggaggttttcaactcgaaatttttacttgaactctatacgaaaggtgaagaactctctatcctgcttcatttggctccatttttgttatatttcgttggtggaaagtggagtttttttaatattttgacaaggtttgttctaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgtggagaacgcagccgatatttattaaggaagtatctaaatttattgatcaggctaaggcgcatgctttgagggagaatatgacaaagatcttttgtccgtgccgtcattgcaagaatcagaaattgttggtagatcctggtgaaatattgggtcacataatggagtacggattcaccaccaactacaaggtttggacctatcacggggaattcgccaatccggaagatgacgatgaagagttaagtttcgagatgaatgaggcagagaattttataatcgaagacatgtcgcgtgaaagaatggttgtcgatgtttccaccgatagtgatgatttcgatggtggttttgatttagaggatatgctacgccatgttgaaccagatgtgctagcgggcaggtcacgaggattggagaattggcaggcattagagaaggcatcgaaggatcgtcttttcgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatgaagcgaagaaactcatatgtcctttatctcttggtgtagaaaagattcatgcttgtaagaatcactgcatattataccgtaaagaatatgcggaattgaaatgttgcccaacgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgtaaacttttcattatctgggcagattaaagggaagactggatgtctgatatgtctggaaaaaacttcatacaaatacctgacgtcgtctttgaagacagtgtacatgcgacatcgacggttcctaccacaaagacataggtaccgtaagatggctagattgttcgataatacagtggagaatgacaatgccccagtagcaagaggtggtacatacatgtatgagataacaaagaagattaaggttgtatatggaaaaggaaagaagaagacagtaaagaggaagaaagctgatggtgacaacggtactgcgtcgcctttcaagaagcactcaattttcttcaaatacttagattactggaagaacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcataaccttcacccagtagtgctgccaaatgggaagaccgagattcctcctgcttgttactcgttgacacttgaagagaaaaaagccttctgtaaatgtttacaaggggttagagtgcctactggtttcgcatcgaacatcaggaagctagtatcaatgaaggatttgtccatttcgggatacaatgcgcatgactgtcataggttgctaacggtgttcctaccaattgctataagggcagtcaaaccagtccatacaaaggtggttataacaaagttgtgctactttttcaatcgaatttcgcagaaggtatttgatcctttggaattaggtccgcttcagacatttgccgtcgagactgtatgccagcttgagatgtatttcccaccatcatttttagatatgatggagcatttgatcattcacatcgtccctcagattattgaacttggtccattatacttacatcagatgtgggcctatgagcgttacatgtcgatcctcaaaggctatgtacgcaatcgcactcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcaataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctatggttgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcaccgcacaaaacagtgggatccgtgtcgaagcgattgacacgagtggagaaaagaggtcgtattatgggaccattcaagaaatatgggaactggactatggcctaaacatccagatccctgtgctctattgtgaatgggttaaagacacaataggggtttccgttgatgactacgggctaacgatagtcgatcacagtaaaacaggccacaaggatgatccatgggttttagcagagcgtgtggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatatcgtacgttcgagcagatggtgttgccaaggttattaagtcatagttatttcgtaacctttagttctcattgtattccaaatgtacgtgcatgaatttaggtcccccttatgtagtaatcattagcatgtaacatttgattacgagttttgagcaattttcatgagttttcttagtgccaaaaacatttggaatgtataattgtggcgaaatattgggaaaaaaatatatatggacagtttacttagagaaaaaaaaatatgagtttttttggtaaaaagatctttctatgcggacgacttaagccagccggatggaaagatctttttcccatgcggccggctttatggcccgcacggaaagatctttttcgcatgcggctggcttaacagcccgcatggaaatatctttttcgcatgcggccggcttaacagcccgcatggaaagatctttttcgcatgcggccggcttatgtcgaccgcatggaaagatatttttttcatgcggtcccttaagccgcccgcatgcgatgatctgcgcctatatatagggagagcggggagccaaaattttctaagtcccggctcccgcgaaaccctagccgccaggctgccaaaatttcccaagtcgccgtcgccgtcgtccccgccaccgccggctcctccccaaagtcgccctgccccacgccgtcgccgccgccgccgtcaggacctctccccctcgccgttgccgtcgccgccgccaggacctctcccccctcgccgtcgccgtcgccgtcgccgccgccaggtcaccgtcgccaccgcacgaaacgctcccccctcgccgttgccatcgccgccgccaggtcgtccccgccgccaagtcgtccccgctaccgccggctcctccccgaagtcgccccgcccctcgccgtcgccgaggccactgccaggacctctcccccctcgccgtcgccgtcgccgccgctaggtcgccgtcgccgccgcacggacctctcccccctcgccgttgccatcgccgccgccaggtcgtccccgccgccaggtcgtccccgctgtcgctcggtaacatttacttttaaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgtttaaattgggacttatgttaaattgggatttatgtataattgggacttttgttaaattgagatttatgtataattgggacttttgttaaattggcacctatgttaaattgtgacttatgtttaaattgagacttatgttatattgggatttatgtataattgtgatttttgttaaactgagatttatgtataattgggacttttgttaaattgggacctatgtcaaatggagatttctgtttaattgtgactgatgctaaattgggacctatgttaaattgggacttatgtgaaattaagttattgggacttatgtgaaaataagttaaattgtgacctatgttaaattgagatttatgtataattgggacttatgttaaattgagatttatgtataattgggacttatgttaaattaggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagtgcctcaagaaggtaacgctcctcaaaattccggtagcaataagcagccagacgcttctagtgaagaaacgtggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattctgtgcagatggtagtccgacgccgctcgaaacgtggaagtccgatctaaatcgggattatgttcagaagaatctcccaccgtttacggattatggacatatatcgcaggctgactgggacacgtttgttgcggatcatacaacagctgaagcattggctttgaggaaaaaaatgtccgagctcgcgaagaagaacaaatatccccatagattggggtcgagcggatacgctggtcacgtcgatcaatggcaggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagcgagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcctttccaaggttattccctgatagccagtaacccacacaatccgcacagcaaacaactaatgtacccagcagtgtaggctcagtgcagacaactaccttccctgtggatagtataactggaccaactccgtgcagtctcgtcgtaccaatcggccgtgctggaaagactaagaaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcctgcagcaggatcttcaaccccatcttcatcgcaggcaatgactgctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccggccccgcaaccagttcaagcctctcccacctccctagctaaacagcatgctcccccggctccgccctcagttcaaacctctccacctacgccccaatctgctctggtagaacaagtgcacataccagatggtactacatccgaaccaaagtctaatactttggaactgagtcgtataattccaaagttgatatcgacatacgacccaaaggagattgacaaggataaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagaccattacgccctctacaagctagataaaatggacgttaatctcgttgcggctttctgtctgtaagtctgaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagagaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctcgaataagcctatcttatatgtagagaccactacatattattccttgtatatccgaaagaccaattgatcatatcattggaccccgcacactatgacaaggagacatttatggaatttctcactattttgaatttgtaagtgataaacatttcattactataaattgtttaggtcgatcaccggtcttctaactactaataaaacaattgtttccttcaaacagagcacacaagtactaccgcaaaagaggtggaccagtacatattccatcccagaagaagttatctgtcaggactggctggccggtactatcaaatttataccaatacaactaattatcgaacagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccattttattttcctttctgtgtgcagatccccgaaatcccatatattgcacaacgattcaacgacactactatcttgaacgtggccgctgacctctgccgattcatccgtcgcgatgtctacaacgcaagaggtctcttctacgacaaccagagtgaactcgcaatggacgacaaatttaaacctctcagagagtgggagaaagaacatatgcaataacatgtacactacttatacatatgcaataacatgaaaaaactgtgccacttgctattatatatttgtatgtaaattacgattgaattaatggttatgtattacatgtttgttactgcggcacttgtcttatcttatatgcttactactccgaaatacgataataaatccctcaataatttaatattaattacgaatcaccaaaatgctagaataaatattattttagctattcggaaattgaatttcgcatgcggtctacttaagacgcccgcatgcgaaaatagaacttcgcatgcggtcttcttaggtcgaccgcatgggaaaatatatcttcgcatgcggcttcttatatggaccgcatgcgaagatctattttcgcatgcggccgtcttaagggaccgcatgcgaagatcgatcttcgcatgcggctgcgacggccgcatgcgcaaatggtgatctttgcagaccatttcgcgcatgcgggctggccaaccgcatgtgaagatcgattccgcccgtatgcaaaaacgctttctgtagtagtgtgttaatttcaccacgaacaagcaataagtccagtgcaatatctttgagtggagttcccagaatatttgtcccatgtgtccccgtggtacggtaggggtggttgataattttggaagattattgggaatagaaagttcattttttaggcaaataattaaatgtgcaacacatatggttctatgacaaataattaaatagaatattgtcacagctctaactccagctccacttctcctggatctgaagctcaaccaaacagtttcagctccacctaaaataagagtgaagctgggtggagctctctcacgaaatgatctagagaggtggagctggatttaggcagctccacaattccactccagacccaactcctttagctaaatttaggagttggaccctactaaacaggccctgcataagaaatccttatctctccaataggtttgagtttaactattctactagcagtttcatcctcatggtctataaaaaacactcgctagattaaaacttggataaatattaataagagaagggcaggtctatagctagaaacaagggtttttatgggtggtggaagtagtaaaaagcatggtggacgttttctgacgagttaagatagcgagttattaactactccctccatctaaaaaaaagttagcttctaactataaatttgaattttgttgaggttcataaccataaattcttttttttaatggagagagtacttaatttgaagcatcaagtataaaatacaagtacatgaagacgtcatgtcacacttaaatccggtaccaaaatttgtttcagagaggtataaagcattgcatttcttgttgagtcatccaatgaagttgaacgattagcaatgtagtactataaatcgagacatgcatgtccagattgatattcatatcatcagaaagtgttccctccggttctatgttgctgtattatgggatggaaagagtaatttcgttagtttgcacatacataatattataggaagtagaggcatcatgagtgaaatgtgttcaaaacatgtacgtttcttctcccaatttcgatccaagggcacttcatgttcatgaagtttgatcccctcgaaaaaaaaatgttcatgaagtttgtgggaattctgcggcatcctgtcacaccgagttgggtacagaaattatgtggatttccaatgattatcctaaacttgtacacgtggatcatgcataggttccgacttccgagccgagacgaggagatcagtcataatcaggaattaggcagaatttatgctccaaaggaaacaacagccaactattacatatttttggcttaaaccctaaaaaagtagctaccataaagtgaaacagaatataagtaatcactccacaagcaaaagaagtgatacatcttattcatacaaaaatgctattagaaaatctccattgaaagttggcaaaaatttgtttgtataaccgtaatctctacagtacaacaagcaagatcaatggattcttcctcctcattacacctttgtaggtttgctcaaaaccgaagccaatatgttgctatgaagagtatatgcatataagatttagttatagttttgatattgagtctatgccaacaagccaattaccaaacatatgggcaaaattatgagaaaattttaaaccaaaggatacaagaactgttctccaaagaaatttagcaatataacaatcaaagaatacatgttggatattctcatcatgcataaaaaacaatattttgtattaccatttcaattcatttttgctaaattttccagggttaaaaccacccctttatgcaagtagtacataaaggtcttaattttaattttacgagacatcttcaatctttataaaacttgtttactctctgcgtaaccattagcaattagagctacatagagtgaacataaaacaatccattctggtgaaaattccatataaacatatccttatcaccattaagttgaatatgcacaattttcgcaaccacattattccaattttcaaaatttgtcccactaaattccttctaaagtaaacattaagtgaaactgtactcataacagttataattgatgcattttttctacaaacaatgttgtatagagatggaagtgtttcttaaaggaggaattctcattgcatccatcttcccataatctaatttgttttccactgtttactatgaaaaatccaaggctcaaaatttatctttatctttcattaagcccgacaaaaaagggagtcacccggttatctgactacctcagtgatcgtttgattcttaaatatttttttctccttagtaaatcttgcaaaacaccatcctcattaatcaacttaaataaccatttacttagtagatattgattttgcacatctatcttaagaattcctagtccaccctgtccttttatttgacaaataatattccatctcattggtatattctttttcttatattcatcgctttgtcaaaataatctaataaacaattttttgaagtactcttcttggaatctaaaaaacgacatcgtagatatatgtaccaatgaatgatttttttttgctggtaccgcaagcagctagcaggttgaaacttcataccggtaaagaatgttgctcaataatgctatgatctgcattgttattcatcaagaagcagagtaatttatgaatgctcaatttctaccgttggatttttctttttttttaaaaaaaatgaatagtttatggtgatccgttctgtttcgcatcgatcttattcttcaaaaaggaaaaatgaaatgcacagataatgcctttttaacatagacaagtacactcacactcactggtggagaaactatctttagtcggtcgaccaaattccacaatagtcccggtttcattaaaaaccgggattaaaaacgacttttagttccggttaaaaaaattttgatctttagtcccggttaaaagatgttttttagtcccggttcatcctctgtcagaggcatgtcagggggccgaggatctttactcccggttgatactaccaaccgaactaaagatctaaatgatctaccaaccgggactaaagtggtaatctttactcctggttggtagtatcaaccgggactaaaattcaacatagtatataatccctattccttatcctctcctccacaatcacaaccacttcctcacctacggatcgatcctcctctcttctcccccttcccctctcctccccttcctccttccttccccctcccttcctcctccctcccctggagacggatgaggctgctcctccttccttccccttcctcctccctcccctggagatggatgaggccgctgatgaggccacgccgcgcggacacggtggacgaacggacgtgccgcgtctgcgcaggcgtgcggcgcagacgaccgtctctttttttttttgatattttgtgattcacttagatgtaattttgtgattcattgtatggatttgagatgtataatctgtgatgtatttgatttgtgcgtaatttttttaggatttgtgatgttttagatttgtgtgtataagtaactttaagatttgtgatgtggatttgggatttgtgatgtggatttgagatgttactttatttgggatttgtggtttgatttgggatgtgcatgccatctgattcggaaaaaaataaaaaagtaacaaaaaaaaaggaccatccgggattgtccctatcctctctttagtcctggttggtaacaccaaccgggactaaagatccctctctttagtcccggttggtgttatcaactgggactaaagatagatctttactcccggttatttcgcccgggactaaagatagctatctttagtcctagattcgtagtcccggttaggaaaccgggactataggggggttataaaccgggagtaaagatagtttctccaccagtgactcattgtttccatcgtatggtcagggtatagtgctcattttggaagattatttggaatagattgcgttttaaggcaaataattcaatgtgcaatgcatatgcttatatgagaaagaaataactgggatattattagaaattactgcatataagaaatccttatcccttgaataggtttgagtttaacttaattgtactagtagtttcatgctcacggtctacacaaaataaaaagaactcactaaccgtcggggccagggttacacgccccgacggtaagcacggtaaccatggtaaccgtggcaaactgtacgaaaccatgtaaaatttatcaaattttcaaattatcttttaaatttatttgaatttaaggaggttgccgtggttttccttttaccgtaccccgtcgtaagcacggtaaccgcacggttgctgacggttttgcaaaccctgctcactagtggtgaaacctcaaatagatattacaaagggagagaactcactagtgataaaacctcgaataaatattgaaatgggaggagcaggtgcatagctagaattagaaataaggcattttaagggatggagagagtagtaaataagcatggtgacatcccttctttctataaagttacgactcaaagctaaaacctcagcgtgccacgtcatcactaattctcagtcgttcaatcggtggatgagatcgcgtataaaccattggatgagaaggtccctagtgagatgtcgagttatcctgatgagcatagccaaatcattgcaaaaagcccaactgatgagcaaggcccatcccattgccctgccccaactgttcgctctccttccccgcttgccgtccttcctcacgcagcaagccagcaccataatctcacccccccccctatgcctcttctgcttccgtcgcacctgttttgctcatcttccctgggtgcttagaaaaacggaaaccctgggcgccaaactctcacccttcacctccctggtgagtaatggccacttatttggtatttcattgcaataatctttctttttaaatagtgtaactgatgataagccaaacttcctggatttatacgcctatgaccatgtaatcactactcagaaataagcagtaccctccctctcctccattgcggcagcaattctttcctcttttccaggtcccatttcccctttctctctcgcatgtgttgctttgttaccttatactggagacaaccaagaagtatttcattgattttaagagtacgtgagtggcgagctacatttttgcacattgcattcattttggcaagcaacaaagcaagcaagcatgtggttgctgttcgtctgttgatttatttattgagtattttccctttctacctctggcaatgttttatttgttgctaccatgtcttataacagaagccttcttacggtgttcaatgatgctcatacagccattattttattcccaattcttaataactgtacaatttggatatttttctatgatataaaattttgctttctagcaaaatggattgtttatgtcacagtttattttgtccatatttctgtattgcgcatcaaaagaatacaagatactgtgatgtgtgtatacctatcttcccttttttttctcttccatggttatagttcattgaattgcaaaacgtttgaagtttttttgattgaatcctttgaaatcccacagcaatgcacagggtatcatctagttatcacacaagttaaagacacagagatttattacactactcctgcttactttggagcatcaagtactccctccgtcccattttaagcgtagccatcgagtactccctcggtcttatttgaatttttttttaaaaaaaaagctaaaaaaaacagaagttatacataaatactattcatattttataatctaacaacaacaaaaattttaatcataaaatttaaaataagctgaacaatcaaagttggacacgaatacttatgactgcgtttaaaatgggacggatggagtatcaaatactagtaggtcaagacgtcaagtcacttaaatcggtagaggtaccaaaagtttcagataagtataaaacattacactacatgttaagtcgagaccatgaaatgaagttgaatggtaccaccattaccacatagaaattcacatatccagttggtccatatatataataggattgagaggcatcaggataacacattacaatgaaatgtgttcgatatgtgcgtttcttcctcatgtttgtttgaataaaatgctgtggcgagctgctgcttccagtatgggtagaaatgatgtacgggtatgtagaaatgatgtgaagcccatgaatttggagccaagaataggatgaatagtcacgtattccctccgtccaaaaaaagacaaaccctgggtttctgtgccaacatttgactgtccgttttatatgaaatttttttataattagtattttcattattgttagatgataaaacatgattaatactttatatgtgacttatctttttaatttttttcataattttttcaaataagacagacggtcaaaacgttggacatgaaaaccagggtttgtctttttttttaggacggagggagtaggaattaggcacaatgctccaaaggaatcaaccgtgaattcagttggcactagtatctactactaatgaatgattttcttttctcgctgggcctggagttatatgctggtagtcaatattgttcaacaatttacaattctgtgatctttttttatcaacaagcttagtaatttattaatgctcaattctcattgccatattttttaaaatgaagaatagtttatgacgcccagttttatatttttcatctttttcttcatagaagaaaataaaatgtatggataatggcttgttttgatcctacaatataatactcattgatgacatctcatctaagttttgtgcttctatacaatatagtctgattgtacaaattaaaattgatttttatgaagcaaaatgcagcaaaataatcaagcgccagcccattaaacgatgcccgtttgccgagctgatatatacttggaccataacaaaacttaaatactcgcaattgtacttctgatggtactccaatgatacttaatgatactagccatgtaataggctaaaacttttagtaaacttttaacaaattctaagagtttggctaaattataaaagactttaagtggacgtgtttgagcaaagttaggcagaaagggccagcggattatgactcattacttagatgatagcacaatatacttatatgtagaacaacaatccttgtgatactcagttcagtttaatggggacgggaggggatccagaaaaaataatttcatacctatggaataaatttctttcaatccctttcacctggagattagctgaaaatattatggaaccctgtacatcactacagggtgtgtggcggtatgtaactacaattaggcagtatgtagttacttgatgtcttatatggctactaaaacattctgtattgcaagatatatcacaccccaaatgatatagtaggacatactcccttcgtcccaccaaaaatcgatttctagtggagagagtttatccctaaaaaatcgatccctgcacaaaacactagaagcaataaatgacattgtcctctctcttctatcactcacgctttaacaccaggaatcttatctctatctcatctctctcctctgccttatctcctactctacccatttctttcctctacgagcaggcaagcagctagccttcaacccttcaccactctgcttctccctctcccgctccaacttcttgcactcttttccgcacctccctccccctctctcctgcaggccctgctccacatccctctccctacccacaaccttccgcatccaccttgatgtggtggcgaggaagaagatcccatggagtctgatggatgcagctcgatgcaccggggcgcgttgtaggcaggggtggcgttgcgatgcagtcggcgatggagcttgtgtgtcttcaatctgcggtagatctaatcttggcgcttgatgcatgagccgccatatttcttttttttctctatattccttttctatctttcttttttctctattctgggttcttcctattgcagtagtagtctgatataggtgaacgaacaataattctttcctcatattgtagagatcagtgaattttttttggcgttgtttattctattccagatgcctcttgcgtgtaattaattactgcagagaaacgacagtgctgataaccggatgtagttaatggggggcattttcgccttttcaccttagtactaaacttgtcttggaaactcacgatgtcccaagcccgtaaacgccaattccccttgctgataggcccacccaagcccaaaccgagacccaaacccaagcccaaagtgcccaacggtcatcacgcccatctccaaaccctcgccgccggcacatcgccattcccagaaaaaaaaacaagaagaagaaattccccaactctctcctcctcccacggatggatccccacgccggcgcagttgccagcggcgaatccgccggcgacgaggacgacggcagcggcgagcacgagacccacccgacgtctcccgcgccctccgccaacagcaggccccggaagcgctcgcgcctgaccgccgccgcagacgaatccacgaccgtcgacgactgctccgccggcggcagcggcagcggcagcggcgacggcggcggcggcggcggcgagtcggtgggcgcctggccctacgacgagagcgcagccagggacgagctcgtgacgctcatcgtctcccaggatctgcccgtcgggatcgcgggcagtgcgtccttcgaggccatggtgctgcaagcgttctgcccccagttcgagcgaatcgacaatgctgtcaccatcagagacatcttggtgttccacgaagaccatgtggcgggattgaaggaggagttcaccggtggtgatctctccttcgcgttgtcatgtgaaatctgggggacttcgtatcataggatgagctatctctgcgtggccgctcactatgtcgatggggatcacattctgaacaagagggtgattagcttcaagcttatcgacggcgcgccgaccgcggaggcgatggcgcggcgcattcttgatgttgccatggaatacggcattgagaatcggattgtttctgttactcttggggatggtttagcagatgctgaaaccatggatgcattggctcctcttcttgggtggtacaccggcggatttgtgttcctgcagaggtgcattttcagcatcctcaatgacatcgttcgagctggtttgactgagatggctgagcctttggatgctattcgttccgcgattgcgtacgtttccagttcggaggcgaatttcgccgagtttgagaagtgctgcgtcgagcgaggccagaaggctaggaagctatggcctgattccaaagtaaggtgggattccacatatgacatgctcaaggaagtgcttccctacaaagaagttctgactgactttgtcaatggcagtatgcagcaagagtttctttccgagcacaattggtcgctcctcagtatatttcacaagttcctcgcgaagttttataaggctgctaccaagttgtctgttgtttacagtcagacatcttccttaactttgatttacatctgtgacatggcagtattgtttcggtcttataggacagaccctgttttctctgccattctgaaaccaatggaagcagtgtttgtcaaatattttcaaagaattccacgcctctattgctatgctttgattttagatcctcggctaaaattacatggcctggaagtggccttgaagatgttaggtgaagccttaaacattgattattcaagcactttcacacaaattgctgatgaatttcttgaagtcctttccatgtatgaagagaagtttggcagcacactccgtccaccaccatcaccgccctcttcactggtctttagattattcgctgctagactgaaggagttggagctgaaggagttggagcttcaaaaggattcctcgccctcttcatcagtacaccaacgaaaagccaaaaacgagttcaacaagaaatacatcgagactccatgctcgttgcgtcttaattctcgtggacctgatcccaatattatcat

SEQ ID NO: 60581 - DNA, 531 bp, Oryza sativa
cggcggatcgccgtcggggctaggcttacgcaggccgcggacgacggctacgaccgcggcgggggtgggcaaagccgctccgccgttgcgattgggctgggcttgggcttgggcttgggccttgggatatgagcctagtctgacccaagatcagatgtcacgagtaccgtgtttagtaggtcacaagtccaatttctgtcacatgttgcctgcctttgtagtgtgatttttagttgcactgtctaacttcagtcactatactactataaatattttttaaaccctttttgttttttatttaggcgataagtttagaaatgctatagaattttcttaaatttcacaaaagagaaaaataacatttttcacgaaaggtaatatgcttttttttaatcagcacaatctctagggtggaactttctagagtattttttatctagagaattatgctatcgtatttatcagggttatggataccacatacctaatagtagttgattaaatctcggcaggacccaccacataccatgt

SEQ ID NO: 60582 - DNA, 24893 bp, Oryza sativa
agtgaggtgggagtcggggattggcgcgggggagtccagcgtggacgtgtggggggcgcggccgtgtggagatgcagattttgtgggggctcggtgctttcggccttgtggctgccgcggtttgaagatgattttgtttggctccggctgtgtgcctgtgtgtgctcgccatatgcacgtcgtgcctgccagagtctcgattaggattttgttcacgggggttcccatttcaacgaggggaaataaatggttctggagatgtccatttctactagagttacttcctccgatcataatatctggcgttcatgatagcatttgattatacttatttaaatactaaccgctcctttattataaggtgccaagtgatcagtagtgctagttatctcaattaggattctttatttcccggaaaaaaaaggattctttattaagctgaacaaacatcgaacaattagggcctgtttagttccccaaaattttttcccaaaaacatcacatcgaatctttggacatatgcatgaagcattaaatatagataaaaagaaaaactaattgcacagttatgggggaaatcgcgagacgaatcttttaagcctaattagtccgtgattagccataatgctacagtaacccacatgtgctaatgacggcttaattagtatcaaaagattcgtctcgcggtttccaggcgagttctaaaattagttttttcattcgtgtccgaaaaccccttccaacatctggtcaaacgtccgatatgacacccaaaaatttccttttccccaactaaacacacccttaatccactatttcacacagtagcgtagtaccacacccgttctgcgcctgcacgctacgcgaaacctgaagcccccgcgcgcataccagctgggtcgtgttattcgatctcacaaacacaagaactcaagaagtaccaataacatttcatccatggactgtacggttcgcaaggctgtctcgcgaggtttcgctctagcagcagagccgagctgccgatgggtgggtggcatctgaaatcgatgcacttcagtggcttcaaccgagcgctatctgtggatctctcagctggagtaatactggagcccatggacacttgtgcccgctccgcgtatttcctgatgccacccatttctacccgggcacactagctactggaaaatttaaccgccgtgaggcgaaaccagatggccaatataccagaggaagtggcgatgtgtgagaagaaaagaagactcgccatatatatgcaaaatctcgtttaggatttgtttactgtgttctcattccaacaagggaaagagaatagataaagctctagttatatggttgttgccaaaagatatttcgatcattattttaatgccagcctctttcgaagaagagataaagctttacaaaagacggttcaacacttgtccactgtgcaagataaatctgaacaaattttagttgaattcaaacatttagaaaactcaaaatttgctcgaaattgcaaaaacagaaattgccaaaaaaaattaaaaactaaacagattttgctaaacttaaacaaccatttgcaattttttttgatttgtataattggtgacaagttttgaattttgtaaagtatgtttaaattcaacaaatatttgtttccattagagtcttgcacatggtcgcccaagggtaaaattatcctttgcaaaatttccaagatatattaaaatagtggttggaatgtcttttgccaaacaactattcaactcctttaaaaaagagtaacgatggtgtcagcaaatatgccaccccatctattccaatgtagatttggtgctaccccttaaacttcttgatattaaaaataactaaatataaatggatgatcacaaataataatattacatcgaggtgaatttctatgacaaaaagataggtaacacattaatgtattttctcttatccgtatccaagcacgtcattcaactagtaaaactagaacatcagcaaattttacctttctctttcttagtaacatgttaacttagaattcaactgccctggggatgttccctcgtgaaaaactctaaagaaaacaatagagtatagtggcatctattagttcatcaaaaatcaagtttagatttgatctatacattggaaacaaaataagacaaattcgagtgtgaatggtatgttactatatattcatacgctgaattttttttatctcaatgtgtgagaagttgagtttggacaaaactcagaatttttgtacaaactatcaagtaacatgtagccgacacatttcatccatgaaccacacagcatgtactgctcgtccacgcaactcgcccgtctcggttttgctgtatagcagcgccgcaacacagctgctgatggatggacgagctccgaaaccaacgagttctctctatgtcgttagccgagcacttccgtcggttctcatctccactttggtgcttcagccaatggacgtaagcgtatggaaaacggccgccgtacgctcctcgtgcttccggatgccacccatttctaccccgtatggtacgctcgcactgccatacacgcgcatacttctactaatggtttgacacttgagctaattacaactgccgcgaggcaaaaccggatggtcaatatatttgaggatgtggccgtgtgtgggaaataaaagaatgcgctcaattttatttcttttgcaagacagacagttagttattgctgtatacttgtatgtgctgggtaatatatcaaaccggacgaattaacgaatggatcctctcatcctcctcaaaattaaaagaaaacattttttttaggggggggggggtgggggatcatgtgtaggagatgaagtaaaaggctcgcaaaaaaaagtaaaatctgggttgttgatacgaaaactaaaatttggatttatgttagcatggccacgaatccatgatctcatgtgcactatgtagtatcgactcttttttagaaacatgttacaaaagcaaacactcaaaacgcgcacacacttatccataagaacgcacacatgtccaccctatgcctatgaacatttttagaagattaggctagcatatcttgaggttgatgaagtcaccacgagcacctcattgtcgagaggtacgtcgcttaccactgaaaaattaattaaccataaatacgagcaccagtcttaagtataagacttgaaccactagtcaagcccgtagctattttgctactagcactcccaataatctagccactctaaggtctataagatcaagttagctcgtagacaccggcgaatgtacacccttcaccacccagttccatacgccacccatttctaaaccgcgtgaacatgtagttttgtgattttggcccatcgagaaaagatcagttctctagtagtgcatgcttgctcgcttgatgctcgcgcacgttcctgtgcgcaataagctagtgctaatcttaaccccgcagagaggccaaggtggaggtggatggtcaacatatatatccttcggaggaagcgacaatctttttgggtggaaaaactaatgcctcctaacattatattacggagaaactcagttactatgcacttatgctgggcaatcaatgaatgagagggtagttattagttaccagttcaagggtggatcttattgaaaccttaattggcagttctcctgttcggtttagttaaaaaaaaaaagatgaacatataggacaaagggaaaggctagctagccagaatgtaaaattttgatttatctttttaatttgttaggaaaattgaatctggaactttgcatgacagtgaacaagattgtagtacaacagtcttgcagcattgcaccactccactgctactacaatattcaccacagctaatttacaacattcagttgctggcagtggaaagaaccccaatcgcagctaataatttacaacatttgaatactttcactccaaaaaagtatctcgtccatcacttgtcgctacattctcgatccaaccgaccaattgatcagcgctaacggcaggcggttgatgagaatgctcttgtgtaggcagttcgagttcaacccgggaataagccttattagttagcatgcttcccaataccgctcattccaatcggttttcatcatatcgtcgtcgtgcaccggccagccaagagatacacagaagcaataaaatataatgtggagatgtggaacggtgggtgatggcggcagggtgtacagtacaagatatacacacaggggttgggttggtgcctgcatatatatgtgtggcgaatcatcaataatggagagagatgtgcatttacatgcatggtaaacatcgatcaacacacgtgccagaaacttcacatggaaattaattggcgtccaggaaccgattcaaggaacataaataagagatgtgctgatggctagttcgtcagaatataaaaacttgtactgaaattgagcattcgcagcagtgtgtatatttttcactaactgattccgagaaaattttatagtatttgagaaaatacctcgaggtatctaaatttttacactatctcttagtacctttattatggatggtaaaattatccgtctgttcctactcttagataacaaacagtctcatcgtttcagtatcagcttgtagtacaagacatatagttgagttaattatttgagctttcagtttaaccagatatataataagaggccaacatttagcacttatactgaatttagttgagagactaagcttgaattaagcaagtcgattcttcattctcttcatagacgattctgcattcacctcatagactaagcactggtgctccgtgtgccgatcacgagatcgagacgacatggaactaaactaaacacaattccattcttccatttccatgggaagtcataaaaatcgtggccattctacttcgatagcattcgccgcagcatttcgaggaagtgatgtacagtatattgctgccaccttcatggaatccttcccggtgccgctcattccgatagagagcaactgatgaacatgttcgatgtatcatccaatttttttgctaggcctttttaagcgcttatatattatcctacaatgcaccactaccatcgatctgctggactgtgcttgtgcttggtctcaaggaaaaggacaagtgagagagtacttagtatgatatggagaaaaaaaaagaaggggagatatgtcatggaagaagagaagagattatgagaaatatacatatactgaagagcaaaaggtggatatatatgtacatgtggcatgctaacaagttaatatgcaaaaactagctaggatgacttgacatggatcatacggcatggggaaggttttttttttctctcaggggatgtttttacatgtcacctagaaagctataatcttttcttataaatcacaaatatgactcaaaacagtacacactattaatagtcatattaatagaggtgagtgcacgtgctcataaaaataaggtgtgcctttgtgtattcatagagatgagtgtgtgcgcctatgttcctactgtgtttctcaaagaaaaaaaataatagtatatttgttattttattaaacttgtatacgttaaatttggacttgcatgtacagtgatatctcatattgacctatactgtcaaagaaaaaatatggctttttaattacatgacataggtaaaacgagtggatattcctcgagagagacaagggccacttccttcctgcatgcatgtgaattaaactcgtaaatgcctcaacaagcaatctttgaaggccgttttttttctctttttttagggaaaagagagctttattgatctcgtaatagaattacaatcttgctacagtatgagcttaacacaggatggggcatgatcactctaggccagttatgtatgtcaaagatgcaaagatcttgcaattaaaatggaagagataatatcgatctaacagtgctttaatcttagatgaaaacatttggccatcatgattttgtgttacatacatttttcttaaggaaggtggccgagtaaaacaatcaacacattttaaatctttattaaatccttgaaagaaaattgtgtcatctgtaatatttttggcccatcatcgatcccccacctctaaacttatgctacaacataaattgggcttgaaaatgtcttgggtgcgcgacttgtgacagtcctatgatcagtggacagtggattggatattgttagaaatgttttctcaatgccgctcattcccattgaatccgcactagaaatctacagttcggatagagaagaaataaattgatcagtttgggctagagatctgcacaattgaaaattgttaaagaagtcagctcacggtggattccttatattatgagtacaatgagtagtcgagatgtaatgggttggtaggtggtgacgtgtaatgttgcggtgttcatgctcagaaatgtaacgcttccgtgttctaattggaacacagtgctctaaattttgttaattttccaatctgagaattatatggaaaatcataaaattaaaataaatacatagccttggaaaaaaaattctaacacgcagaggagtcctgattcatgttggtaattaatagtaattttccagattggaaaattaactttctaaaagaaacattcaggttactaccatgggcaaaccgatctctagtccacactccacggccgttttgtttcgttatagcagcacagtcgatggacgggtgaggcctcaaatcgatgaagaaatccgacagccgttagcacaccccttgtggagtctccgtggtcatcaggaatacttgagctcatggacaatggcagatggacgatggccaccgcctgctccgcgtgcgcatgccgcccatttctacctcgactccccacactcgacgcacgcattgcattgtttaaccgccgtggaggcaaagctggatggttaatatatatactccctccgtttcataatacaatagattttggtttgatgtgacacatcctaaagtgtatgcccagattcactatactataatatgttacatccacctaaaatcccttacattataggacagagggagtagatcgaaggaagcggcaaacgagaggatgcatgcatctcaattaattactacctcaatcccaaaataagtgcagccatgggtatatatccgtgtctaatatttaaccgtccatcttatttgtaaaatttatgaaaaaaactaaaaaaatagccacacataagttacttttcatgttttatcatctaataataataaaaatactgatcatacaaaattttcaactaaggcgaacggttaaacgttagacatgaacaatgaaaaactacacttattttaggacggatgaaatacttcatatggtttggagtgcactaaagttattaattactaattaatttgtagtcctctccatccagatgtaatttgttcttttgctctgtcgtaaacctcttttgaatatgttattatggaattgtatcgtgaatttgtgaattgaaaactataaatggacctgattggtgtttttttttcatttttttttgccaaaaaaatcttttcacatgcggtcccataaaagagactatcctataaaaatcgagaatttccaacaaacctgcaaaacttgaggttttccacatgcctctaagttagagacggttcatccatccgcatgtgaaaatacaatataattatctgtaaaaatgttttttttaaaatagtcataaactcctaatgtcatggcagcgacaacagctgccatatgcagcacacaaaatgtccatgaccgtcagaacaggattgccgatagggtgtgaagatatgtttctactccctccattttataatgtaagtcatttcagtatttctcatatttatattgatgttaatgaatctaaatagatatggatataagaaatgctagaataatttacatgatgaaacggatgaagtagcagggttgccatggaattgtgcttccatccatacgagacaaaacgtgcaaaatccattaggttttattatctgataaaagcaaccgcaagagctagtttacaatgtatacgccgttgatcatggtattaatgttggaaatttggtcataattcggcatattttaatccaaaataacaagataataatcatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgctcgcccgtctgtgcaaacgtcgcagcaacgcgtggtttcggaggcctattctcccaacgcgtgtgcacacattcgttgggatgggattaccgtagcagcaacagcttttgaaaatggataaaagtgtgtcttcttcttctcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaatttcaaggctcatgagaatgctctctattccatagcagcttttatataccagtgtttcggtgaagactgttaagttgaactttcacctagaaaaggagctacacctgaccacaactgaacaatggactatgccttgaattgtcagtcttgtgcagttaggtttcactcaattccataactgatactaggcaaccattagtattccctcgggttggagcttataagtcatactccaggcctttcatgagtatctagagatcacccaaatctcatagactgtgactagcagtcgaactcatataggtgtgttccttctaagatgttctgcaggtcaacatctctgcttggaaaagccactcggatcacattaagacataagccatcctaccatgcaggaaagaagagaaacacatcatgaaaatgagcccttttcaagggtctcttcagtcacacaatagtttgtttcaccatccaaattcacgggatctccgatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactatcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtaccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatccttcatttcaaaactcttggacagatagtctttgacctcctcaatcacattaaggctggtcccaaagatcagtatgtcatcgacatataagcacaagatcaccccttctcccccaccatagcgatagtatacacatttgtcagcttcgttcacaacaaagcctgcagatgtaagcgtggtgtcaaacttctcatgccattgcttaggtgcttgcttgaggccatataaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggccacaagccttgccttgtacttttcgattgtaccatcaggcctaagctttttcttgaaaacccatttgcatcctacgggcttgcacccatatggacgctcaacgatttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttacaaccctttgtctcttactcttgcgagtatctacaatgttgtcctcctcaggattttcctcaggcgtttgatcattatgttctatcggtgtaaagtgctcatggggcatgacagtttctttactagaagtgctaggtgtatatttcataggaaattcattctcaaagaatgtagcatctctggactcaagaattgtaccaacatgcatgtcgggtactccagagtttactattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttacttccttatgcttcattggaattttattcaggacatgacacgcagtcaaaactgtctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcagctttatagattttaaagaaatgcaatgcctcatcctttgttttcaatagatacacatagcaaaatctagtgcaatcatctatcagcgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgcgaatgccacacattagactcatcattctcgctaatatggttcacaacattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactctaggtaatattttaccgtaccccgatgttcctccgccctcgctaatgatcatgttggcagacttcctgtctttgcgctcaggacagtccttggcccaatgcccagacttgccacacacaaagcagtctccctttgcctttcccttgcttttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgtcacctgccacaaacttgtccggcaactcacagttgttgttctcaagttccttagccagcatctgaatctcatgagcttgttcaactacagaacggtcatcgaccatcttgtaatcatagaactgctccataacatacagctcactgccggcgtcagaaattccgaacttggcctcaagtgcatcccacatgtccttcccagaaggcatgtgcatgtacacgtccactatgttgtcagcgagtacactgatcaatgctccacgaaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctataaggtttttggaatgttggaaatttggtcataattcggcatattttaatccaaaataacaagataataatcatgatatttacaataggatttgatccagtgatagtggtgaatgtaatcaacatgagcatgcttaatgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacattcgtcgggatgggattaccgtagcagcaacagcttttgaaaatggataaaagtgtgtcttcttcttctcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatatagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattaatttaaatggattaattacccaattaaatctaacaattaatccgtgtgattggacacgagaccttagtacgggcagcagcacatatcaggatcgttgtgtatgcaggtgcctccttggtagctgagcatttggcagtagcccatgcacatttctgtgttgcatccttgtagcggcttacacgccattttctcttcgcctacattgcctaaacaaaaaattgcaatgtgcagctagtagttaggccatgaatatgtttgattcgtgcataaatatcaatagtaattaaaaagatatactcgcagaacatataattaatgagcaattttaccattcaacatttgatacctcaaggtaccacataatggtatctcgaggtactaatttttatattagaaagtatcttgagataataaaaatttgtgatatctcgagatatcaaatggtggatggtaaaattgctcataattaatagtactcggtgattgcagaacaaatagtaaaccgtaagaatatataattcatgatcaaaataaattaaagcatagtagaccaaaaacgaattatatgctcatcgcagacaaaataaattcatgatcaaaatcatttatttaaatcatttatttgttgtctgcgagtaaatcatttatagttaatttgttgattgcagaacgaaaattgtattatcgttaccttgtccttgggcagcatgagaggatgaaaaagcagtagccatgaccactagagctgccaagaacacggcagccttgcaactagtcttgccaagaagagccatattcagatttagagggaattagctttctaatgagtggtggtagctagcctatccttagttccctatgtttggtgatcctctcctaggtgtttatatagagaaattggatgatccattcctaatatcatttagaatgcatttaactgttatatatcctagtatatctctccacgacattaatattgtcctttttttctctcaacgtctcaaattggtagcatgcatatcctatatatcttttgggttaatttggtagcatttgatccactcttaatctcttttgttaccattaactttattatattctacaattgtcctcctcttatcgcatcctaagctttggctgcgatgagcaggtccggtatgaaccgtccatatccgaacatgtcaccaagatgaaagatgtacggtcatattcgttttggatgaatttcaaacgatttggtttcctaagaattaatttctataaaagccattcaattcattaaatgtagatacagaaaaataaaacaaattccttttctacaatgtgtagagagaaaacataggaaattttccattcactcaaacctcttgaaatatgcatacattcatattctttcaccatttctattcgtaatttctgtgttaaaatttcttcaaaacgaataggccctacatgatttatgagaggaggaagctgaattccaaaccttagagattagagaacgtagtagaggaggaggaggaggaggagaagaagaagttgcaccggaaacagttgttggaattttcttttctttcttttttttatgtttttgagaaggcagttattggaatgctgggtttgagtgccggggtcgacggggtttgggccgcgatggacgtcaatacacggcctgccaaatggggggggggggggggcgctaatgggcgcgtacgcgtcagcaatttagctggcgcgcgtcagctcggccgcctcccgtgcctttttttttttattttcctattcgcactttttccgatcgcctctgagcatgttttttttcctgtttctttccgatttttttcaatctttcgcacacctctttacgaatgtagaattgaaagtttttatttttgaattaaaagttattaaatctttacttgaaagttttctaattttatgttgaaagttttctaatttgagttgaaagtttttaaatttaatttgaaagttttcaaatctgggttaaaagtttttcaaatttgagatgaaagttgaaagttttcaaaatttgacttcaaaaaaaattcaaatttcgagttgaaagttttaaaaattgagttaaaatttttcaaaatctgacttgaatgttttcaaattgaattaaaaatttaaatttgtagttgaaagtttttaaaattcaagttgataggttttgaatctttaagtaaaaaaggaaaataatgttgtgtgaaaaaaagaaatatatcttgattgaccgtgattattagatctaatcacgtaaagcgcagctaatcactgttttttctcatgattcctgtgcacatgcagcgtcttcgcgaccaaaaaaagaagaggaacgacggttgccacgcgcgacgaagattaatgggctgcgcatgagggcgtgggccgcatgcagagttatgggccaaaaatgcgcgcgagttaagtacatggcacgtacgtgctaattagcaattctgtgccaaatgcatctttattcggcccgagagagaagagctgggccttgattccatcggtggcgaagtttgggctccaaatatgcgccaatccaatatgggcttgaaaacgaggcctaacggaaatgagccacacgatcacctgatccacgtccaatcggcgcagtcagccagggcacgggttctatcgagtgccgacgagacaaaccaaaaccctcctcgttgatacgcaatgccacctagggcgtcgtcgatgctggcgcggctcgtacgcgacgcggcggccgcgcgcgacgccgcccgcgtagccgcggccgccgtatctcgtgccgcgcgctcctaggcggccgccccgtctcgtcgtcgtcgtcccgcacgcctggcagccgccgcgctcgcgtctcgccgcgccgcggcgtctcgcgccgcccgcgtagcctcatgcgtcccatattacctcgtcgacgacgatgatgacgacgaccatgctacccgcccattgccatcatgtaaaccaatcccctcactcagtctctcttttctggtagtgcttgaatctctttttttttttctttttttttttgaaaaaaaggcaaaagctttacctcgcatatattaatagggtagaagaaaacaaccataacaaaggtctatttataaggctatgtcaatagaaacgggagcccgaacaaagaaattacggggactcttccaaaagagttaactcagcaaactttgaggctcccgccttggcctaggtcatggtctctttcttgatttttgcgacgatggtggctggagtggcggcgatacggcgaaaaatcctagcatttctctcacaccaaagttctcaggctattaggattattagggattttagagatcttatggggttacgcggcgtgtgtagcatccaaggtctatgctatcccaatgttgcactgctgcccatacccttctggagagtttgcaattcgcaaggagtacttgaagtcttgaatcttggttcaatagtgattaaaaataatttgtaggtaaaacttttatatgtgtattacgaaaagtaaattaagaagaaaaacttcaaaattcacgtgtccaattgtgtttataagccgaaggctaaacagtagatctgaatttttcgtttctttgtgctcgcaaccaaccaaattgcaacttacaagcctccaatttcgctgttgtttgactgtatcaatgttgttgtattttgtgatatagatgatcctgagccaggtaaggatatctcgggaaaagacttagagtcggacgaagccatatgggccttgtacgagcgctggtgcgaggcttacgagaaagagcgtgaccatgctgagatgactcgctggttcgagatgttcaagaacaatgcagagtatatttatagtctcaacagtgagattacttcggaagcagagcaactaattttgggtccgtactgcgatgggttcaacgagaaagacaaggctgaatttctgaatgattttggccattttaacggggttcacgaatttgtagagtagcggatgatcgactcccccatgaatcgcctttgatcccccatgaactgcaaaggattgaaccacgactgtttactcgggctggcgtcaactatacattgtgattcagcattttgtataaaaaaataaactataatatactcccttcgtcccaaaaaaaaaaaactctgagtttccgtgttcaattttgattgtccgtcttatatgaaatttttttataatttgtattttcattgttgttagatgataaaacatgattaatattttatgcgtcacttgtctttttaatttttttcataattttttcaaataagacggacggtcaaacgttagacacggaaaccagagtttgtttttttaggacggagggagtacatgttggttcatcgactcttcagagtaatcaaagttcctgcagtgaaagtgacaaaactttaagcacagataccagtttacagctcaaactgtaagaagacgcatatgcataggccttcgcaggcttaggtatgtaacatgactgttgatcattagaaaccttgtgctggataacatgttcaggttctcaacaaaatttatgttcagacagtccagatccttagccccagtcacaggttcctcaaactggcgcggccgtcggcttcggatcggcgttggcggcgcgctcgtcggctccggggaggccgatcggatcagagatgcagacctctagttcaacatactttctcgacacctctcattccgagaccatcacttgatgtatgtactacctttcttagtatcgaactaatcttcctcatcgttcaagcatggctggtctgagcccgtaattgtaactatcagtttgggcaagagatctgcactactgaaatttgttagagagaagttagctcacggtggattctttatatataagtataataagtagacgagatataatgggttctaggtgatatgtaatgtcgctttattatggcccaactttttgacataaattaacttttaagccaaatttcttatttttgtacgatttataaattggtggcttttaagcctccctatgggtgaagttctagctgcaacccacctaaaaagattactcaaagtttggcttaataatacatgaatatttatagattttaagaggcttttaaaaaaaacggtttgcttgtttggttctcctcgtatattccatttttttttctaaattcaatgcaaatggtttgttaacaacgctaaaacattaataactgtaattcaatgcaaatggatttcaagtttttttattctctaagctagttgaggtacatttctattgataattgaagtgccacttttacctcaaaaaattaaagtgccacttatgctttcgcctcacggtcctgtgcttgcaggctaagcgaaatctgaagaattgcatcgatctctatccaaaaactgtaacgccagttggaacacaatggtccaagcatgccatctctggggacggggggttccagttgtgagttgactcctaattctctgttaagttgattgtttcccagtctatgataaagaaaatcataaaattaatacacagccttcaaaaaagatctaccacgcacaggcgttcaggttgatggaatttgccaaactttctatgatgaacagctcagaattcccatgtacttcggccgtctctttgcaacacaggaaatacacaataagtggctgccacaattcatccatgggtcatactatacatgcccgttttgttgtaacagcacagttgatggatgggtgaggtcaaaaatctaccaggatcctccgacgttagcactccctttctggcgtctctgccagcttggggaacacttgagctcatggaccatggcagatggacgatggccaccgcctgctccgtgtgcttccggatgccacccatttctagctaggcacccactacattaatgtgaaacatgcatgcattgtttaaccgccaaaagatcaaaactggatgcctggatgaatggatggtcagttaaatactccctccgtttcacaatgtaagtcattctatcatttctcatattcatattaatattagtgaatctagacatatatatctatctagattcattaacatcattataaatgtgaaaaatactaaaatgatttacattgtaaaacggaggaagtagaaggaaccgaggaagggtacaatagttaacttccagtcctcttgatttgtatgtaggccctatttagtttccaaaacaaaaaattttcacccatcacatcaaatgtttaaacacatacatagagtattaaatgtggaaaaaaaaccaattacacagtttgcgtgtgaattgcgagacgaatattttaagcctaattgcgccatgatttgacaatgtggtgctacagtaaacatttgctaatgacggattaattaggcttaataaatttgtctcgcagttttctggcggaatctgtaatttgttttgttattagacaacatttaatactttaaatgtgtgcccgtatatcctatgtgatttttttagataatggaatagagcattccggcctttgctcaaagagttacagccaattattacaatctcacactcaaaatgagtgaagttcaaagaaacttaaaagatgaaaccaaccatcaagaagaaacaacttaaagactgccaacccaagataaagagtacacaattattgaatttgaacctccatccaaaattgacaaaaagttgcataaccgttgtttcaagaatacggcatgcagcctttaaaagctcactatcttcctcacacttttggggtatatcctatgtgataccctaaaacaaaaaatttttgccatctaaactgggccgtagtacatgtctcacggtccttgtgcccctcattctgatagagcaactatgggcatcgggaatttctatctaaatatatgtatctctacttttgttggtagggtggtttttattggtagtagggtgttttttatgtcttcattctatctataagctaacaaattttataataaatggccgtaccttctttaaagcaaaagccagattttatccattaaaaaaataggcatcgggatggtatgtgctctagtctaccagaaaaccaggtgaaacatgagatagtgtgacaatggaagaaattaaggagatgataagatgattagatacatacacaaaccaacacctcgcacaatataccgtcatgctttgtatacttgttgtatttccctgttatccaaaatactcgtcccagacactgtgttactgggagtatataaacttaaagacgcattatcaagtagatcacggatggaagaagattaaacgcacaaactatcagaacaaacatacagcctaaggccaaagaggatcgaggcggtaagatgacaccgtggccgatcaagctgagccactgtgcttgtacccactcaagagctctgactattctcgtcgagaattccacacggaactttagggttgaaaccacacgcttcttaccgttttatcaccaaaagcatctcctatccctgttagtcgaaagagtatccaactgcttagtcaaatgtattctcctggcgcctcccatttcaatgcccaaactatctttatctggggaaaccaaggcccccggccgcaaccttgcatcattgtcatcgaattgtaatgttcttttctgtagtggccagctccaaagaggagtagcgtgagtggactccaaggaagtgagtagccggaaatatatttgtacgctggtttgtaaacagatgggcaatgtaatgtggttgtgagctggtggtgattgacaaaatccaaaagcacatcatcagtatcgtgaaacaaatctctagcaaataaatttcttgtgagtcaatccgaaccggagtaaagataagatttatcttcttctaagatccctatatatacatgattagactgagacatttgaggttagcttgtactcgagattaaatctataacagagagagtttcaccctggtccctacacctatgcctattgtctacttttataatgttctttctctaccgctgtgggtgggaagaaaacggtgagtttctccgtgctaaagatcggagcctccgactgacagtcagaacgatacccgcatgtgggccggtgacttcttcagtttcacgggccacgcacgataactaggcgcggcccgggcaatggtagcccatttagctggggcgtgtagcaccgacgaacagcgtgggattggaagttcatccggcaatgtgagccggtgtggctttggttgacattctgttaatgaatatttcaaagctaattaacactcactggacgagtggataacgttgctagcaacgttctaaaaattatttataatttgttaggtgaaaaacaagacggatggaacaaattaatgagagctggacaaaactagaagccgtattttgacgggatcgtccaccaggcaccagtcacatgaaaaatcgttgcatatgggcgaagactcccatcaaagtgaaacagtgagctttcaatccaggtagcagacacgaatttactatgacggcaagaactgaaacttcctacctcgtcacccccgagaaccgtgactacaaccatataaacctttgaatcacatcgaggttggaatatacccacaagcacggtaaccaccatatgtagcagatgatcttgtcgatctagatgttttctcgacatctctcattccgaggctatcacttgatcgatatatgtaccagtttacttggtatcgaactaatcttcctcatcgttcatgcatggctgacctgagcccccatatataaggggaaatattacgtgaaaacgagtaagtgttaaaaactcgtggaaatgatcatatctagaaattttatgaatttataaaaaagcctactaaaaataggtctagatatgaaatacattctcaccaaatcttaagtacaaacttaatttcatttgagagaaacaaaaatgacaaatctcaggtgaatagtgtcatattaattgttattattcacccaaaattagttttatatttttagtcccaaatgaagttaagtttgtacatgagatttggtaagaatttattttatatctacacttatctttagtaattttttatgatttacaaaatatttagatatgattttcatgagtttctatcactttacctgttttcaccggatatgctataatggctatatcaagactcgagagtgagcacagaaacgtgggtatcagggtacatatatcaacacggacagtgtgctctcatcaatagatgtgatcatgagatggtggatgggactcatagattagcttttagcctgcttagttaaaagtaagaaataaatagaatttcactttcgcttcattgtgtgcttggatggaggctagcccactagagacaattaataatgtgaaaagttaatacatttcattagtttttcgatgtgggattatccgcttatcccctcaaccttttccagcatgtctgactactagtcctatgactagaatagctcaaatgattgacaacaaaacgtatactgaagttttcgcgcaacatgagaaaatttagcccgtgtacccggtacttctccattccaacacggttgtatcagatgctaccacaccgcgacgatgcattgcacctctacgagggatcaggatgttgagttgcctcacgggcacacccacttccgaagaaatcacacttacactgggctttcacgaactggtgctaacggtgagcaaacctgaactacaaccatgccaaatcgacaaaaatactttcctggtgtcgctcattcccaaactatggatgctctcattgtagaagaagaacatagactcttactctcttagcatatattgtgatgcatatcagaaataagcagtgaatgttgtgtgctgcacagcgaagttaattatgcttcatgtggccatgcatgtgcgcgcagctatatatgcgtgcactgtcacctgttttgttctacaaaatagttccaccattcaagtttaatcgtcatatataaaaattgaatcttttgcattctttcccccccccccccccctaaatcagttaatcctatcattgctccacatttcattcacactcaaaacaccctaaatcccaaaactacatgctccacaccgccccctaaatttactgtcacaaacaaacacctagctagtactcgcaagcatgataccactattctttgtatacttgcttacattgctctgtaatccgaagtgcttgtcgtgtcctagactgt

SEQ ID NO: 60583 - DNA, 2603 bp, Oryza sativa
tgctattgttgtccagcaaggggaaactacacacccattctcatcccagaatgcatgtccttccccagaagataactatgttgttcccatgcctacgggacatgttcagagttttagccctcctactaatatcaatgtcaagaagctacatcaagaggagaaaaacatctattcacaagatgttgctgaagaggacatgtccaatgagtctttggagggaagccagaaggatgaggacctatttcttcatgagaaataatttcctccatttatttagaatatggaagaggaatacaacaatggcaacgatattcatgatggtaatttctccaaatcaagcaacagtatcaagaattactaaataaacaacaaatcaaaggaggatgcatcttagctatgtttatccaatgatgttgtatagtttaccttatactttactcaagattaataaaaaataatttgtgtgtgattccagtggtttaccttgtgtttccatctacctttgtatggacaataataaaaagattattgtttgtttgataattcaataataaaacattcataagttgtatcatttatttagcaatacttcacaagctaaaaaaataatttgcgattgaccatttcttaatggcattgaaagctttaggaatttcaaagttaacatggtagtaagggagcctattaactataagatgttgttcctagaacatcattacaccgactttgtaggccctacccaagctacctcaacaggcaaaactattatgttcggtccatggtggagcagttgtggaggaaccctggtcgaagcctggagtacttcgaccacgactattgcttgcgctaggaagacatagttgtattccggtgcaacttcaaaatgtttgatcactaagtggtgatagctgagcgctaataattagcattcattttgccatcctttttgcttctttgacattagtgacatgaagatagctcaatggacgtgacttctatactagctttagtactcctagtcactctaggagctgtattataatttcagattctagttcatctagagacatggactctagtttcaccgggctagctgcccttctaatgacaatgtaatatacttgtgatcattcttcagtacatgatgtctggttctttatggcatttgtttaatgctggtatttcttatagtcaaagaaaaatccgcaagcacacggataccactatagcatttcacccaggagtattccaaggttattgcatttatattttcacagagacgacgatagtgtaaagatagagttcatacatttttattcaagctataattattttaccatagtctaaatatgggctaattgataaatgataatggagtagtgtgacacacaggagattcgtctctaatagatatatactaggcaagaagaactatagaaagcttaggttcatatatacttctatattactaatgtttagtttacacttaacacatacatgcttacagagaccactccctgttggtttgccagcgtggctatggtattttaattacgaactcttacttcatacccggatgtgaaggaattcaaaggaccgacatggctgtcaccacctgccacctacctcactttccatggggcttacccgcatccaatggcatttaattaagctaagcaccatacttatgtcaataaataatgtcaccaattcccctgggattcccacccttcggattgacaagttagaactagtgcaatccgttaagatcattggtccattaccgtagaataaattgactagcttaatcaagtgaagcatataaatgaagtacaatctactcattgaacacacaactagtaaactagtgtatgaactatgaacactaataagtaaagataactcctttattgcaactatagtgttacaagaagagtatagtactaaagacatatcaaaatctctgagaagactataggacctaaaattgttctaagcctaactccactactactagagagaaaacaatttatggaatgaaagaattgctccttgaagtgtgtgtgttgtgaagtgagaagctcttctccttttataacctcccaatgaaggttgtatggtggttactgaggtcggtgcacttctaaccatcattagggagggttgagatgttgccacttggaaggtggagatgacgggtgaccatagtggttcagtcgatccaagtgttcggacaatccctgggccccacctctccaccgcctttaaccaaagggtgctaggtgggcccctatggcaattgaggatggtgtggccccactttaggttagtttagactgacttgtgggcctatcgttccgtttactcgcacgtgattcgccggaggtgtgtttctttgcatgccagctcatttctttttcactttattgtgtaatctctgcatgtacactgattcatcaagacaagtggaattacattatttaatactagcatatgatagttgacggccaaaatcggtacttcacgaccatcaacacttaactacgttgcccatgtaagctcccaatagccctttgacattttgctatgttttatgttctttg

SEQ ID NO: 60584 - DNA, 578 bp, Oryza sativa
caagtttatgattttgaagaaattgcaagacaggtttgatcagttgaatatttccatgagtgtatataagaattctcagaagtttcaaaatggtcttgggatgtcctaagcttaccattaattatcgacatcattgaagagataatgcgatgtagaaagatgtctgattcttgaaacagtaggttcttttgtctgaagaccatgacaaactgaattaacacctagaaatccaattactacatcatctagcattggatacgaaggtacgttactcagaagattgagtggatccaccacgatggtaattgatgaaacctacgtagacaatgcttatccaaatgagtgccttccatgaattctgatcctttgcaaaataggtcctccaacggtaaaactagatttggattcttagcaaaaattagttccacatcgttgtagttcgcggcttttgctgtatatatatcgacaaagaaaatcgctataaaattatttttttaacatgatataaatgcatgtgtttatataaaacgcgcgcgcactcaccctataaataattagccgtgaatgcgagcacccat

SEQ ID NO: 60585 - DNA, 6251 bp, Oryza sativa
  unsure (1)..(6251): unsure at all n locations
cgggttggaggaagtggataatgtagagagcgtattgaaaggagaatgtggccagagttgttacggtgaggtatagatagacggagtgagtgtaccaactgtagaaaaagagaaaaatacgtccgaagtcaagaaagaagaagtaaaggaaatcgaagaggtgaagaggctagagatggggacagacatgcgctcgaaagtagaaaaggggaaataaggaaggcgggtggaaaagaagaacaggagagaagcacagagaaaccgccgcccttttaattttccccccatcttgccgttttaaagacgataaagaatttttgccaatttaattgcaccgattttttaaaaaccctgtgccgacttaaaaacttaattattttttggggcagagttaaggactattgtttccataggaagtgtggaagcccctatataatgttccgtaaaaaaaaaggtgaagatgttttagaattgctgcggaatgagttgaggtttttgggattatccagagggggtttaaatgtttataaaaagcgaagggngccaaacatttcgaaacggagggagtatattgttttactgtaatcattatgaattactccctccatccataatatgagggattatgccattttttttgtaaaaattaagaaagtagtggtagatgaaataataaaatagtataaaagttggtaggtggagaataaaatactatcttggaaacctaaaatctcttttcagaacaatttacagatgaaaataccttatattatgggacggagggagtaagttgttacagtaccactatctatatatagcaagagatgcatttatgatgggtgagacatgaaaaaaaatgtcaattcaaaaatatgcaatagtgatatttgactacaatctaagtttgcctttttaatatgcaatcatgtaaacatataatatatgtatataattcgattcttaatcgatactatgataaagcctaagtagtaaaattggcattttccttgtaattaattagtcctatatatgcttgtgcgttacaatgggatatgaagaaatacagaaggatggttttatgaggttcaattttctttgactggtttttctagtggatcatgaaaacactagtttttttagtaggtctttttttaggtagggtggttttcctttttatggggtgtatgatggtggaagaagagaagaaagacgacttccctttatagtagtagagacaattaagcaaaggataaaagctttcaatatcacatgatagtaatttttcattaattaattcaaaaataaaactattatgctacataaaaaaatgtgatgttttaagattgtgaaagtccaatattttaaaaattcttctaacatctctcctatatggatagctgtattagattcaatgaaacatcgatcatgcgtgcaagtttttctctaaaaaaatacgtctcaatgtcacttttgcacaatatatagctttatagaaactaagggtgaaagttgaattttggggaacatgcatgtcaatgtccaagaaaaaaatgtcatgtttgcgagggaacagagagcacgaggggcggatataagagaggtaggtgaggggtgacaaacggaacaaaaactcctatacagaagaataacaaataatagcttaagcgtaaaatttggtacctctatcggtatcttaaggaccataaaaattctcataaaaaatggagtagttaacagattcatcatccaaccttttgcttaatcatagtaagcaagacatccagccatttgcttacctcacacttactgtacacaccaaacataatacatgaatgaataaaaatgcatctagacacacactagtacacattagtacacctcaagctaaggtaagcagctatcctcccccttcttctccccctccattcccctataaagccatcttttatgtgaccactcatgggctctccttcctccatctccatctccctgctgtgactgagctacatactaccagagctaaagcatatgtactcaaatctgtactacctccttaccttgtgatccatgctaagctgcatgctagctaggttgctgccatcacttactgcatgcacttgtgagtggtgatctcatctgctgctactacagcaattagctagcagagctgcagctcatcgatccatggacaacatgacccacaactccagcagcagcagctcatgggatttggacatgagcctcggcagccaccaccatcccctcctcttcgaccagccgccgccgccgncgcccccgccgccgccgncgccattacccttccacctccaccaccaccctctagatccctctccttcttcttctttgtttcctcctcctccccatcatcaccaccatgcccatcacctccatcatcctctcgacctggaccagcggcgtggtcaccatgactatggcggcggtgaccaggggggcgacgaggagctgaggcttcagcaggaggcggcggcaggtggtggtggtggtggccaggacggcggcggcggtggggatcaggacgccgacgaggagctcggcgccatgaaggagatgatgtaccggatcgccgcgatgcagccggtggacatcgacccggcgaccatcaagaagccccgccgccgcaacgtccgcatcagcgacgacccgcagagcgtcgccgcccgccaccgccgggagcggatcagcgagcgcatccgcatcctgcagcgcctcgtcccgggggggaccaagatggacaccgcctccatgctcgacgaggccatccgctacatcaagttcctcaagcgccaggtccaggagctccagcaccagccgggaccgccgccgccgccgtatcccgccggagctgcaccggccgccgggcccagcacctcggccgtgggcccaccgggccggccattcttgccgctgggtggaggagggcccatgatcgactgggtcggcctgaccaggccggtggacatccatgggccgacctcgtcgtcgtcctcgtcgtcgatgggcggcgccttgggtttcgggttcggctgcggcggcggcgggcagagcagccatgggatgcactgatggatgatgaaattgggatggagcaatatagctgagagagaggagattaactaagctagggatgcatggattggtggactagagaggtaattttggtaatttggttttggtcttggtttttattaattaatttgctcttgttgttggctcaggctactagctactctctctactccccactgagtagctaagctgctgccttgatgtttctcaaagtacaattaattaataagattagctagggtttgcattctatttgccaattttttttccctgcatgtgataattacccttcaggggtttggttaattttctcttgtcgaattttcttttgtgggaaatttcaattaagggaccaaatcattcaacaaattaaaatctggacacaacacatatgtagtgtagtagaaatttaatttaacaaattaaatcttggatgcatgcaatagaataattgtcaatgatgttctggtaggttgcgtgttgtgtcgtggtggcagcatagcatagcatgcatgcatatatgttgactgctaggctagctactggttgagctgagagcatgggatcacaagagaggatcagaccggatacatttatttatttattgtttgcagcttgtcacacacaagatcagagctcttgctatctacctttgatcacttaacaaaccgcttaattaattttactctttctttttgtttgtttgtttggacccccaaaggggatcatatcggatcagaaagaaaaaaaaaaccactttaattttgtcctgatgagatactagctactccagcgcgcagacgtagctagaaaaggagggaattattggtgcaaggtattcagtgccatgatcagtgatgagtggtgaggtgctgaattccatgcatcgtcagtaaattaagaaaggtgagggttttcatttcatttcagttggagagttcccagggaggacgacaatgcggccaaacccaaccattggaaaaagcttagctgtaaccatcaactcctatcgatctaggagtagtagtattctctaccttacctattgcttacgtattctacctagctagtagtagcatttctagcttagcactggtgtacggctcctggattttcttatgttttgtttccttctttgtgaacattgggccagaggtttctcaaattgtcattcctggcaaaatttcttgtttatctaagctaattaagccatatgtgatatactacctccgttctaaaatatttgtccagtacatagctacaatttcttatattttagggtgaattggaggtggtaattaagaacttaaatttttgttgtgcatgacctcctcgaaaaattccattagccgcaacaaatggtattttatgtaaattaatggtgatgcatcactgttgatggaattactgctttgtacttttttaaaagagttttcattagatttagatgcatgttttgttgtcgaaacagaaacaatgtaagtgatttgttcactttttgttgctgttactctattctgaagttcagtattcttgccatattctcccccaattttgattaatttctgctatatagtttaaaccaatgcttaagtatacgcataaatgaagcattttagttttcttcaacatgctggtaaataaattattttaatcaaactaattcagctttggttttttttatagtgctcattgggaattttgtaattctttgtttcagattaatgcatgtttggctgccaattttgcctttttaggtatgctaatttatattgatttattgtagtatttgaaccttgctgactcaaaatgtttagtttttttttacttaaaccttttggcaaagcaaggacgaaatcccaagtgatgtgcaaccctgccttaatttggggctatagacattatattttgagtgaatcttgggccatatatataatgttacttgaattttaacttaagatcatctagataaaaaaatgctgccttatgccgtagttgtatgccaatcccatttttatgaatgaaaatagctaagaggtcaccaaaattaagtacatcacataataaatttgatcttcaaacttaattaatgcaacatgcatgtcatcgtatcagtattaatcatggctaaaggagcaagctttctcctttatcttcggaattgaagaaaaaaatgttacaatattatatgtttgcatggtcattttttaatgttgcagacatatggttcaaagaacattactgttcgttgtaggattgttagaactccagagaggattaattatattgattccaccattgtgaaatgttaacatacacatacgtgaatgtgtggaaattggccacattaatctactgtacctttgcattcgtgatgaacagctttcattccatacagtcctttgtcatgccttaaagcacactaggttatgggcaatcctcagcagtgataatcgactagctagagatcgaaattggtagtatatatgtaaaatctcgatctctaccaaagatttttttttctccctaaaactcccgtgatttagaattaatcaaaatcgttgtgcgtgctacatctgccctcatcaagtaaaagaaatttagtaatatatgcagatcgaatagatcaactagtagtatatgttagagcatgcatattcctttcccttgtccatatatatgaaaagttcaattcaaattaaagatatctctacagtactataaccaatgaatcttaatttgtttaatttgattacttccattcattagattgaacttcaggaaatcatcaaatactacactaacaaggagaaataaattcgataaggcgcgccatttggagtagtgcaggaatttttcccatgttaattcttccagaaattgttttaaaaattatgtcatttccatgttccaaacggggcgcgcagcatttagttctctcttttcatttaaatctttttttaccaagcgaaattagaactatatttgtcgtcagaagaaattaagtatatacatgcatgccaactttgtagctagagaggtttgatcaattatattatgtgctttacgatgataaattaactcacatgaatttaatataaattaagggcacactttgctatataaataagggcatatgtacc

SEQ ID NO: 60586 - DNA, 4161 bp, Oryza sativa
tcctagctactgtagtgatgctgtttttttatgacaggcaaacggctagtgacatcatcagacaatggaattaatttagtagtaccatataccctttttttttcaagcagcagactgcaaactaaccattcaatggcactcatagattacagactagcatagttacaggatacagtactaagtgcatagtaatctaccctagtgctcacacgtgcaaatggaaatcccctagtgctttaacttgaaaattgccataatgccctctgaattgtataacataattgggtataatttcatatatttatataactgatttaactactaactgccaattgttcaacaaatagaaagtactcaactagtatttgacaattgttcaacatataagagtggcaatatgtgaaatatatagaggattgaaaattgtgcaatgtttgaggcagggggactcatgaattgaggatttaaaattcatgaacaattgttcaagagcaagaccattttttctcttcatattttagacccaaaaatccaacaatatggaaatgggataaatgcctctggattctcatggaagaattgaagaagaatcatgcaatgcaatggtagtgtagaagaatcatgcaatgtaatggtagtgtgccgaacgccattgccaataagtggatacggtagctctgctacataaattgatttcctttctgtaggacaggggaataatagacttaagtacacatgccaagaattatcattgctgagaggagttgcaactgtactctgtacttagatctgagtagcatcatacgcaggtaaatgcatgcagaacttgcagatcgagggaacagtgctaccggatgaatcgcaggatcaaccaacattcaacaaagacagatagatagagattgaagcttactgttgtggctggcggatgagtgctcgacccatcggcactccaggggaatccacttgagcaccctcccgtccgacacgcccgtgtacgggccgtcgccgtcaaacgccacgcagccacgctctccggcccaaccgcggacctgctcctgggggaccctgcagccctgcgccgacgagtcgtgcggccgcgccagcgccgcagtcgccggctcggcggctcgccgccgccgcacccgtacgcctctcttgctcggctcccgtgtctagggtttgggtattaggtgattagggttagatggggaggagaattggggaaaatgtcgaaatgggctgagctgctcctggccatcgggtccagcatcgaagctgctccggatcaagcgctgcaccaccatatggagcgctgctgtggattatgggaggcaacatcagatgaagcagcgagtggacggaggatgtagcggcggcgggaggcgatgcgaggcagcagaaaggcgggaggtggtgcgggagtaccgtcgcggctgctttcggggtggggaagcctgccgccgacgcctagagaggtgccgacgccgatcagggctaccggccgcggaagcgagatgccgccgccgccgccgccgcgggtgtggggaatgcagagggaaagaaatgagagtggatgagggttagggtttgcaaccctattttatacttcattggtgcaatgacagccattcgatcaagaatcaatggccagaaatttatgggccgagtacagtaacgggccgatttctgggtttaggcctactaatatatgtggtatttttttaatttcaatttatgagaactttaaatttaattttaggccaatttgtgtgtgttttaaatgcaaaaatcataaacaacaaaattttagaactcatcaatatctacaactattgtattggtatttttacaaataagttcatttgaacaattcaaattttgaattttcaaaatttgacaacttaaaaaaaattggggtaaataaatgatgtaaaatgaaaaagtcaccaaaatcaaagttgtagaactcatagagatgcaaaatttttattttggtcatttctccatctgactctatttgaacaatttgaaatttgaaattcaaagtttgagaccttcaaatagaattttttattagtgaacgacttcaactgaaaaagtcatcaacaacaaagttgtataatccatcaagatctataatttttattttggtcatttattcatccgataaagtgatagtaacattatttacaaattttacatatctcccgtatggtttcataagttataagagagatatgtaaattttgagaacaacgttactatcactttgtcgaatgaataaatgaccaaaataaaatttgtagatctcgatcagttctacaacttttgtgttcatgaatttttcagctgaaatcgtttactgcttcaaaatgtcatttgaagttgccactttttgaaatttaaatcttcaattgataaaacaaagtcacatgaaagtatgccaaaaataatagttgtaataacacaataaattgatagatcatgaacttagaaaaatttagaaaaaagaataatcaaatttgaagttagtatgagagagaaagactacctacaagttttagccaaagattaaaaagataaaccacactttatgatgaaccccacaagcaggtgatgcaggtcctagctcctaggtcgtccgcataaaacattcaatcattcatgcgttcaagaattgtgaaaggaaaactaaaagtattcgatcctagctgcagcatatttttttagaaaaaggtatttcatatgggctgcaagtagacagcatttgccatctcctggcccgaaaacacacctgggctgcatccgtgggccaaataactaaaacgaaaacacacctgggctgcatccgtgggccaaataactaaaacgaatgttgggacccactgtacctcaattatatgtgggtccagtaacaacctggttagccacatatacaatgtggggtcaatctagatagccacatatacaatgtggggtccagggaaaatctggatagtgccacatatacaaggtgggaccaataggagaatagatattgacttacatctgatgaaatatatttcagcataaattctattaataaaggagcatcataagtgagttacatgaatggtgcgcaacatttgtgacgaaattatctattgttttttgacgctattttaaatttcgtcatggagtttcgatgtctacccctgcgcatgagtgatccgtgacgaaacatgaattttcgtcatagatatgctctgttcaatgacgaaattatacaacgtcacgagcaaaacgtcatagatggacgatttcctactagttgcaggtaagttggagctgggagctagagctgtgccaaacagatcctaaacgtagttaataacaaaaacaaattacagattccgccaggaaactgcgagatgaatttattaagcataattaatctgtcattagcaaatgtttactgtagcacaacattatcaaatcatggtgcaattaggcttaaaagattcatctcacaatttacatgcaatctgtgtaattgttttttttcctacatttaatactccatgcatatatccaaacattcgacagcgtgaaaaattttattttgggaactaaacagggcctaagagcatcaccgagagactcaaaatttcatccccaaaatttagattttgggattattaaacagaatttgaggtttgaatacattgatctctcctagtgatagcctaaaattaacttcctaaaatttaaaagttccccatttaaaactaccaacaaaaaaaaatatttttttctctcccagaccgatgtgattccgaatcccggtcggccggcgacgatgttgctcgcccctccacgcgacagatctatttttcctcccctcattgacattagcaacaacatttagcagcattaggatgcaaggagcagcttcaggccttcagccaaagtaatcatcatgcggatcatcaaacaacgacatgtatcagcaaacatcagtagcaaactagtagcaattactatggatgtgactagacagctaccgatcgctgtgtaatcggatcgtagatcggatgagtagtttaagagaattttatttgaagcataggtggttcctatttgcttgatgaactattttcagtagagtaatggtttcag

SEQ ID NO: 60587 - DNA, 47062 bp, Oryza sativa
  unsure (1)..(47062): unsure at all n locations
tgtccctgatatggattttcacatgctaaggagaagaatcaggagcttcatgaattggtgtgattcatggctccacttagcacaatctgaacagtttagcaatcctttagttgaaattgtttctcaaaattttcaaactcaattaagaactactgaaaattttcaaactgagtgcaccttggccccattatctcaacaagctttgctggtttagcatgagatgagactctgtaaagtttatatgtcctaagtagtgcatgtccctagtcatgcatgtttccaatatcagctacctgtgtggatgaaattatctgccaatatcagctgattcaactgaactttcattgagtccttacatcttttctcgtccttttctctagcaaatcacataggattagttatctagccgggagagcaaacgaatggcaacccttggaccaagcttgattgctcccctgctgtggctccatgatctcagacttcgtcagagtatacagtaatgcactttcttcagaaattttcttgacagaataagctcaagtcacttaactcgatgttaaagccctgtagcgtatcatgtaaagctcatgattttgatctcttgagatgacatagggctccgttcgttaccagggattcccaacctccctcccgcgttttccacgcgcacgctttttaaactgttaaacggtatgttttttgtaaaaaaaaattctatacgaaagttgcttaaaaaaatcatattaatccatttttttaaaaaatagcaaatacttaattaatcaaccgctaatcgctgctccgttttccgtgctgtaggaaaccgttcccaacagtgagtatcgaacagagccatactgtatgttcatacatcgttgcctagttgatgactaaaaaaacataaatattaaggaatgacataatattaaataattaaaagaggtaaggcttcgaaccacaccttgtggagctcatcaactgagcttgtccagttgatgactgaagtgctgaaaattttcctggtctgaattaaaatacagtagtactgatatagtagtacatttcatatatgctgcagaccattgccttttacaaacaacaactgtgaattgtattattagagcattgagttctccggaaaaaaagagtaatgcaagataatggcaaaagtcacaaagaagagtgtagataattatagaagcatcattcgcagtttgaaaagaaaggaggaagaaccacttggttgattacgcgtgtatacataatctaccttttaaaagcaacgaacaaatgcttaattattttgagggaatcagattcttaattagaccaaaaaagcaaaaaaaaaaacaaaaaaaactgtttactgcttggagatcttgaagtgtccaccctgaacttttgactgcaaggttaatccattttgtccaccgtcatttcccaaccaaagttctctttcccctaaagaaaaacacacacaaaaaaaaaatttctctaagaaaaacacacgaaaatactattattttcaagtagtagaagtcaagcttccttgctttgctttgcatccgaccgttgggccagaggctccaagccaacggtcaccagaggaagaggtacactgtcacagtagcaaactccacaagcttccatctgccttcttccataggattcttcaacctctgctgcaccccgcagattaccagcttccatccatggctggtctcccctatttatacaccaactccttcccctgccagcttcgtctcccaaggcaagagcaacgcaaagcaaagaacagatacttcttctctccacctgcctcgcaagcttcttctgtttcttggatctcacctcgccacgccattgacgccataaggagcttgtgagaggtggtagccaagaaggaggaggaggagatggggttcgtgctggtgatctcgctgcccttcatcttcttctccatcctgctcggcttcggctgctacttcctcggcaagcacaagggccgcgaggagatgcgcaccggcgtcggcgcccaggtctacggcacgccgctgccgccgcccggcgtcggagcgccgccgccggagccgttcacggcgaagaaggacggccccgagaatctcgtctgatcagcctcggctgctgctgctgctgaatcggctcatttctttttcttgctatactgtactgttcgtgccgcggtggtgtacatgaagtggttaatttggttgttcttcatgttgagttcagtgtgataatttgtaatcacaatctatgtgtttctttttttcttttggtaaaatgggttcgaatccaaaatttgtaatcacaaattcgcaattagcgcccagacaagtgatttgattgattggctattggattgatccatttgaataggttctcttacttgttgctgatcgtggagacgaactcgaaaacgagttgtactctggttgcttccgcatatatgcgagaattcaacaaggtcaatttctccatccattgatctgccacaagagagagagagagagagagagagagagagagagagagagagagagatttccacctcaccctcgagcattttcagacaataattttgatttgatggatccgcttcagccttgcctcgtcttgcagcaagataaaaaccgagaattttcagcatctccgatgagaaggaaatcgaaggtggccgcgacattgccgccctgacgagcagcaaatcgtgggtgacgccgcaggggcggattcttgttcgcgacaccgccgccgcaaccacgttcctgcagcagaatcctcatggctcagtgctacttcgcggcgtcgtgctcggcggatgagagccggtttgtgtatagcaaatgtcaatgtttgtagtgtcattattgcaaatctccctgttcttcccaggccatgatggcgacgcgttcgtctaagatttccaacgtgagagatggcaatggtggagttcttgtagcttccagcggcccacagagtaattgtggatcctgcctactgattgagtagttgtttaggatttgtagtcacagcaaaaatgttcaggttttagcaaatcaacattgggggttgatacatttgacatttttttttgggtcaaatttgataaaaatatcttcctttgttaccagtatcttgttttcggactgtttcgatgtgtcattttgcatcaaacagtctattgtagcccaattatctacagtgcacaaatagcatctgaagaaattttgttagaaagaaaaagtatgcttcaggttgtcattaaagacagattttcatactaaggacctgtttgatacaactccaactcctaaatttagctctaggagttgggcctgtttggcacaactccagctccagctccacccctcctggagctggagctcagccaaacagtttcagctccaccaaaactgggagtggagctgggtggagctctctcacaaaatgaactagagttgtggagctgggtttaggcagctccacaactccactccagacctaacttagggcctgtttggtacagctccagctccagctccacccctcctggagctggagctcagccaaacagtttcagctccaccaaaactgggagtggagctggatgaagctctctcacaaaatgaactagagttgtggagctagatttagacagcaccataactccactccagactgtcctgtcacgccccgaactagtaccgactggaactagcccgtgacgctccaaattaacctgttaatcgataccagtcccaggaaacagtgctggtatcacaggaagacagattatcacagcaacagaggtctctttattatagagtagaggtacagtcatgttgggctgcggacagatcccgagctcacaactgcattacaaaaggggaatggaagccaggacttggatcaaacaatacaggcgtgacttgggaactaggccgaaaccctaaaactcatcgtagccggcttgctcctggaagaactcctcatcagcaggattcgcttcatcttcttcagcaactgggggagattatttatatagagcaagggtgagtacgggagtactcagcaagccatgggaaataagtgtttaatgcaggctttaagggaagggctgttgtttttgcaattgattttatttgaactcctttctgaaaacaactaggtgagtgcttctcaaacgacacggatgagacagtgcgtctcgtccggtcggagtatgtgcaatgtatcaatctttagaaatgacacaagattggcacctggccaacagcttttcaaccggccacccgggccaacaactttcaaacggccacccgggcctagctgatcccatcagctgcagaatctttcaaacatcgaacccctttccacaacagcaatttcacaagcggtagtcaaagaaaactacactaggaatcacctcacatccgcccatgaccgtgggcatggctgttcgaacagtttgttaacctctgcagagggggtacactttacccacacgacattactaacccggatcacctagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccagcccggcgaatccacatgtctctcggcatcaaggctcccctggtaagctagttactccgccaggggtgtcccattccacccatgtggtcgtacttgtcttatgtttggatgaaattccaaggaaatggtccttaagtgcgagagcgggaaaccgtacacccggtacgttccccggtccgcggttttggaaattcatttagttcgcaagcaccgacccaggtgtcgggttttccaagtcttttgtaaacccaagttttacccaagaagtttttcagattttaagtttgaaggcgtccgtcgatactcgcgcaggatgcacggatatcgagacgcaactagatggttacaaggggacatgatataacaattaacaaagggaggatcaaatgcagcaaattatgtaagtccgccaatctgccttgcagacgggacaacagattaagtgcgatcctatcagtgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaaagaaaagaaaagaaaatagggagggattatagacttttcctcgggcggctagggcgcggcccaagggaaaaggagcggaccggacgagctaaatgggccggccggcccaaggcggcccaagtgcgcgcgcgcgggaggggaggagagagagggccggtagaccaggctcaccgtgcgcggtcccgagtgggacccgcttgtcagcggctcggctcaccgtgcggagggagcacgcggcgcacgcgcgcgggcgggggagggacgcggtgcacacgcgcggtctgcggaggaacggatgcagcgggcccacgcgcagcctcacggcttgcggtggaacgcgcgctcgggaggggctgaccggggtcggcccgtcctgacctcggctgagctggcgccgacgtggcgcctacgtggctgccacgcgggccggcgggaggtagacgacgacgccggccggaacggacggcggacaacagcggcgagcggcggagcgaaccacggcgataccggcgaaagcgagcacaccgggtggttgcacgagataaggggagacgagccaacggctcggattcgccggaggaagcttgacggcggcgaatcgcggcggcggcaaccggcggggagggaagaggaaaacggcgacgaggtcacgaggggccgattcccggcggcgagagcatctacgcggctacgggaatccgatgctagcgtcggattgggcggagctacgccgagcgaggctggcgacgagcgggtgctacggagctcgagcggcgacgacgacgagcacacggcgagcgacggcaacggtcggggcggcgccggctagctacggggaggctactcgtgctaccaccgaaaactaaggggggaagatggagcgaggaggaagaacggagagaggcactaccgtgcgggtcggggcgcagtgacgagaggccgacggcgcgggagtaatctctccggcctcgggccggggaagaggaaggagagggcgcggccgaagtccccttccgcgtccttgctcgtgccggctcctccgacacgcgcaacgacgaacggcgacggcgaaacagagggatggcaatggcgcggtggcggcgagcgaaacgggagggggaatggatgggagggcgccttggtttataggacgacgatgtcggtttgaaaaccgaccttgggcggtcaaggcgcgagctggcactcggcgctcgcggccaagacggtgacagagggagggaggatgacgccggcgggaggaaaaggggaaaaaggagggggagaaaggggcttgcccccttgccgatttaggaaaaaggaggaggggagcgggggcgtcgcggcagagggaggagggctcggcctccgtcccttggcggcttgcgtgcggagtggcggggccgaggcgatgacgacggcgatgacggcggggcggtttggagcggcgcgacgacacgggcgataggcgcgggctggcgcggcagagagtgacggcggcggcgaccagatggtcggccactcggcacgcgcgcgcgggaaacaacgggagggcgcggcggatggagtggcgcggctcgggcacgcgcgctggctgcggggccgagcggctgcaggcgcggcagggcagcggggccgggcggcgcagatgcgacgcgagcaaggaccacgcgggcgcgcgcgcgaacgacgcgcggggagcggcatcgagggagcggaaatgagggctcggctcggcgcgggcggctcacgcgctcacgcgcgggcagagcgaagggagcggaggaggggcgctcggctcggcgcgggcggctcacgcgcacgcgcgggcagagcgaggttaaagggagggggcgctcggcgcggcggctcacgcgcacgcgcgcgcggcgcgcgggcggggcggagcggagcggagggagagggggaaagggagcgcgccgggggaggggagggggcgagagagagagagagagggggagaaggagcgcgccgggggaggggagggagagatgggccgagcgagattcggcccatcgaccccggaggaggcaaaatagacttttgcggaggaatttgatttggaaggatttggattcggatttgaacttgacgatagatcggggattgagatcttgagatggcacggacactagacaacaagcaaagaaacaaatctcgtaattagggtttttaagagataattttcccgctaggcgccacgacggaacgggcgccacatgtctcaaccaaattttgtggaggatggaactgtcttccactgttcccagtccaaactccaaaccgaagtataatacgtttggtaaatttgtctcaagtttcagaacatggacaggtgattttatacttttgctaaaaaaaaaaagattcagtcacactgtttggatttggattgagtacatcaaacatgtctcctttacatgcccggctgatgaattattcttttaaactcaaaataccaaaaggggacaattaaaattgtttcttccgagttctactcaagttcggttttcctttttcagagtatcgcgtttgcacgcagttatcgtaaaccaaatcagataagccacaagattttttcttgtttctcgcaagatcaatctagccagaaattacaagaaaccaaagcgacgtcgtcgccgtcaaaatttcttctttgtgttgggcggcgaaaacgatggacacgtcgagcagcggcgttcgtctaccctgcctcgccctggagcacgccggcggcggctccgacaagccggtgctgttcagcatctcggagaggaaggtcatcgacggcggcggcgacatccctgggctgacgaatgccaacgcctgggcgacgccgcagggctggatcctagtgcgcgacgccgccgccgccacgttcctgcagaaccctcgcgactcctacgacacgattcctctcccgcatctgccccaagacgacttgccgccgaggaggtgcacctgcctcctctccggcaagccggccggcggcgacggcggctgcgtcgtcctcctcgtccaccctttctccaccgtgttctggcactgccgcgtcggcggcgacggcgacggcgagtgggcgaagcacgagtacgacatcggcacgcagagcgtcgacgacgcgagcctgcgcgtcgagaaggtgccgatctgcccggtcgccgccgctcgccacggcgcgttctacttcaacgccgacgcggccggcaacctcggcgtgctcgacctcgcctccgcggcgccggcgttcgcctccctcgacatcgacgccggggagctgggcgacgtcgaccacgcgcacttcttcctggtggagtcccagggggagctgtacatggtcagcctggtgtacgagctcggcggcgccgggatgacggactgcgagacgcgggtgcacaggctctccgagcacgagcagccgccgccgcggcggtggcgcagggcgcgcgacctcggcggcgggcgcgcgttcgtgatggctccgtggtatttcgcggcgtcgtgcgacgccggcgagtgcgggctggaggcggactgcgtgtacatgttctacccgggggaggacgcgtgcgtgaagatatcgagcgtgagagagcgcggcggggaggagttcgtcggacttccaccggcgaacagagcgtcgtggattctgcacgttgatccatagtttcagcttggaattattaggtggtgtttggataattttagtcactgtcgtatcagatgattgacactaattacaagtattaaacgtaaactaatgataaaactaattgcataaatgagagctaattcgcgagataaattttttaagcctaattaatccctaattagcatatgtttatataggctaatcatagaatgagttttgtcgcctacgtttaatatttctaattagtgttcaaacatccgatgtgacaataactaaaatcaaccaaacagtcgcttatacttcatttatgtttggatttggccagtttatttttcttctcctttttgatattgtagcatactagcaaacgtgcttgtgggatgcaacgggaacaagttcatggttgcaatcaattactttcttccggttgcacctgttctcgaattagttagtaggtgatgatggcaacatgatgaagagtctatttgggaaagcttgtatcagaatccgaagctccccaaacaatctaatttttagtttaaattctgataagttatagttgtagaattcaaaaaataaactaaaagccagactaaaaaatccaaccttttcatattttgacaactctatattttcagattgtagcaactctacttttccaggccttgtttgtttcaacttagaattattataatatggattattagcaataatttgaaacaaatatgtagattattatgatacattattataatctataagctagattagtataatatgataatcttctctaaatgtgccttttcagattattaggtggctaaagaccattaccttacccttaaaagttttatgcaaattacccaccactgccatcgaacccaattgatcgagcacatccgcttcctctgatcctctctccctagtgtgcgcgaatccggtgcctcccccggccgtgtgtgcatccgcttcctctctccctatcgtgcgcaaatccttcccaagtccccaccctgcgctgcgcaaatccttcccccgagcccccaccctgagcccgactccttccccaaggcgcgtcgttgtcgccgtctcatccgttggagtatataaagtgaattgatcgtctttccctatcagtttaggcttttaggtgcaactggctggtgcatgtagcttaatatggtatcagagccagaggtctcgagttcgaatcttggctggcgcgcaattaaataaaataattgcagcccactctaatattccacgcttgagacttgagaggggtctcgcgtgagggggagtgttggagtatatatcccattccgcaatagctaagggcattaaagacattagccatttaaactcaataatatatgtctccgataattcaaagaaacaaacaactcataacttattataattctgtttatactaatctggtttaataatttggattacaataatcttaattaaaacaaatatgacctcagaatgttaagctccacatactagtacatgcccaaagaagaccttagctttgcttgtcccatcccctcccaaacgaacggtcatatgcgtggaatgcaagcccaaagccgcgggcatcttctagggcaagaggtctgaagccctgagcagagaggtgcccggcggggggcggcgtcacttgccggccggcgcggccttttggaaggcaagtgctcggtactagaaggtcgattattcaactgattcgacatgttctgatgaacttctgatatctgaatatctgatggtatttcagtaatccgatttgatcgactcggagtcggattctggttctgctctccaaagggctgtttggttcgcctatttaagatatcgccacgccacaagggtagtttctcttcatcgagacagatcttgctagatccatataagaagtagtaaagggtacgatactctctaggtgtcgccacagcttgcttgggagatttagagcacgatatttgggatggctcctctccctgtgccctgcctcgccttgcagcagcagcagcacggcccggaatcagtgaagacgacactgttcaacatcttcgagggacaggacatcgcctgcgacatcgatgccctgacgaacaacagcagcaaattctgggtgacgccgcagggttggatcctagttcacgacaaaacttcgctgtccaccttcatgttcagccctctgaatcctgacgagaaggttcagatgccacatctacctgacgacttaccaagaaccagctcctgcttgctctcggacaagcctactcttcctggctgcattgttctccttgtcgagcccaatgccaatgtcatctggcactgtggcgtcgacggcaagaagtgggcgagacacgagtacgacattggaacgcagctcttggatccagtcagtgacctgcacgagaaggtgccgatatgcccgatcgccgcttgccggggcaagttctacttcaacagcgagagcctcaccgacatcggtgtgctcagagttctcccccacgccggcgttcagctcgctcgagctcggtggagagctcgaggctgcgaacagggcgaaggtgttcttggtgggatccgaggaggagctctacatggtcagcctggtctatggctttggctgcgacatgattgacggtgaaacccaagtccataagatggatttctctgagcagcggtggtgcagagccgatgaccttggtggccgtgctttcctgctagctcctgggtatttcggtgcatcgtgttcggccgacgatcgtggactggaggcggattgcgtctacatgttttatcccggggataaggcgtgtttgaagatatccaatgtgaaagatggaggggtagaattcatggaagtcccagcggcaagaagagcattgtgggttctgcccacttatccatagtctaggcctaggtttctgcaattttggaattgtgataagtttttgttttgctgcgatattttgtcttgctattgtagatctgtaaaatgagtaatattcttaattagtattttgtacattttgcattgaactgtctattttagcccagttatctgctactacacgatatccctgagacagattttgttggaaaggaaaatgttcagtgtttcaggaatccctgagacaaattttgttggaaaggaaatgttcagtgtttcaggaatccctgagacagattttcacactgataattttagttcagagattgttctgaaccaggaacttcatgaattggactgaaccatggcatcacttgtcacaatttgattagtacagcaagtttgcaactttagattagatattgtttctgaacataatgatatattttttttaaaaaaaaatactgcactcagctgaccaatttcatattgccattcaccagcaaaattttgaggaattgtattccactcttccgggtccaatctttagtgatacgatggctaaatccatcgtcaatttcataacatggacaagtacaccatattaaactttgggcaactgctcaattgaagccgaagagctctaatgatgcttttgtgaacaacagtttgacatgaacagaacaaagccacccgttggtggtgataggactgtttgagtacatgctaagaaatacaaaagtttctattacccatctaaaaattgaatttctgctaccaactttttcattcactagaaaaaaatacccgtgtgttgcaacgggaaaaattaaaattacattaaaatttgggtaattaggattttctatattcatgatctgagcattattcatgcagatgatttgttatcgttcaatagcacttacacaagcatgtgcaatgccggaggtcctgtaacctaattttatcttagctctttggatgaagcataaccgatgaagttaaacgtgtatattaagggagttgattggactttttcctaaataggctacacatgtgcatacaggctccaatatgcgtgcacgtgggctaactgggtcaagtgggccgcaacgcgttgtatgatcttttttttttcgaacgaagaagaattgatcttttgcctccgattccgattacttctgatgtctgataatgttcgtgtcggaatcaacattcctctggcagcagttttcgcctatataagcaccggttttgcagataaaacattaaaagaagagaggaatagaggttgacaacaccacgctgactatggagaacgcaagcccagtcgtcagtgtccctgtgccttgcctctccatggagcaacgcgacgagtctgcagataagcccgtgctgttcagcatctccgacaagaaggccatcatcgacggcgacatcccggggctgaccaacgccaacgcctggttcacgccgcagggatggatcctactccgcctgagcaccgccacgttcctgcagaaccctcaggattcccaagacaagatccatctccctcatctaccagaaggcttgtctaccagatgctcgtgccagctttccggcaagccttctctccccggctgcatcgtcctcgtcgtcgagcccatcgccaccgtcatatggtactgtcgcatcggcgatgacgagtggacgagacacgagtacgacattggaacgttgcccttcgatccacccatcgatggaaaggaccacgatgatgtggcgatatgccagattgccgcttgccatggcaagttctacttcaacggtttcttcgacaccatcggagtgctggagttcaccccaacaccggtgttcagctcgattgagatcgtcgacccgaccccgggaggattaggggtgacgggcgcggcgcacgtctatcttgtagagtccgaggacgaactatacatggtgtgcttgcggattgactatgagtttaccatctacgatatgacagtccacaagatggatttcttgagccgtcaatggcgcagagccgacgagattggcggccgcgcattctttctagctccgttgtacttcggcgcttcatgttcggctgatgagtacgggcttgagaaggattctgtgtatgcctcgtatgcagtggataaatgttttgaggtatccaaggtggaagatgatgaaaccgaggtgcatgatctcattgatgctccagactcgaaaagagggatgtggattttgccggttgaaaaaaaagtagagatgataagagggagtaatagatgtgattgctacctccaaatttatttatggcattcaccaataaattaagatgcaagatactccctccattccaaattgatctgcatatagttttttttgaggttattcctaaatgatctacatatttgtgtttatttattaagtctattcgttatttgtccattggagtaaatggacattgatgcatgcatccatgcacacaagtatttataacccacatgcaatatcttaatttgctattggctaggaaatagtggggatggtgcatgcattgggtttgttgctagagtaaataaaatatgagagagttattagctttttttggtcttggtgtacctatgaaatatgtagatcaatttggaatggagagagtatacaataggtcacctctaatacacaaatatcaatgactttagtactctcacatccttcttgaagtttgtgtggggggtggttcatcatctctgtcctcacttctctcctccacctcatcacccaataggggcagcacataaaacattatagcacttgcactaatgattggaaaaaagtcagaagctatacactctagatggaaatgatgctcacagaaattataaaaatcaaaatttgtatatagctgatcgaaatggtgggaaacagcatcactaaaaaatgatacttggtcggtcggccgggaatttccgccgtcgtttttatttgtttttgcagcgtttggtgagtgcactatctgtaaagtgagtactattcttaatcagtacgtatcttgttttctagttaattgttcgtatttcgagtgcttgatgagagttaattagttaagtcatcatttcccttatgcccgggcgacacacgttttacgatggatgggtgtcaataaaaggaaatggattttttccctcgagggaacgtctcttcgttttatacatatcatttaaaaagttatcaattttttttaaaaaaatatcagattgatcaatatatgatatatctttttgcaaacatgcgagttaaatatcgacttatataattcaaaacacaattaacaaatttgaccgtgaattacgtgttctattcatagtcaaatttgttatttttgtttctacttgtataagttaaatttgaatttgtatgtttataaagtaacatatcacatattgatctatcctactaaactttttaaatttttttatgactttttaggtgacatgtaaaaatagggatatctccttaaaggatgaattgaggttttacgtcgatgaaatcaacattcctttcttccatcacactctgtaatcctatcttactataaagttatcccccactaagtactccttaagcttgacatgcaaagatgccacatcatcattcactaattaacaagatgccacattatcatccattaacaatcatcacatttaaacatcattcaaacatactatatatttatagtttttataatttaagagtttttcaaatacaaacatgttaaattatcatccaacataattcacataatatttcaatgtatatctgtattatgttttatgacattctatatacttatatagtttatcctcacttagttagtgcttaaatgattaatatatggttcaagttatctttctccatttttttcctcaaattaagtcatatcacagcctttagataattaatctacggtccaaactatttccctacttttctttttccataaagtcataccagcttactttttacgtttaaatcaccattctacatactatttaaatttaaattatcataaaccacattaatttacttaatctgatgttatctagctatcttacacgttattttttttattgttatcatacagcaatgcgcggggtttcacctagttattgataaacgcaagcccaaagccttgaaaacgtcattagcattctgccaaagctaagttaggacaaggcggcgggaaattgaaatcatccctcgaggagatatcccctcgtgtcatcaaaaaatatatgaaaaaaattaacaacatagattaatataaaatatatcactccacaaatatgtaagtttctcatcgatctttgattaatataaaatatatcaaaaaatataaaatagatcctccacgaacatgcattccgagtcgatccggcggcggcaagcgtctgacaccttggttccgtcggcggcggagggcaagagtccggaggaattcccgattcgccgccgtgcagatcagcgcgcgaggtcggtgttactttccctggccggtgccagcggtaagtttagcggattccgattagtaattctgatctctgattagctagtttcgcgtgagcttcggccagtgattgctgtgatcgactcggaatctgtctgtacgtactccgattgacacatctgcatgcccggcctatataagagatggttaagcacagttgcagttgatccaacgcgaggagaggagctaggcttttttttatcacaccaagccgacgtcgcatcaccacagttcaccatggacaagacgaacagtgtgccgtgccttgccctgtacgtgaagcacggcgccgactcagacaagccggcgctattcagcatctcggagaagaaggccatcaacaacaacatccccgggctgaccaacacaaactcctgggtgacgccgcagggctggatcctagtccgcgacaccgtctccaccgccacgtttctgcagaatcctcatgattcgaccgataagattcagctaccgcacctatcccagaatgtgcacagcagttccacatgtctgctctcctgcaagcccacgatgcctggctgtgtcgttctccttgttgagccagtcggcactatcatctggtactgtcacattggagacgatgacaagtgggtgaaacatgagtacgacatcggaacgcagccattggacccccccccccccccttggacggcaaggaccacgagaaggtgccgatatgctcgatcgccgctttccagggcaagttctacttcaatggtgacttcgaaagcatcggcgtgctggagttctcccccgagccaacattcagctccatcacaatcaccgaccccatcatcggaggattaggggtggtgggcatggcaaacgtgtacctggtggagtccttggatgaactttacatggtctgccaaatgtatgactctgaaatggagaccatctacgatgtcactgtttataggatggatttctcgaagcagcaatggtgcgtagccgaggacattggtggccgtgcgttcttgacagcttcatgctattttggtgcttcacggtcggctgatgagtatgggttggagaaggattgtgtctacgctatttttgcgcgtgataagtattacgaggtatccaaggtggaagatggagaaaccgaggagcacgagctcatcgaagctccagattcgaaaggagggacgtggattttgcccgttgaataaagtagagatgaaaattgtccaaatcagtaagaaatgacgtcgtctctatggaaacagagctgatagatattagaatgtaagtcaaaatttatatacggctagaataaaaaacttggtaagttgggaatttgtgccaccgtttcaactttcaaccccgttgaaagattgtaaatgtttttcttttcagtatagctattgtttattactccctctattctaaaatataaggtacaatcacccttaattcaaagaccaagaaacaattattaccacctctttatttgaatcgatccatacatgcacccaatagaattaaacatcttgtgagtgtatgatttaaaaaataataatttaggagagaagatatgctaattaattgtcatgcatgcatgcacgccttatattatgaaacacctttaaaaagtcgttgtgacttatattttggaatggagggagtacatgtttttgcaacgcttgatgagagcactatctatgaaatttacatttcgttttttttttgcgtactgtctactgcaagcataacaagatatttcgttgtaaagaaaaggttatgcacacacgaaattaatgattctggtgtattaaaaaaattgagtagtgaaccttgccatcactcatctcagttttattggtttagcattagtcagttcattttcacaagttgtctgtcgaccagaaccaagtagtggatttattggggaaactctaataatcccttaacgcgatatccccttatttttcgcgtcgcttaaaaatcatgaaaaaaattaaaaaaaagttagagcaacatgtgatatatcacttcacaagcatgcatgttcaaattaaacttatataattaaaataaaaacaacaaatttgacaatgaatagaatgcgcaattcactattaaatttgttatttttgtttcgaattgtataagtcgaattttaattgtgaaaagatatatcatatattgatctatcttaacagttttttataatttttttgatgactttcaaatatcatgcacaaaatgaggggatgtcccctcgagtgataaaaaaatccatctcgatttattgaaaacaaaatactgtacctagccgaataatgtcgcactgcatttgcccagttgcctctgaggatgaaattctttcactagttccaaatgaaagtgacacacttggtaaatctatttgaacttgtaaaagcagaggataggccgtaaaattccaggtaaacagtcatgtgtttttttatttcctgtttccaacctgaaaccgaaagattagagcattgttcctacctgatgaacaaagctggtatgcctgcttttactgaagtcctcgtctcggcgcgttccatggccgcctcctcctttctccgcagctaagctcaatccttctccgctgcgctcgtgctcacgggcgatcgcctccatggccgccaccgctagccgttgccccctctatgtcaccgctccggttcgcggcgtgggggtggaggagaatgccgccgcctgcaaggaatgggatgtggggaatacgatcaactcgtgcgtcgcgtcggcgtgggggggacgagatggacgcgatctcacctttttttctcgccggggaaggaggggagcgcggcgtcgactcgccttgtgcggggaagaagacaagaggggtggggtttgccaggttaaatgcctctgatcggtggcaatgaaaaaaataataaaaaaaaagtcgatcgtattttacattacactatttaccatccatatctttagataagatataggtccctatgtgtatatgacatggcaaaagttaaacatcatgataaatagttaagttaaatatctagggtgcgtgaggtttgacattggagagaggcttaggcggaggttaaggccctatttgagagagcttgtcacagctgcagctttttgctagaagctgccccaaacagtccacaacttctgagaatctgtagttacatattatgaaaaatgaactaagaagccagaagttggagaagctgagtttcagagtttttccagattctcagaagctgactaccaaacagctgtttttcagaatctaaagctcccccaaataggccctaagtttatgaacatttgtgaaataacggggtggcatgtgagaatttggttttttttttgacttctactttactttttagttgtataattacatattatcataatatatggatgaacaatgtggattgtttggggaggttgagattctcccaatctagatttttttttatttctagtctatcttttgattttatggttacatattttcagaatatgggcaagaaacttggaccgttggtgaacctagagattctagcagaagctctctcaaacatggccatagattgggagattgtgttcctgtgtgttcctgtgttggaggtggtgggttgagaatgcagtggcggtatggagatggcgttagagggaggaggtggattgagaatacggtggcggtatcagtttgtcactagaggatcggaagaaggattatgcttttcttacttgttggttccctatagcaatgtacttcctccgtttcacaatgtaagactttatagtattgcccatattcatatatatgctaatgaatctaattagcatctatattaatatggacaatgctagaaagtcttacattgtaaaacggaggaagtactaaccaagagcaagaacaatatagtgtatgatatcggcgttttggatagaatgcctacattatgagcgaggatatatttatataccattcaataaaatatttaatacactatttataccatttcgtacaatacatctgttctaaaatatagcaacttttggctatacatagagatatactcttgtttaaattaaatgtactgtggaagttgtaatattaaaagaccctcattgttatttaacaaaatagaatacaaagaaaacaaaattttggttttattaagggtagcgcagtaatcgtacaaaatacaaggacttgtgtgcaaaatatccttctctccggctctcccacaccaaatcctctcaccccccacctgcgccccgcgcctctcgccgccgccgccgccggcgacgacgaatttcttccacccgcatccccctcctcctagcaagctagccgacggcaacgcctcccggttccccctatgaactgacgtcgagacctcatcccggccgccaccagcgccaacgccgctcctcctcctccacgagccggtgcctggatatttctggatctgaggccggcccgtggctgcaggactgcgtgcaccattcttccgacccgacgttctgccgccgcgcgcctccatgccctccggatcaagctccccctgtattagggtggggttttttgcctgggttggcgagcgaggcaagatgctgtggtgggacacgctgctctgctctgctctggcgtacggcgtacctatacgagagaaccaagtgccgcctccgtcagccgtgaggtgctcatggagggcaagcccatccccaccgagctccgcaacaaagacctccaggaccaggaaagagcaggttagtgagctcctgtttctcaacgtttccgctccatctccatcgctgctgccttttctgcttcttctttttcatctatatggctgggtgtgtggtgaattttgcttcagccccaagtatccgcgtagacaatgagtattgacggtggcacgctccacgtgccaagattctcctggccatgtcttgcaatccgagcacggcttgcaatccaagcgtgcccctgatttagtttgtcgaggtgcggcggcctttgaccaggcaacaaattgttcttcacaagttgaattggacacatttggttgacaatgataatcagtaattactgtccattcgctaggaagtcaaacccataattcctgtctcgcaaagactaaactatggtagtcatatttagtatagttcaaaggcaaccttcacaattgaatctattctaaaaaagttcgaagcagtcactaatgaaaatcttgaactactttaattctaacatagttccagaaaagattggtgaagtatactttgaactattctagaaaaagtaatgctgaaggctgttgatgtgcttgctagcagtgagtgtgtcaatggtaccatctttttttttccctaagagggggatgataattcacaaacaaactgtgaattttggattctattcttctgtcttatttgggcataatttatcggttctcatatttaggtttgatcactgtaaaggaaaatgtctctggactcaagccagtgctccatggctttcatgtgcatgcacttggtggcaccactaatggttgcatgtcaatgctacattcatttctttcccccttttctttgtcaggagaaatggattgtggtgcgcgagttggggaaattgttctaaaagtgtaggaataatatactccaatccaactaggaaggaacatggggggcacaagaaggttagaaacgtcatgctggtggcgttggaaatataatgatttgaattggagcggatgcttttttttacagctcttttattgcttacattccaaaaatattttagtacacactgtctgcattggatgaaaatttgatagcttaactacaacgctgtgctatcttaacatttattaggtgttttactcaggtaggttctacagagacctagaaatctgagggacattagtgtgtctaagttatcttgaaatgtttcacgaaaatttttagtgttcaccccaagacatcattagtgtatgcctatgcttaatgaatgtcgttatccgcttgaatgaccaatgtttcttatgtttccttgtaaatcaaatgttatatcattgtctcttgtcatttcatgcagattttcacaccacttagcccaaccctgtttcatgtaatggcttcttgcttaataggccttccaagtaaagatggcataggctgagttgcaggatggaaatttatcaggagtcagctccactttcagtgaatccatccttctcctggaggaagagaagatacatgatgcagtgtatgttctttttattcgtgttctgacattgcatgaagtaacgcttcttatattttatttggaaattggaacgatctctatttttttccttctctcagtgagttcagttttctgaagaaaaaatgtgttttagtttaaacacaaccatttgtttagtagttaatccattacacgtttctgtgaaattttgatcattcgtaacactgttaaattttactttgtgatttgtaataatttcttctgcttctttttctgcagtggacaagttggtgaaaaaaaaggaattgaacttttgcaagatatactgaaataaagtcagtggttaagtctgataaattatctgctgcattgaagtcccctcatgcgtttctgcgcaaggtatgtagttgcatcgtttcctctttacacgcactgaaaaaagacatgttggaaagcctacaaccatagaagtttacattgtccatttttggattatatgttaattgccggaactgatagtcttcagatataatgcataagaatttatattcttgctagggagaaaaaaactcttcatggttttacgaatttcatcacttgcaaaatggagcagcaagttagccactatgggcacattcagttttaaattaggattctgatctgaggatttaggcttgcagggtacagaaatcagaattttcccatttgctctgcttctactggaaacataaaattttaaatgcttgtcctagaaccatgttatttcatatttaagcactatgctttatggtattccacatttaaactttttatttagggattggaggatattgagggggattaattccacaccttaatagatgtggaattaatccccttcgaaatcccccttgattcccttgtagggggattaactgaacaatgccttagtggtcancntnanttncanttccatnntgaaaaggaaataacttttggaaacaagtggccgtgaacttacataataatgcttggctttgttggcagatgatggagagtacaatggatgactggtcaatcagaaagggtcttcaacaaagtggaggtgtggttaaattatatgtacattcaaactaatatttatagatggctttggatgggatttcatggacaatgtttatatacattgtcactatttaggttagagaatacagaacaatacacactgtgtcatatttgggtacagggaccgctcatattctgggatgcattcttcagcttttgttaactgtgatgatgtagccttgagctgcagtcaacaacggttcctttcgattctgtcatgccaatttccccatccctgcactgtctttcacaattaagtcatccctatttttgtacaatgcaatgaacagctgcaagcatagttgcaagagtgatattttggttattcactaatatggtcatattatggtttgaagtttggtcaatttaattaaagagcacctatgttaacaaagcttccaattgtttttatattgttatgatcatgacattaacctgtgtggttgtacttttaattaatatgcacggggagtatttgcacgagcaaatttttacatgaagtttgttcatttgacatttggcgtcactgaatacaaatttctgactatgtatgtactatgttttaagattaccttttttaggttaattgaaatgaaggggaaacattcaatcaataataactaattggcatttcatgagacttttgcttgcgcagctgtgtgcggtagtagcaccgcgcttttcccttctaatactatccgcacactctatttcttttgaatgaaaaagacaggtggggttagaggctacacatgtcaaccactttttttttaccaactctctattttttttaattaaagtgattatatagggctaaagggtccacatgccagtaatagaaatacatacaataattaaaagatgatatacataggaaatgatgataatgcagattaatgatatttttgaaatcccattgcaatgcacacgcaatatggtaatatatataggaaaaagtccaaatcccccctagactatgcccaagagtccatctagcgtcccaaactataaaaccgggtatttagcccccaaaccttataatccagtccatttaaccccctaagctgtttcacaaggcggttttgcacatgtggtgggctgactggaccgtatttgccacgtcgtcatgctgaccaggcaattgcaaagtacaggagggaaaggtgaagtgatcgcgaaataaaatgagggagggaacgcacatcgctccatatatcattcttgcctcatcgtactccctcatcccatctcctaggtttcttctctcgagtgttgcgtctatgacgaccatggctgcctgatcacgcactgacgggaagattaaggtgatcgcggagtacatcttggagtaggtgagatccctgactcgattgcagtctttgatgcaagaaagtttcctccgtttttatctagggttttgtggtgattgttttactcacagtggttgacagcctccacgagggaggtatggaggcaagatataattagctttggtttctttagttttgttttctttttgttccgacattgaggtttagggctttgatgttttctgttgcatagtgcagatcgatgtgtgtaggatgatcttttttaatcttgtcaaatctaatataaattaaattaatttcgtcttttatcatgcagcacaagctagcaagaatgaataatttggagatacttcctgtcagattccattataatggggagttcgccaattctagaaggattgtgcaatacgttggtggagatgaagggatgttatatatagaaaatgataagatttctatgcctgaaattagaggacaccttgcagaccatgtcgaggtcaaggatgccatgcagcttcactggttgtttcctggaaaagaattaagcacatgattacgtttactgacagatgacaaggcatgctttgatatgtcaagttgcattgctgaaggtggagtggctgaaatttttgtggaggaaacaatgtcagattataattctaaagaaagtgattgggaaactgacagtgtgaaatctgatgagatggaaaacgtggaagggacacaatatgatgcaaacaaagaaggaagtgtgggagaagatagtgacactattgatagtgactatcaaccagaaagtggaaatagctcaccagatgatgaggaggtagtaaacctacgaaagtttgctgagatgtataacaaaaagttaaaagcaatgaggctaattctacaagatcctgatgcaaacagtgtgcccattgagttaataggtcatggagatgatagcttgaatgagataattgatgaacctacatatgattctagtgaaggttattcttatgacgatgatagtggtgaacacaacgaccatacagtgaggagaaagagtaggtggacaaggtatgactctaattctgctattccccatttttcggttggcatgacatttagagggaaagaggaaatgaagaaagctttacttaagtacggaatagtgaccaaacgacatatcgtgtttatcaaggatgagagggacaagatcagggctcctagatgtccttggctgatttatggttcaaagagaagcaaatgtgattggtttcaagttggtactctctgtgatgaacacacttgcccacctaaggaggaggtacacagtaaacttgcaaaatatgacatgccttaagtgctatttataagtcaggacaagccatagatggttttattgctcaatgctattcaattgaagagtacaacatatgatcattgcatggagcctgtggaaggagagaagtggcctacatcagatcaccccaagccttcacaacctggttatgtcaagatgcctggcaggccaaaaggaaaagctaggaagcgggagcctggtgagaaacctaaagcaactaaaatgtcaagagttggcacagttatgaggtgtgggctttgtcataaaactaagcataatagcatgggttgtccactcaataaagagagtggcaagaagaaaaatgctcttgtcacaggagctaatagaaaaagaaagcaacctgatggagcaacatcatcgactgttcatacaaaacaacaggcaatcacatctcccttcaactaactgcaaatttaatcctaatatgatttgtgtacattgcaggcatcacatagcttgcaaggagcaggggaaggaacaattcacaggctaggaaagacacctgtaaggagctccaagaaggtttcactgaagggcaagccaactggagtagcaatctgatcagcagtgcttttttgtgtttatacctgtattcttgtcaagatctatgttccttactagtttcctaccacttgtgttagtactctaaacctgaaaaacaatcaaatttgttggatgtactctgaacctgtaagcttgatcttgaacatggccttcgttcctgcacaattctcctgattacagtcatattataaagtaaaaatgtccaaatacaatcacatgaaaaaaatgagaaaaatgcgaataagataatcccaaaaggatacaacgtttgaattgcataataatatgcttactagattatacaatatcacttgggcaatctccacattacactcaacagtagagggataatagatgagcttcttttacacatttcattcctccctaatctatatgcatggatttacactgaaaaaattcttttctatcaccatgttctacagttcatatcacttggccctgtccatccttgccgtgcttgcggccggcgcgtcgagcgtcgccgtgcagcccatgcacctgccccgacagccacagaacttatcctgtagcctacaagctccgggaacgcatgagccccagcgccggcaaagatgacacatacaggatgctgcacgtacggctcctacctgtcgcgggcgccggggtcgtcgcgctcgccgtggctgcgcaccagcgccgctgctatgatttcccgcgctagagtcgcctcgccccaggtccggaatttgacgctgctactgacgtgcgggaagaactcgagatggggaatatgaaccctagagcgagaggaactctccctttccctcctgttacgaagtggtaaatacggtccaatcagcccgccacgtatgcaaaactgccttgtgaaacagcttaggggttgaaatgactggattataaggtttgaggggctaaatacccgattttatagtttggggactatatgaactcttgaacatagaacctgttttattcagcttagaattattataacctggattattagaagtaaagttgaaacaaacaagttaattattatgatagattattacaatctataagccatattattataatctaataatctcctttttttttgagcttttttcagattattgagtggctaaagactcactatttttagatgcctccaataatctagagaaacaaataaattacagtttattttatgtcagcttattataatccagcttagagtaatctgatttaataatctagattataataatcttaagttgaaacaaacatggccatagtttatgggagatttagactttttccatattatctgattatatatataatcaaataattgattatttaaatattacgtagataactaaatgaaacctattatctacacttactatttataaaaacgtaatggtcgtggtgaatcgtccactaatttttcgcaccttcctatattaccccatctttctctttattgaacctacaaagtcaaatgctagatcttctgtacgctcctctcttagaattattcgtacatactccccaatggtcaatcctttaaaatctttaaaaggcatacatttcataagtcacatgttttaaaacataataacacaaaaccccaccttttaccatttgtttcaaggaaccacatattttaaggtaaaatgtttcacaaaaccacatattcattcaaaatacttatacttcgttgtagtacacatatactcgcattaagggctgaacgtttctatactatacgctctatttccttcctacctcacaattcataatgggaaaattgttgatgcaaatagcatctcatgtacaaattacatataagcaaaaaaaaaaaaactcataattcatgaccggtgttctcttgagaaagtggctacatctactcagaaaatgcaacatattatttcttatacatgtattacgcgtaagtataatagccaatgaataatttaggcatatgaatgtaggttttattaaacgttttgccctaaaccccaggttccttgaaacacgctgtaaaatatgtggggtttttatgttacgcatgctttttttttattttgcgaaatttgctcaaataaaaaagaaaaacgcccagaacatcagatccgccacccgcaatccgccggccttgcccgtcacccacgacagccgtcgacggcccctccgcgcctccactgcctccgtccaagcggccaccgccgcgcgggcggacggggatcgcggcggactacggggacgccgcggccttctcctccctctctccccccgcgggaccttcccgtccccgccgatccgccgccccgtacgccgatcgccatctccgccgtccagtccgcggccccctacgccgatcgcgacgcacagcccccctctaacaaggtactgatcccctcatcgcagttaaggtaagcggattcgtcgcagttctatctgattcggtttcagttctccgcttgattcggtctatgatgttctatctgattcgatcgcagttcgtggaatttcatccaggggtttgtccgttgccatgaccgactcgaaatacgctgtggcactccgattggcatctgatttggactcgtcccaacccttcccaatttccccctcctcgcctatataagggagccactacggtggcagatcccacgaagaagagaggaatagaggcttgacaacaccacgcccacgaagaagagaggaatagaggtttgacaacaccacgccgactatgggaggccgtgtccctctgccttgcatcgccctgaagcatggcgccgactcagacaagccggcgtgaccaacagcaacgcctggccgacgccgcggggatggatcctgatccgcgacgacaccaccacgtttctgcagaacccacaggattccgacggaaagattcagctgccgcacctgccggaagtcgtgcacaacagatgcgcatgcgtgctctccggcaaaccgacgatcccaggctgcatcgtgcttctcgtcgagcccgaagacaccatcatctggtactgtcacgtcggaggagaagatgaggagtgggctagacatgagtatgatattggaacacagcccttgcttccactcgtggatggcaagggccacgagaaggcgccgataacctcgatcgctgcttgccaaggcaagttctacttcaatggcagattcaacagcatccgcgtgctggagttcaccccagagccgacgttcagcttcatcgcaatcacggaacccttggatttctggggcgcagctagcgtattcttggtggagtcagagggcgaactatacatggtaagccagctgtttgactacaacctcgagtacatctgcgatgtcactgttcataagatggatttctccaagcatcaatggtgcacagccgaggacatcggtggtcgtacgttcttgatagctccatgttatttcggtgcttcacgttcggccaatgagtgtgggctggagaaggattgtgtctacgctatttttgtgcgttataaatattttgaggtatccaaggtagaggatggagaaaccgaagagtatgatctcatcgaagctccaaattcagatatagggatgtggattttgcccaccgtctagtttcacaattgggaattttatcatcttttttgcatggaaagaaacatgttttttttatccagtgtaaccgtagttaattatttgtatttccaactttagtaagctatatatatgaaacagtattattggtcacacatcaatcagtgttacaagaatttttgttggaaagaaagggagggttcgttgaaagactgtacagaaatattttctctagtgtagccattgtttattatatgtttttgtagcgcttgatgagtgtgctatatatgaaattaagtttttttttctgtcgtactgtccactgaaagcataacaagatatttccttggaaagaaagggttatgcacagagatagcacacaggaaattgatgactattctggtgtattaaaaaccgagtaccgaaccttggcgccactcttctcaattttattggtttatcattatttagttcatattcatgagttgtttgtcggccagccagctgaataatgtcacactgcatgcatgtgccaagttacctgtgaggataaaaatctctccctagtttcaaatggaagtgacacacttggtaaatctatttgaacttgcaaaggcagaggataggccgtaaagttccaggtcatgtgtttttctgttcctgtttccaacctgaagctgaaagatggagcattgtgcctacctgatgagaaagctacatgtgcaggctggaaatttttcatccaaattgttagttgttggtttccatttccccatgagtagttggagtcttggagcactagatgttattaggagagaaaaaccagcacaagatattagatcgatggaccgatggtgtttcgtctcactatttgctttggtagtttgcttggctaatacggccgtcattagtttgtaatatcaatttgatttgactggctaatttcgtactccctccggcttagtaaaacttattattttaaacaacgacacgcggttaaaaaacgatttcaacaactattttttattacaatatatataacaacatcaataaatatataatttattgaagtacttttaggactaatctaacattctgagatgttattttagtcaaagttgtaaaagtttaacaatatttttgttcaaaataataagtattactaaacccaaattgtaattagtggtttgcatgtgttcagattaaaaaaaaatagctaacatcacctcgccatccccgttgccgtgccgctcagctatctcaacgtggatgcctcacttgatttgggaggagagaccgagaacaggagcatgggaggagagtgaggatgatatgtgaggcccggtttgtttttgccatgtaagcgcgtagtcagcacaagtggatcggatcaacttgccacgtcagtagaaaacaaccatctatgctgcgggagggcctaatctatcccagttttgcaagtttgggggtcaaaatttctggtatcgtggtccaaggatacgatttcaaactcgatgtcaagaggagggacctaaagtaaacttattcctattccaaaacaccggttcactcactcttgggccggcgaagtgaaccatgtgagaagtgaaagcccatacttggtttggtcggtgaggcctcgagccctcgactcccggacgcctcgcctgcgtcgatctccatccatcgccgccggcgtccgcggcgtctctctcgctggttggctggtgagtctcatgatcatccatcccttctttctcatctctctctacttattacgttcctttctcgaatttgcgttagccctagcttctcttctagatcttggaagcttttctctttgcctgccgctgtgatcacaaactgtgtgtcgcttgccataactgacatgctctttgatttgtgctagaatcgtgtgcctggctagcttgtttcagatctgtgctgaaataaagaacaatattagtatatgttaaatcgagggatggataagtttgttttctgatgaaatttgcgtgcttctataaattattcttgatttttctttttgaattttcaccggtgggccggggatgaatttcatttcccaaacgaaaaaactctgtacaggcaacgggcaaacaagactataaattcttcgttataccctctctagtcattgctcgctcgctccttgctgttattgattgctcaaaaataatccagatttctcacccttctccattgaatctctacttctcctttttgagtgtcagtcaggctaccaacgaagagaaaattaatttaagtcgctcatccggtttgttgacttgtggaatgatttctctatcccttgattggaccttcaggtcaaggaagcgtgagtgttgaagatgagctgcgagaagttgagccgtcagtctctgcatttggtgttgaacgagggtcgcggcttgttctcgctaaggcacatggacgtatcaaagctcttctacccatcaacggcagaagcactggaagcagaggctaaagctaagaagaagaagaatggcaccaacaaaattgggagcatcggccgtttgccaacaccgagcatacactaccagccatatacgtggtctgcgtctaatccctacagttcactgtgtgcacttgctctctttggtgagaggagcaagaacaagatcctctgcacggacatggcaggccacaccagcatctacaaccccgagttgcgctcattcatgagaatgcctgatctgaattcgcccaagagatacaatagttgtgtggctgtctccatcccaggtgcttctgcccatgccatgtccaactttgacatcgacacagaccacagcctgtacatcatggatatcgatcctacctactggtgtagttctgaggtgcttgcctatgatcctgtggaggagtgttggtgctgggggccactcccgcagccgccattctttcaggaccgagagtataaggtcccccttaagcctcgcttcatggtggtcgatagcaccaagatatgcgtgtctaccaccacggcgacctactcctttgacatggtgacgagagattggaataaggtgggtgattgggtgctgcccttcaatgccgagtatgtccctgagctgggccactgcctcggcatgtcggatggcggcccctttgacctgtgcatcttggacaacctctccaccgccgcaggctctcctccgccggtggtgcggcatgtcgggatggagtttgagctgccggagaactggtctcaggtgtaccgtgacctggtgaaccttggatcactgaggttttgcattgtcaatggctacaccattgaaaacgagcggtacgagtgtgactttaacccagtgactgtcttcaccggcgtggaggtgttgccaacaagcagtgaacaggggctccttatgatcaagcacaagtccaaatgtatcatgacttacatcatgttcgtgctctgaggtcatcgattggtcctcaatatttatccatgtttaacctactgggagaagtaggttcataatagccagtaggaggacaaatgctgcacgcagtgattttgctttaatgtgccatctatatatccatgttactgttgtactagtgttttattttttttgtcgtaaggactatgtatatcttagcccttgtttctctgccgataaaactaatatatgcaagcccaaaggtctggaagatttttggttccgatttgccagttgccgcgcgccgtgcagatctttgccaagacggctggtgcgggaatcgcataattgatttctgtctccgattccgattgcttctgactcgtgctgaaggctaccaaggatcgccatcaccgacacgaactaaccttgctcagcctgcagttttcgcctatattagtgcatgctgggtacagtttgcaaatccaacgaagaagagaggaatagaggttgacaacatcacaacaaacgaaagaagaagaagaggaagaagaacatcacccaatcatggacaacacgagccgcgtctccgtgccttgcctctccttggagcaacgcgacgactccgcggataagccggcgttgttcagcatctcggacaagaaggccatcgacggcggcatcccagggctgaccaacaccaacgcatggttcacgccacagggatggatcctacttcgccagagcaccaccatgttcttgcagaacccacaggatccccaagataagatccgtctacctcatctgctagaaggaggcttgtcgaccatatgctcatgccgtctctccagcaagccatctctccccggttgtgcgtcctcctcatcgagcccatcgccactgtgatttggtattgtcgcattggcgacgatgagtggatgagatacgaatacgacattggaatccagccattggatccgcccttcgaaggcaaggaccatgagaaggtgccgatatgccagatcgccgcttgccggggcaagttctacttcaacagcaactttgagaaaatcgaagtgttggagttaacccccacgccgacgttcagctccattgagatcgcggactctattgccggaggattaggggtgattggcggggcgtatgtgtaccttgttgagtctgaggatgaactatacatggtctgcctgcggcttgaccatgacttcaccatctacgatatgaccgtccacaggatggatttcttcagccatcaatggcgcagagtgtatgagattgggggtcgtgcattctttctagctccgttctattttggcgcttcatgttcggctgatgagtacgggctcgagaaggattctgtgtatgcctcgtatgcactggataagtgttttgaggtatccaaggtagaagatgacgcaaccgatgtgcatgagctcatcgatgctccagactcgagaagagggatgtggattttgcccgttgaaaaaaaaatagagatgttaatgtttggatacagtcggaaaactatataatctctatgaaatcgatgttgatagaaattgaaaaattcaaaatttatatatggctagaattggaagcggcatcacttgtacaaaacatacttggttggaaatttccgccaccgttttgaaccctagttgaaaggttgtaaagaagaatcattttccgaatgtaactgatttattatttgtttttgcagtgcttgatgcctgcactatatatgaaaataatatttcttttctttttggggtactttctactgagagcataaatattccgttggaaagaaagggttatgtacagagagaacacacaagaaaatgatgacctttatttttcgattattaaattgataaccaccttggcaccactcatctcggttttaatggtttattagcattatttagctcatattcgtaagttgtctgtcgaaaacaaccaagtagtggattcactggaaacaaaatactgtacctagctgaatttttttttcagtgtagctgtaaaattccaggttaacagtcatgtgttttttgttcctgttttcaacctgaaaccgaaagattagagcattgtgcgtacatgatgagaaagctgcaactacatgtgcaggctggaaattttcattcaaattgttagttgttggttcccatttcccccatgaatagttggaggcttggagcattttagatgttcctacctgatgagcgaaatctagcatgagcacgttttactcctgtccaggagccgttcggaatccggttatactccggacggctgcttgattccgattcggctgcaagttccctgcccagatgaagtataagaacacgatatttgggatggatcctctccctgtgccctgtctcgccttgcagcagcagcagcagcacggcctggaatcagtaaagacgacactgttcaacatcttcgagggacaggacatcgcctgcgacatcgatgccctgacgaacaacaacagcatccctgtttcttgtctcttttacctcaccacgaaaattggccttttgcctccaattccgattacttcagatgtctgatctctgatgagggatcgccggccgtgactgactctgagtcggaatcaaccctgcttaggtagcagcttcgcccatataagaggagcacagagcacgatttgcagatccaactaagaagagaggaatacaaggttgacaacaccacgccggccatggacaagccgagcggccgcgtctccgtgccttgcctctccatggagcaacacgacgagtctgctgcagataagccggcgctgttcagcatctcagacaagaaggccatcgacggtgacatccctgggctgaccaacaccaacgcctggttcaccccgcaggggtggatcctactacgccagagcaccgccaccttcctgcagaaccctcaggatccccaagacaagatccatctcccagaaggtctgtcaaccagatgctcctgccagctctccggcaagccatctctccctggctgcatcgtcctcctcgttgagcccgtcgccaccaacatatggtactgtcgcatcggcgacgatgaagagtggacgagacacgacgacgacattggaacccagccattggatccacccatggatggcaaggaccacgagaaggtgccgatatgcgagatcgccgcttgccggggcaagttctacttcaactgcttcttcgagagcatcggagtactggagtttacccccacgccggtgttcagcaccattgagatcgtcgatcctatccccggaggattaggggtgataggcgcggcggtcgtgttcttggtagaatccgaggacgaattgtacatgatctgtctgcggcttgaccacgacttcgccatatacgatatgaccgttcataggatggatttcttgagcttgcaatggcgcagagcctatgaggccgtgcgttttttctagctccgttatacttcggcgcttcatgctcggctgatgagtatgggcttgagaaagattctgtgtatgtctcgtatgcactagataaatgttttgaggtatccaaggtggaggatgatgcaactgaggtgcatgagctcatcgatgctccagactcaagaagagggatgtggattttgcctgttgaaaataagtagaaatgaaaatattcggaaactgcctgaaatgatatcatctctgtggaaacgggttgacacagaaagcagaaaaaattatataagactagaattggaaatggctgtcacttctagaaaatttatttggttggtccaaagtttctgtcatcattttcaagcctagttgaaagaatgtaaaggatttttttctcctaatgcaactttagtttattatttgtttctgcttgatgagtgcattatctatgaaattagagtatttttacggtccaacagcctgggtaggtaccaaatctacaccattcatttaacttgatcggatggctgagacagattcagtaccgggcagtaccaccgatcgattccatgcagtaccaccgcctgaagggcattttcgtaatttcgcgtagcctcagttcagatcagatcggctcagccagccgcctgcccgttctccatcccaggttctgagcttttttgcagcggcatcaacggcgtcagcccacaggatttgggccgacgacgagctacaggatttgggtcggtggtaggctgcgggatccgggtcaacggagtgcacgaagccgacggcggcggcgatgggctgcaggatgcgaagcggcagcgggctgcaggatccgttcgagggtgtgcgcgaggccggcgtcgatggcggatgggggaacctagctggcgtcgacgggctggcagggatctggccgccggcctctgtggtgcgcggcggccggcggggccggcgtcgagggcgacggcggcctgaatgttaagtcgacctgacaatgtttccaatcatgcccacggtaattgaacggttggatttcatttggtacctgatgtaccatctgctggaccgtaacaaatctcatgaaattaacatttttatatttttttccatcgtactatctattgaaagcatgagaagatatttcgttaaaagaggggactatgtacagagagaacacacggaaaattgatgacctttattttggtttattaaaaactgagtagtgaaccttggcgccactcatctcaattgtagtaatgacttagcattatttagttcatattcctaagatgcatgtctatcgaaaacatccaagtagtggattcaggggaaagaaaatactgcacgtagctgaatactcgtttttttatgtcacccaaataaccataattttttttaaaaaaattaacaaaatagattaatatgaggcacattgtccacaagcatataaggtcaaattcgacatttacaggttgtgataaaaataacaaattaaatatatacattcagtcatatttgttactttaacttgtatatttgtgctgtaaaatatcttatattaaactatcttgttaattggtttttaatattttagtgcacatgcaagaaataagttgatgtcccattaagggattaaaacacttttcttggataatgtcacactgcatgtgcccagttacatgtgaggatgaaattctctccctagttccaaatgaaagtaacacacttggtaaatatatttgaacttgtagaagagggataggctgtgaaattacaggtaaacagttatgtatgttaatttgttcttgtttccaccctgaagccgaaagattagagcattagctgtcctacttgatgggagagctgcaacctacttgttgatgatcagcaccgagaggtgaggacatcagaacaagtcgcttcagaattcagaattcagaattggacttggaaaagaagagaacgcaagaacctgatagtagcagcgcattgcaaccagaacttctgaagagtgaacaccagttatctgaattttaatggtttataaattacttatcacaaaacataaattacttatttgtctcaaagatgtctaatgcaccaaatattttaaatactgaaactctgtaaagttatcagtcaaaaaaaaaaaacctctgaaaaggggcagttctttggagggattggagatttaggagaaactcacacccgtcgctattactgtgattatctgtaaaactatattaaccatacttttagagactttcctctcttgcgatcacaatcaaaatcagaaaaggaacagaagacatcaaatccgtttccttgttaccaaaaactgaaccacatgaccgctgctataggaaggcgatcgatcttcttgtgactagttgtgagttgtgaaccgactctgaagccgactcgtctcgtcgtctgcaacacggcactgaatcggagtcttcgcctagagtatgtatgtaagagagccaaaagcgttgctacctgcagagatccaacgccgcatactcacatcgatcaccatgatggacaagacgagacatgtccctgtgccttgcaacgccctgaagcacggcgccgattcagacaagccggcgctattcagcatctcggagaaaaaggccatcgatgcctacatacccgggatgacgaacagcaacgcctggccgacgcagcagggatggatcctgatccgcgacgacgccaccatgtttctgcagaacccacaggatcctgacgaaaagattcatctgccgcacctaccggaagtcctgcacagcagatgtgcttgcgtgctcgctctccgacaagccgacgatccccggctgcatcgtgctcctcgtcgagcccgaagacaccatcatctggtactgtcacgtcggagaagatgaggagtgggttaggcacgagtacgatattggcacgcagcacttggatccacccatgaatggcaaggactatgagaaagtactgatatgctcgatcgcagcttgccaaggcaagttctacttcaacgccagattccacaacatcagtgtgctggagttcaccccagagccgacgttcagctccatcgcaatcaccgaccccatggattttgtgggcgcagcatgcatattcttggtggagtcggagagcgaactttacatggtatgtcagctgcttgagtacgacttcaagactgtctacgacgtcactgtttataagatggatttctccaagcatcaatggtgcatagccgaggacattggtggccgtacgttcttgatagctccttgttattttggtgcttcacgttcggctgatgagtgtgggctagagaaggattgtgtatatgctatttttgcgcgtgataaatattttgaggtatccaaggtagaggatggagaaactgacgagtatgatctcatcgaagctccaaattcagaaagagggatgtggattttgcccattactgggtagtctagtttcacaattgggaattggactttgttttatcatatatttcacctgtaaagaaacatgttcttaatcagtgtaaccgtagttaaattcgtgtttccaacttaatgagctatatatatatgaaacaatactatcgttcgtgtatcaatcagcatgacaagaatttttgttggaaagaaagggagggtcagtatttctaatgtgtgacacacagaaaatgcaggaatttgataacttaactttgtatactggtttagctagcatcgtttactttgtaagttctgtcaaaagagccaacacttgattatgtggaaacaaatgactacctagcagtgcatgttgccaaagccggccacctgtagatggaattatattttcatgcaaattattagtttttggttccctgaatagttgggtgttcctacgtgatgaacaaagcacaaattactttgtcgatcagcttctgaagaggagcaaaccctgcagatccagcacatgtacttccttcagaattcagataggcctgattaggcccaaaatgggaaaacgtctgtttatgcaagcccaagcccaaaattggaaaaacgtaagcatctggtctctgatttttcatgtcgtgtcaggctgcaattcgtggagcttcaggcagggattgctgtgaccgactcgtaatccaccgtttgtactccgcaacatctgaccttgtgactcgtctgcaaccagctagcaatcccctacataagagaggcttcggttcggttgcagatccaacgaagaggataggagatagatcagccttgatcaccatggacaagacgagccgtgtccccgtgccttgcctcgccctgtacctaaagcatggcgccgacacagacaagccggcgctgttcagcatctcggagaagaaggccatcaatggcggcgacatccccgggctgaccaacaccaactcctgggtgacgtcgcaggggtggatcctagtccgcgacaccgcctccgcaaccacatttttgcagaatcctcgcgatttcgacgataagattcagctaccccatctaccccaggacgtgcacatcagttccacatgtctgctctcctgcaagcccacgatgcctggctgcgtcgttctcctcgttgagccagtcggcactatcatctggtactgtcacattggagacgacgagaagtgggtggaacatgactacgacattggcacgcaggtcttggaccctcccttggatggcaaggaccacgagaaggtgccgatatgctggatcgccgcttgccagggcaagttctacttcaatggcggcttcgaaagcatcggcgtgctggagttctccccctcgccaacattcagctccatcgcaatcatcgaccccatcattggaggattaggggtgatgggcatggcaagcctgtacatggtcgagtccttggatgaactatacatggtttgccaaatgtatgactctgacatgaagaccatctacgatgttactgtttataggatggatttcttgaagcaacaatggtgcatagccgaggacattggtggtcgtgcgttcttggtagcttcatgctattttggtgcttcacgttcagctgatgagtgtgggctggagaaggattgtgtctactctatttttgcgcgcgataagtattttgaggtgtgtaaggtggaggatggagaaactgaagagtatgatctcatcgaagctccagattcacaaggagggatgtggattttgcccgttgaaaaaaagtagagatgaaaactgttcagaactgtaggaaacaatatcatctctatggaaacaacgctaatagaaattagaaaaatcaaatgttatatatagctagaaacaaggaaacgaatcatttctatgaaaatgatacttggtcaattggaatttctgccactgttttcaacctgtagcgtccgttccgtcgtggcgcctagcgggaaaatttaaattctaaaaaccctaattgcgaaaattgtttcttcgcttgcagtcagtctccgcgccattccggatctcgaatccccgatccatcgtcaaatccaaaccctaatctcaatcttccttcccaaatcaattcctctgcaaaagtctattttgcctccctcaggttcgatgggccgaattcctctcggcccatctctctccccatctctctctcccccctctctctctctctccctctctccctcgctctgcccgtgcgccgcgcgcgcgtgcgcgtgagccgcgccgagccgagcgcggagagccctcactgccgcttcccgccgacgccgcccaaatcgccgcgccgcccgttgcttcccgcgcgcgcacgccgtggtggccgaccggccagtcgccgccgccgtcagcacctgccgcgcctgccccgcgtttgccgcccgtgtcgccgctccgctccaaaccggtccgccgtcatcgccgtcgtcatcgacccggccccgccaccaccgcgcgctagcttccaagggacggaggtagagcccctcctccctctgccgcgtcgttctctctccctccttcttttcccaaagaagcaaggaggcaagccccatttccctcttcctttcttctttttcctcccatcgctggcgtcaccctcccttggaccgagcgctactcgctcccttgaccgccctaggtcagttcccaaaccaacatcgcctcctatttaaccaaggcgacctcccatcgattcctcccccccgtttcgctcgccaccaccgcgccattgccgcccctctgtctcgcctctgccgttcattgccaagcgccgggagagccggtgcgtgcgaaggacgcgtgaaggggactccgggtgcaccctctccttcctcttccccggcccgaggccggagcgatcacgccccgcgccgtcggccgtcgtcactgcgcccgcccgcacggtagtgcatcttcccgttctccctccttgccccccctcttcctcttagctttcggtagaagcttgtgtagcctccccgtagctagctggcgccgccccgactgctgccgtcgctcgcagtgggctcgccgccgtcgccgcccgagtccggtagccacctctcatcgccggcctcccacggcgtgtttcctcctaatccggcgcaagggatggattcccggagtcacgtagatgctctagctcgcccgaactgatctcccgtcgcaccgtcgccgtttccatcttctctcgccgccggatgccgccgccgcaatccgccgccgtcgaactccatccggtgaatccaagccgttggctcgctccctctcgttctccctcatcattccggtgtacaccccgtcgcccctcgtcgtcgcacggtgtcccggagaaaccgccgctgcccgccgtccattcgcagccggcgccttcgtcttcctccagccggcccgcgtggcagccacgtaggcgccacgtcggtgccacctcggcacgaccggatcggctgaccccggtcagccgcttcctccggccccgctcgcgcgcgcggtccaccgcgagccatgaggctgcgcgtgggcctgccgcatccgcgtccaccacgaaccgcgcgcatgcaccgcgcctccctccccaaaccctagcacgccccacgtgcacctcgctcacggtgagccaagttgccgacaagcgggtcccactcgggaccacgcgggatggacccgacccaccggctctctctctctctctcctccccgcccgcgcgcgcgccttgggccgccttctcgggccggccggcccattaagctcggtcgagccgcccctttctctcgggccgcgccctagccgcccgagggaagtctaattcccttccctctttcttttcttttcttttctcaaaaaggatttaaataaatcctctttctttagatcaaaaatctaataatcttagaaattcaatatctcctcaaccgtatgtccgtttgactccgttcaacttccaaaattcctcaaatcttgagatctatctaatggcacgcttagaggtcaataatagggctttattttcgctgtttgttgagttatcccgttcggcgtgtagtttcggagcctgaagacccgcagtgcgaggatttcgaggatcaagctcaagatctcgagcaaggcaagtcacctttgatcagcttgcacctataaattaaatctaagtatttctttttgcaaatattgcatgaataggattaacacaagtaattcggccgcggcttgcgagatagcccgccggcccccaaacctaaattgctgcaattaccctccgtgaattattgaacacttaaccctcctttgtcaactgttgtgcttcgatgtatgggccttcgggcacgcgcatcggaacaccttccctcaaatttaaaatatccaacgatgggtaaaacttgggttttacaaaagacttggaaaacccgacacctgggtcggtgcttgcgaactaaatgaatttttccaaaatcgcggaccagggaacgtaccgggagtacagtttcctgctcttgcacttaaggaccgtttccttggaatttcatccgaacataagacaagtgcgaccacatgggtggaatgggacacccctggctgagtaactagctaatcgggggagccatgatgccaagagacatgtggattcaatggggtggtgtcggggagaacccccaggtttcctggcacagtatggtctgggacctaatctggtgttggtctgggacccctctcgttggcatatggtgaacctgtgtctgctctcgaaatgccttgtcatgaaagcccttaggtcaccagacgtggccgttctgcatgggctggatgatccgggttagtaatgtcgtgtgggtaaagtgtactccctctgtagaggttaacaaactgttcgaacagccgtgcccacggtcatgggcggatgtgaggtgattcctagcgtagttttgtttgactactgctttgtgaaattgctgttgtggaatgggttcgatgtttggaaaatctacggctgatgggatcagccaggcccgggtggccgtttgaaagctgttggccgggtgccaaccttgatcaattcaaaagactgatacatcgcacatactccgatcggacgagacgcactgtcccatccgtgtcgtttgagaagtactcacttagttgtttcaaaaaggagtttaaataaaatcaattgtaaaaacaacagccttccccttgaagcctacattaaacacttatttcccatggcttgctgagtacccctgtactcacccttgctctatataaataattccccccccccagttgctaaagaagatgatgtggcccctgctgacgaggagttcttccaggagcaagtcggctacgatgagttttagggtttcggcctagttcccaagtcgcgtctgtcatgtttggtccaagtcttggcttccactttcccttttgtaatgcaattgtgagctcgggatctgtccgcagcccaacatgactgtactcctactctataataaagagacctctgttgctgtgatatactgtcatcctgtgataccagcactgtttcctgggactggtatcgattaacaggttaatttggagcgtcacgggctagttccgctcggggctagttcggggcgtgacacaaccctagttgaaatactataaaatctttttttctagtttaactctagtttattactccctccgttttttaatagatgacgccgttg

SEQ ID NO: 60588 - DNA, 894 bp, Oryza sativa
agtcgaaaaaaacaatacttcctccgacacagaatataggcagtttttaggtgggcacgaatattaagaaagtagatcgagatgattggaggagggttgtgattggtggagaggagaaagtaggtgaaaagaatgtttgtgattggttgagaagagagggtatttggagaaataacttcattttaggacaagttattgcgctagaaatagctacattttggaactgaggtagtaccgcagcattcagatacccagtacgtggacagtagtagtcagtagtaccacgaaatggcactagtggttaaaatgacccggaccctacctgactgttgcacggctgtgcgcctcccaaacaacctcacagtttcaataacagcacgcaaatctggataggcgggtccaacacaatcatcattgtactaacctttacatgtatcagcaatgaaaataggaacagtacgatagtacctgcaaaatataaccaactagctgtacagtagcggacactcagtcacgcagtagcacggaacataggcaaggacaaagcaccaagcgggccgtcgagcagagagataagataaataaagctacgattgttgattggcttgtggtgagtatgttaccgtcggggaaaagaggccgggggagcccccgaggaacgcggtggggctgagtccgtgcggcaccgggaacggtgagggcggaccgggggcggaggcggcggggtagcccatggcgccgacgaggagctgggtgaaagagccctggaaggccggggagggcgcgtcggggaagagcgaggcggcgagagtgagcgcgccggggctggactcggcggagaagagggaaccggccgcggatcgcgggggcagcgagagcgtggggagcagcggc

SEQ ID NO: 60589 - DNA, 663 bp, Oryza sativa
tgcctttaatctgttacctagaaactatctacactgcacaatatttggtccaaaagccgattttaacttagatcaaaaccagcttctgcatttatcgcgtacaacaatttgctttccaattgtgtcttgctgttcaaagaacaaaggaatccgttagtcccgttgctgtcaatcgaaacgatcagatagagcgaacaacccataaggatgacagaacatgcattacagtagttactacaattacttactttctataaggagggagcttcaggaggttcatgcaagtggccgatgtaggcaagcggtcttcgtcctcctcctccatgccaggaacaccagccctgcagagagagtttacgatgcaattaacaatttcaatgaatggaacttaaaacagaggtatatcaaacctctgaatgcagaattttggttcgaggtactgaaatccaaggagtggtccacgagaacatccggtcacgaacctgtgcatttatcaagtatcaaccacatgatgagactaggagaaaagcattatttcaaaatagccataaatcatgtttatgcataagccatctgtgcatcaaggaaagcaggggtagatagagagactaaactaaaagagatactaaggcaatacactcagcagacattattacaacttat

SEQ ID NO: 60590 - DNA, 607 bp, Oryza sativa
cgcaaggcgattacgccgtggacgagacgagtgagaggaggagagcggccatggcggggcggagtggcggcggcggcggcgggagctccgggaagagcgggacggggaggatggtgtcgctgcaggagttcgtctcgtccatggcgcctctcatagacctggagaaggttccgtactccgatcccccatcgcttttctttcgctgtttggttcggaaggtggaacggatggtagtggtggtgggtggtgacgcgtctgtggtgtggttgcgcaggcggcggagatatcggcggagtcggcgacgagctcgaagaccctcgagaggaggggttgcgtcatggccaacctcaagtgcaccgacgcccaggttgatttgcttccattttgctgcttgcttgcttgcccatcggtgccaatgtgtcatcgaggcgtggtgctaatcttgttctggccttgttggacctgcttggtgcgtagagtagacggggctgatggggaagacgctcctggagttccaacccaacaagggcgacgtgcttccacctcacaaggtgaggttacctttgccctcctgtcgtattgttgttattgctcgctgtgataaaat

SEQ ID NO: 60591 - DNA, 1261 bp, Oryza sativa
gttgtgtatattataataaaaatataaggtcaaatatacattttgtagattgtgtcattgtccaaaagttaattaaaatgaaaccggagggagtaagactttctagtattgcctagattcattaacatctatatgaatgtgtgcaatgctagaaagtcttataacctgaaacggatgaagtaggattcagttgtcatgttcccttatagaaacccagttgaatactacccagcactccttccgtcccattttaagtgtagccatggttttccgggcccaattttgatcgtccgtcttatttaaaattttttttaaaaatttaaaaacataagtcacaagtaaagtattgttcatgtttttatcatctcataacaacaaaaatactaattataaaaaattttcaaataagacggatgttcaaagttgggcacagaaactcatggttgcacttaaaatgggacagagggagtaatagattaggaaagtgataccggctctgactagatttttctctttgtaaccttgccaccaacacacataaggtgggcagggagacctccatggacataagcacaatcagatcattagatcaatacaacacctggcacggatgacatctgtaagtgtcatggatatcacgtacccaataataatcgattcagctcggcggtgcctaccacataccatgtcttatatgaaaaaaaacttcgtatataaaagagttccggataaggaaggatgagtagagttctatacggaaacgacaaggactacttgaattgtatccatattggtctccctggttcaagcacgcttaacctcaaagttctttagagatcggcttcctgaaaagaatttccaagccaagcacgcttaacctcatatggttatcataggtcatagacgaagaagttgcaatatgagtattgtacccccagcttttataggttatagacaacaccggcttcagccaataggatgtagggctattacctatcatatcactcatgcgcactcgggaagaatttttaggccaagcacgcttaacctcaaagttctttagagatcggcttcctgaaaagaatttccaagccaagcacgcttagcctcatatggttatcataggtcatagacgaagaagttgcaatatgagtattgtacccccagcttttataggttatagactgccctcataaaccaacacaagtcttttctgcacattttgtcctcactcgtacgcactcgggaagaattttccgat

SEQ ID NO: 60592 - DNA, 7495 bp, Oryza sativa
gctgccccgtgaatgacggatcgcatgaggcgcaacccgagctcggttcccgtttcctgctccctgcccgccgatggacgccactgtcccgtacattctcttgtgcttgttttttatagcatgctctcaattttgtgcttttctttggtaatcgtagtataaactcctccagagttgattctgagcctttcagccatggcgatctggttcttgatgatctgattgcatagatttggtctcttgtggaggggaaaatgttttccggctgagcggcaatggcaggtgtcggctacacctagcaagagtggcagtgccagctgacaggcgaacacagacggatgacacactcaaactgaaggaagtagcacggaatgaagaaattcgcagtcctgatggcaaaatttgaaaggcttacgggccagtgaattggatggaaaatactgaatttctcacctacctacctagtcaaccagatttatctgaaaaaaggaagaatggatgtattcaccctgtcaggctagtgttacgaatccactccatgtgatttagtgaattcctgcacaagcaaacaattcttcctccaacactcgatacatgagtatttggggatacaaatgggggaaaaggaatcaagactgagaatcagcagtaggttggagaagaagacatagctagagattggagaagagaagagagatacagaggttgaagaagagagagcatcggaaggaagaagtcaagtttcatctgttctgttctgttccctccccatttgttggctctgctccttttgtagtggctggagtggtcggcttgtcgccggattgggcctagccagccctgagctcaatatgcataccaatccggcccagttacatgacagctagttgctacatgaacaagatactgttgtatatactattgcaatgatactcctctataactacctacctagaagaatgaatagcacatccctcaggaagaagtgtataatcagcaaccatgtaagtttcagtagagaggcagaaccaaacaataagcaactttgcaagggttaagagaaagtatggcgggatatttgtgaaaagataatattttgttctgggaattatagcaaaagaatctggatgggagtagtgaaaaggatgtgtggggagataagaagtggacctagcatctgtgatgaagaaaagatccagcactctcccatcaggtgtggtggagaccttcactctacgaattgtgagttccagttcgcacagcactcgtgtcacgtctgcaaagcacagaagcaagcagctccaaattaggcctttttctagtaaaatatcttcactggaagcacttaaatattttttttagggcttagctcgctagtaatcctgagctcctaagtcttgtgaggaattgaagcaacattttgaagaaatgaagctgaagaaaaggtttatggctaaactagtaaatcagtttgttgcaaagagattggggcatatgaattggttgctaacttggtaatttcattcatcattgtgtggtgagattagggctcaaaaaagtaaaaggaaacccatggggcagagaaatgaaaagaaaagaaaaggtagtgagtactccaccatgcaagaggcccatacggtcgtagcagaagaatttgagcaagaagatgttgggagagggggcaggtgcatcgtggtcgtggaggtggagaccagcggcggcgaggtggtggttgtcgaggccgaatggcgcggcgacagggcagagctggatcaacctgtccttgaggaggtcccatctcattgccatggcgcggccgggccttgcaaccacccacagcacgatgtagcaccacctcccatcagtgctcatgtctacaatccaatccaatccaatctcttctcttggactgctataatgaggaaagaagagggaatactagaggaatgttatatattttacctcccttgacgatgttgaggccgaagaggaggacaaggcggcagaggtcgcagccgaggcccgtcttgtcggggcagctaatggtcaccacggttggctcgccggcgacatcgccgtgccggacttgcaccacctcgtcgctgggattcggaatccccatccaattctcaatctccactcactcactaatagctagctacttgttgtttcgtaggagtaccctaataatagatggaaattaatcttggattggaggacgctcgcatcaaatctaacaaaggatttgattgatgtgttgctaattgcgattgcttttgcttgctccaaagtccgaacaaggaggaggtcgtttggtcgtttgggcggcggcggcgggtagagcggagtcaagagcaagagcgaagcgagacgaggaatcttcgaggtggattcccccctttcccctccctctcttttcggatttccggccacttcctatattccaatttaccccttttttttttcttctttgccaaaggcattttattttatttatttatttattatgagatttgacaaacagtaatactgctctctctctctttatatatatatatatatatatatatatatatatatatatatatatatatatatatatatatatatatatatatatatatatatcataatggaattcattcccgttaattagctaggtcaaactttacacatactccacatataattcattaaatcatactcttactgcgacttggtgccggagaaaataaataaataaataccgtggtagcttggaaattggactggaaagtaaatccaactttagaatccttcacagcacgcatttgcgactaaatccactggtcggtcggtcgtctccgtctatatatgtgtgtggggtgatatttggactttgcaatgcaatgacgtgacgacccagccaccactaacctactactagtacactcgacgatcatcatcgatcgaattgttgctcacttggtccacagcaattccaacataaattcattcggtatatacgtactattctccatatactcggcacatgcacattttaatcattaagtacttgttaattagagccacatgcaaacatacttcctctataaaaaaaaatctagatgaagatttgacatcatctaagactataaatctggacaaacatatatccagattaattatcttatgtggtaataggttagtttttttaatgacagagagagtatgcagtaatcttctttcaacaatatactcaatcaatgaccgccccggtaggttaagtaagggtaggtcagatgcaaaagtataacatatatttacactgtagacgcgtccagtaaattgcagctggagtatatatatactccagtatctaactaacacatatcgtcctgcatcacatcactttcttcttaaatttaataaaattattaacggcatgttagttagaaacagtaatattgcatcttgcaatatcttaaccaactcatcaaactattcaagtgaaaaataaaatcaccaaaactcatatagttaggtttcttatgatggaatcagtccacccggatttaaatcctagacttatatgggtactcgcacatttatggctgtgtttatttcacgctaaaattggaagtttgtttgaaattggaacaatgtgatagaaaagttggaagtttgtgtgtgtgggaaagtttgatgtgatggaaaagttgaaagtttgaagaaaaactttgaaactaaacacggcctatggctatattcttttagtgttagccgacatgcccttgacattgagacgtctgtggtgacttcatcgatctcaatgtatatcggctcaatcttttaaatgtgacttcgtcgatctcaatgtataccggctcaatcttttgaatgtgctcatagatgtagggtgtacgcgtgttttaaatgtctgcatttgtaccgtatttaaaaaataaaacccgctcgcaatttagatgtgatatttctaacatacatatatataataaaatcgatagtgaagagaggatggcaacgtagatatattcatgattggagggatgaaaaaaattaggattttaaaaacataagagtaggaaaacgggatatattcaaaagcaaaacatacgattggattgccgtgacatgttgaatcctatgaaaagtagagtcacgggattgctaaaaatatgtgtttggatggctcacaagaaaaatataggatattttagattacgtgttacttaaattgagtaagagcagagggagaaagagtgatgttgctttggaattcccataggagaaagtaacttaggccgagtttagttacaaactttttctttgaactttcaacttttccatcacatcaaaacttatctgcacacacaaacttctaacttttccatcacatcgtttcgatttcaatcaaactttcaattttggcgtgaactaaacacacccttaaaatccaatggattgggggcattggaatgaattccaaaggatttttgcaagtccaagggtgcgctcgttcccacgggcaaccactcccgccacatcgtttttttcgcgcgtgcttcgcaagctgttaaatagtgtgttttttaaaaaaagtttatatataaaagttgtttgaaaaattcatattgatctattttttaaaaaaaatagctatacttaattaatcacacgctaatggcctgctccgttttttgtgccggaaggattttcctgtcactctcgatcggggcccaaatcttacaaaccaaacaatcttcataggaaaaaaaatcctaaggattccaatccttcactgtaacttttttaaggcacaattaacagacgatagcttattggcacatacataaagcttaattgtagcttctttttgaaggtataagaagagacatcgatctggttgtgtgactctaccagaacagcttattattattattattttcgtggaagatgtgctgtggacggtacatttgagtttgacagcgaaatagtggaggaaaataattaagcaaggccgccactgtgacgacgacgatggagttgataattagaggaacaagccaagccacctgcagctgggtgcacagtgctactggatatggtaacgcgggctccagaagcaagcctgcacatatatatactcgttgatcgttgataatagatgagattaagcagcaagcaaagaaacagaaacagagtaatctagtctatatagagtataaaaaatgttgttagttacctctcctcgatcttgatgaccttgtcgtcgtgtttgtcaagacggaatgctacgactaccggccttgaatgtgccagttcgtttgtagtattaccagcagctgctgctgccgagctaacaaaatcctccggcctgggtgcatttgagcattctatttgggactgtactagtggtggtgcattatcatcagcaactctgcaattaattaattttaagccgaagaagaatgtataattaataaatactgaatgtatgaatgtaatcgcgctagcaggtgcaggaggagtggccggcacatgtatatatacgtacttgagcttccctgctgcattagcattactagtactgattgtaccaccggaaaaacgatcctgctcatgaggcagctgctgcttattgacgagatgagacagaggagacagcaccggcgacaatggcaaagactcaacctgctgtagctgctgcttagcagccgcagccgcagccgctggaatgggaatggaggagccgcaaccgcaagcgatgagacgcatgagcaggttggccggcttcaccctgtaaatcgacatggaacagcttcttcttcttctgctgctgttatctgcgcctcctgctgattcttcttcatcatcttccagcatactcctgaagccggaatattcggccattatcagtgactcgaggctccggctgctgctgctgctgctgcctcttcctcctgccgctccctgcttttgggcagatggcgccgcaatcgatccagtaacagtaaaggagctgtcgtcatctgtctgcgttgccgccgacgcaaccaccacagctgctgcaggcctgcgcgcctcgcccactacttgcttctcgtcctctttctctttgctgttgttattatgggacgagctgctgcctgaagaagaggcagaggaggaagaagatgacgacgacgacgatgatgaatgtggctgagtcctacaggaggaggtgcattggtcatcgccaacgacgacgctgttggcgttggcgtcggtggaagaagaggatacaagagagacgtgagcagcagcggcagcatgaggtggcaaagagtgatgagcgctgctgctggtggaggtgatcaagggatggtggcgaggaggaggatcgatgaggtggtggagatggagaagggaggccttgaggacgtagtcgtggggtcctgtagggagcaggaggtcgtccgggtgggagaggtcatgccacacgtagccgccgcggtagctccgcttgcacgaccacgagtacatggccgccatccccttacctcgcagggcgtccagccgccgcgtcacgtctcgcagccgcagctgcacatgcacttgctcctcgccgtcgcccacctccacctccatcaggtgtgggtgctccagccctccctgccggcttcggcacagatagtacaccaccgccaccttcctcctcctcgtcttcttcttcttttcacttgtcgtcgtcaactcacctgctgctgacttcttgctgcgcccaccaccaccagcttctgcctgcgacaaccacgacatcgatatgatacaaagagatcaggaggcagagagagcctgtatctgtatgcatgcagatgcaagtggaataatattttggattgtcgatgacagatcgagctcgatcgatcttcttttctaactgtctgaacaacgatatatatacaacgtacgtaccacgcacaataaagatatatgatgtacctaccagtacatgaatgatcatcgatctctgtttaatttcacacgctagcttgctggcttcttcttcgatcggccagccagcccactagcgtacatttcatccctgtcgttacaactgcgttttaatttcttccatagtaccactacatactagtacaagctaagctaagctttttcaacaacaataattaagatccaatatactcaattcaaatcgatggaggatgcaattgctcgcttgcatccagggaggggagaggagaggtggaggtagcgtactcaagtgaacgacaagcagtaagtaagagcgtagagtacgtacgtacgtctgacaattaagccgttacaaaagtacgtacgatacgacacagttggtggcgcttgtatatggggactgttactccaactactccctccgtcccacaatacaagagattttgagtttttgcttgcaacgtttgaccactcgtcttatttaaatatttttttcgaatgtaaaaaacaaaaagtt

SEQ ID NO: 60593 - DNA, 527 bp, Oryza sativa
aattcctgcagccccaaaattcttagctacaattagtgggggatgctgatcccttcttaatctcagtaccatcttttttacgacaaataattttctgtacttctaactatcagatttgaattgtgatttttaaggggattctacttcaataagcatgtcttaaatattctggaatgtgtttttgacttggtgttgccattcttcatattgatgtggaatcacgaatcaggaggcagacacggttgttttgcactggtggactagaaattgttttcctgtgtttatattagcgtcatgtcgtcctacccatatggctcgcagaattaagagcggatggagatgcgcgcgcttttgccgccaaggtggcacgaggaaacttcgctcatgggctgagctaaaggcccacgataacgagaaattgagcgcatcagagaaagcgtgaaaaccaaatagggtgggaaattggaagagaaattaacttatgtgtagtgttttgaacaatattgagttgtagaggggagagtaga

SEQ ID NO: 60594 - DNA, 570 bp, Oryza sativa
atcgcgttgccgaacggggccgaggagggttccgccgaaacccttgttccgcccaaccacggagctcacccaccggctacaaatttgcaggggagcctgacactattgcgaggggctgcgcccacagtgcgtttaccccttccatcctgtttttttccaccgggatcaattgaatcccttggggtggctctccgtccagattatacgtggaattagaggaggagccaatgtatgggatcaaggacttgccagccattggtgagttgtgtgtggagaatcaaggaattgaattgggatgaagaaggagtttgcacaagaggaggagaggaggaagaataagtgctctgagctttgatccgatcgatctacctccgaaagcgcatcacaacagactacaaacgagcgagggaattggaactaatcgggcgccgtcctggtttgccccaaccagtatggtccgccgaaccctggtgggtccaactggcgggcaatttttcctaagcccactaaatctaaactaagcacaaaagtgacaactattcatgggtttaagcatgcattagatgagat

SEQ ID NO: 60595 - DNA, 992 bp, Oryza sativa
tatttctttgtggtaatactgccatttcctggcggtctgtaaagcaaaccctggttgcaacgtcaaccaaccactcagaaataattgctctatatgaggccacacgagaatgtgtgtggcttaggcggatgatcggtcacatccagaagtcatgtggcctaaacattgataacacccccaccattatctatgaggataacgctgcttgtgttgcacaaatacatatgggctatgtgaaaagcaatttcacaaagcatattgttcccaaattcttttatccccacgagctccagaagagcggggaaataaatgtcctgcaaactaagtcatgtgaaaatctcgcagatttatttacgaagtctctgccagcctcaagtttccacagatgtgttcgtggcattggcatgagacgacttagtgaattgcaaggatcagggggagcaaagaatagcccatgattgtgatcctgaagaatcacaaacaagtcgtgaagacttgatcaactgttgtactctttttcccttggtgagtttttttccccattgggtttttctcacgcaaggtttttaacgaggcaacaggtgcaacacaatattcaaagtgccatgtactcttttctcctaccattttttcccactgggtttttgggaggagtttttgatgaggcatgcgcataattcaaactcgtctaagggggagtgttatgaaatctatcttattgtagacgaattaaattatgaatgggaaacttactacagaagaaagcttacgctgtaagctggaagccagcttacggcgcaagccagcttacaggagaagccagcttacagaggaagcccgcttacggcgtaagccggcttacgacgtaagccagaaggtccaaggcttacgacgtaagcctccaccctcctctgcctaaaaatagggcccagaaggtccaaggcgaggacaaccgatcttcggtctcctacttcttctcttgtagcttgtac

SEQ ID NO: 60596 - DNA, 2741 bp, Oryza sativa
  unsure (1)..(2741): unsure at all n locations
cgcccacccttgcctagatgcgtcggctagaggaaagctacgctacaagcccagccgttgcccacgctggcttgtggtaagtacgttaagttcttccagggcatcccgcgaaccggtccttaactgccatgggtgcgaccagcaaaaccatgcacccacagcccaccatatgattcattttaattaaccaacaccagagcggtggtactaatccaacattaccattagaaccaacagtctaaacattaatatgattttccccattgtgaactagttgaactaagcatagctaagcaattcctagtccaaactctaatcatgtcataaccccaagctaacaaaggagcatggtatccaaaaagcatggctgtgacaataggtaaccaacccataggatcccctataaaacaatgcaatatttgaaagaaaacaatagagcatttgcaatataggatcaacatgttcaagtgacaagcatgacttgccttgctctgctgctggaggaacctcggcgactatctcaaagtacaccggagcgtcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactataaaagaaaaaccctaaatcatttattgcgcaatatattccagggctgacgtcagcacaagggaagcggcgccgacatgcggggcccaccggtcagcggctcgggagagggaggaagggcgccggcacgcgggcccactggtcagcggctcgggagagggaggaagggcgccggcacgcgggcccactggtcagcggcggggagaaagaaaaggggcggcggcacccagctcggcttggctcaaggccggccgaccggccgcggcgacggcgacggcgcgcgcgcgaacgcgttgccggcgacggcaaccggcggcgagggcgacggcgcaaaaggcgacgcgaaggcggctacgctaagcggcggctaggaaggggaggggacgggcggcgttaaaggcgaccgccggctcggctcggcatcaaagccgacctgccggccaggtctagcggcgacggcatgcggccaacgacggcggcgaccggcggcacgggaggcggcggcggcggccgaaggcgacggcatgcgactcgaagcggcggcgcggcactaggaggagaggaaggggaaaagaggggagggatgcctcaccgagggtggccggcgcggaagaagatgatggcgaacggcgacggcaagccacgggaggacgacgtcggtgggcggacgagcttcggggtgccctaaggaaggagaagagagggattagagagagagatggaccacggcgaccggaaaccatggccgaaggcggcggtggaggtggtgctcacccgagtgcgagggaacgagggctccggcgacgaacctcgacggaggaggggtggacggtgtcacatcctgattttttcaggatttatagattatttaataaattattattagaatttatattaaatgttcattaatttacaagtgaagttaaatgtgggaaataaaatttcctaaatataaagcatggatggatttaattttttattaaattctccatggttaattatactctctggaattttctcggatttttcggagctcaattattaattttaatcatacaaagagcatttcagtaattacccacatattaaattaatcattaaatggtctaattataattttggtaagtactttgagtgtccaagtattttcaggatttttcttggaattatttgagcattggaagtatttttaacaattcaaagatcatttaagtgattattttaattggaaaagtaataaaatcctcctcctcagcttgggccattttcggcccattctttcctttccttcctctctcttccgccggcccaacctgagccgcctcctctcctctcagcccagccagaaaagtctactgttcctccctctactactgttcatcttccagctctggacagagcccgagctgccgtcctgtgccctgtgcagccgccgctttctccaccaaatccgccgcatcccgagctccgtttgcaaaattagttgaggggaaatatttcctttatcttcctctttcgtttcccccaagaatcggaacctaattccttgtattttatccaaataaaattcgttttgagtttatctctccaaactaacccgaagattttccggcatcgattcctctcgtttggagtccgatctctctagtccaagactatataaagcatcccctagttctcctctttcttttgccccatctcccgagctctctcgtcaaccgtagagctgccgccacgtcgtcttagccgccgccgtcgccggccgacgaacagccggctcgcgccgtcgttttggccgtcgccggtgtctcctctcgccgccgtcgggtgcgcgtggaagaagggaagctcggncggccccttcccgccgtcgccggtcaccggagagtcgccggcggcgacgaccgagtcgccaccggcgcacaagctcggcgccggccgtcatccgtcgtcgttcgttgcgttggtgagtatcgttgagatcgcgtcgtcgtcgtctacgtgtagatgcc

SEQ ID NO: 60597 - DNA, 1164 bp, Oryza sativa
gagtatatacatattttgatcattgggctgggtatgcgtagattttgaaacatagctagctatcggctatcccaaacacatatcgatccatccttacccaggtaaaattaacatgttacatgtgcgctttagcctgtttcccaggagtttttggttctcgggaacttagcacagatcctgctagtgaactgccaaactaatcgttccatgcatatgattccatcatccatgagagaacttctactagctagttcaccgtttatgtttgagtcgtgtgcctccagtaatacagtatatgtacagtcagatccagtaaccaaattaacctgctgccgacactagttaattaagagttgtgttcagctgttttgcgactctgttacctgtcgatgtgctgacgcatgctgtttcttctgttaaaaaagctacatcgatggacgtaatacgcacgtacgtcagcttaatctgcacgagctatagttaaggtgaaatttattgtgggaatttgcttggatatatacttttttttacaaaatcatgagttacagttaggagtctgatcgtctcaagttagcatgcgatgttttttaaaaagatctcttatagaactccttttgtatttccaaaagtgaacgaatttaaaaactgactcaaatacatatacgtattttcaaaagcgaacgaacttaaaaatcgactcatacacagatgacgtaccaaattaccggcaaaaacatcttcaatttttataatagtagagatattccgaccaacaatcatttttctcaaatgcttaatagtagggtagaaaaatgtcactagagatagcgagaaaatgtaaaagataaagatggaggaaagaagagaaacaaatatactataacgtctttatatgtttcatctctttcattattaatataactagaaaggtagcccgcgcattcgcgcgggcatataagatacgcttttgtaaggtgtaatatcgaccgggtgacacaccactcttgaaaaagtacaatttcttataaattttcttcatctacattgctcagatatttttttacaagatatctgtaaggtttaaactatataatatttaattcactactataagctgcaattatcagtaattcttcattttctagaaaaaaagcatcaataaat

SEQ ID NO: 60598 - DNA, 2636 bp, Oryza sativa
caggggagtggggctgtgggggcaggtagtggggctccagttctccaccagcacaagggtccaaggcacgctgagtcagacccacttgggcggggcggggcgcggcgcggcggttttggttgctgcccgacacgcgaatccacgaatgcatcccatccatccccaccagcacacggaaaagcagggttgaggtaggggtaggacagaagcggcaaccacgcgacgtgcggacgcggcgcggcgcggcacgcccacccaaaaattccccgagccgtgccgtccaacaccactcatccgatccgacagcccgcgggagcccgaccggccgcggagacacagaaccggccccgcgcacacccccaggccccaggaccttggaacttcctcctcattcactccccgtcgcaccatgctctccgttaaccatagtccctctaaccacggttagttgctctccgagtcactctccaccgatcccagggttcttctacctctgcctgtctatatagctccctccccggcttctcatccgccgttccctccccctcgctctccctgctccggtatagctagttgagctctgatcgatcaggttgcatgagacggagaagctgagtgaggctagggtggttggttgtgatcatcaccatgagctgcaacgggtgccgggttctgcggaaggggtgcagtgacggctgcgtgatgcggccatgcctgcagtggatcgacgccgccgacgcgcagggccacgccaccgtcttcgtcgccaagttcttcggccgcgccggactcttttccttcatctccgctgtccccgaggcgcagcgacctggtatgtagaatacaatccatcacggctctgcacgtgtaccgtacatattcctgtacgaagcagctgaccatatgtcgttggttgcgcgcagcgttgttccagtcgctgctgtacgaagcagcggggcgaaccatcaatccggtgcacggcgcggtgggcctcctctggacggggaactggcccctctgccaggccgctgtcgagaccgtgctgcgtggaggcgccatcggccctctgccggagctcggcggggcctgcggcggcgctggcggggacctctacggcgccgccaagcgcaacggcggctggtctaccttctccactgcgaagcgggtgaggaaggccgaggtacctgaagccccgtcgtgcgacctaggcctgtgcctcagccccggctctccgccggcggtgggggagaggaaaccagcactgcggccggggacgccgtcaatgagctccgatgagtccggcaccacaaccggaggcgaaagggatcctgtgctgctcaacctttttgtctgaggccggtcgtcaagctagctaatactaatccttgcttgacctccgtctactggatcccggcggcgaagcagtagtaattttttctcgccggcgagcctagtttattggcatttttttttctttccctttcttttaggagtactagtctacgagtcttggtttttgccgtgtacgtagaaaagaaattaccggccggcctggacgccccgtttgcgtgggcgagcaactttttaccctttttgttcgtttaaattatataaataatccttcattaagctatatagacataggttgcgttcgttcattggagacagcggagattgttactcgttttccgcgcgcacgcttttcaaattactaaacggtgtgttttttataaaaattttctatagaaaagttgttttaaaaattatattaattcatttttgaagtttaaaatagttaatacttaattaatcatgagctaataacttaactcgttttgcgtatctttcccatcctctctccctcgaacacacccatactcatcttgtattgatccctatgacttgttatgagaacgattggagctgcaggcacagagtctagatttccaaatgaaagggctcttctacagaagttttggagaaaaataaattgttctcttccttcatgtcaatgttcttctcacggggtgtgttttgctggtgaaagagtgcaagtcgtataggcggatttgggggtagggagcaaaggcgccgcgtcatggggctacggagttgacgaggtattgccgcctcgaggataggagggcgctgagggtgagagagaaagagagaggagagcccacacagtggccgacacggatgctccaaaagtcctcatagttgtaccgcttgtacgatggacaagaccgggcacgtcacacgatgcagcacacacgaccatgctgtggctacaagttctacgcacgctctagtgtaccgtggggtgaagttttactctctccatccataatataaaaaattttagatgaatgtgacacattctaactaatacaataaatctggacaaattatatatcatatatgtcaaaatttattgaactaagatgtatcgtatccatccaaaatcccatatattattggacggggagagtattttcgaaaaaactggcttttgttttttacacctttgcatggcaatttcagtgcagttgttaattctattttcaaattatgtcatgtacaagttgctcatagtgctgattccttagcctaagggatatactccctccatttac

SEQ ID NO: 60599 - DNA, 6821 bp, Oryza sativa
cacatttgcgttacgtatataaacgacataattcccactaccctgcactccaaaccagcaataatttatcatctagatacacaacaacaatcaccagtcaaccatatattacaccatatattacacagataacaactaaaagtaaccagaagtaattacaagaattgcatctaaccaccgaatcgaatcgagatctaagcagataccttgcaggggcggttcttgataacaatatacccattcttgcggatggttccggcctgctggggataggtcttggacgccccagcgtcggccttcgactcgaaatggtgctcctcagagtccgacatgccgatcttagcgagcccctgataacaaaatcaaatcccaaacatcaaatcaaacaagattgcacaaaaaaacgaaattcccaaaccaagaaaccgagcaagtgtggtacggaagcaattggactacgaaccaaatccgaatggatttccaccccaaattaccttgtttggatagatcgcgaggagaaggaggcggtgagcgagagagagggaggcgccgattgatgataagtgataagctcgcgttggaatcctagggtttggttacatttatacgctgctaacaacgtttccgcctcaccctctcacccgcggagacaccacctgtgacactgacggtgggtcccggaacgacccgtccccacctgtctgtgagcgaggcggtggtggcgtgttacgagagtcgcagccgtcgattcggtctggggatcgggacacgtgtacggctgcggagggagggcatcacctcgcgttcgaaccacgccatgggcggcttggaagaatctttcttccttttttattttttatctttccttttcttatcttgaagtttttatatttttcttcattgcttttcgccgtctcttttctgctgatcggtgataagtcaataatctctcttgtgattccgatcgggtggggattccctcaggagacgtcatagccgcattgttatgagatgatcaaagaggaggagggcctagttggatgtgacatggtgttctttttagatagtgttaaagagagacactcttctttccaaaagaagctactagtacactcaatatctatatatatatatttttagagaagtttctcttaaaatacttatctaatttataatctgtatataccgttatgatcgttacaattaaatctttacaacaagatcttacatgattatattctgataatatatatatatatatatatatatatatatatatatatatatatatatatatgacggagcgtggggctcctcaccgggagaccgcacaggcccccctttgccggttcggccgggggctcagggtgagatcccaagctctctctgtacgtggaaagatcgcgacctatcgaaagagcatgagacacaagcgatgtatacaggttcgggccgctgagaagcgtaataccctactcctgtgtttttggtggatctgtgtatcaaggagctacaaagtgtgagccaacctccccctttgttctaggttccgaatcaggaaagaatccaaaaaatcccccttctccatgggcgaggtcctccttttatatttcaaggggataccacatgcaccctccctttccaaactggacttttcttctcttcataaatggacggagatttgcacggttgccctccgaacgtccttctgacgggacggcacatacctacctccacttctgccgggggcaggcgcgtcgtgggaacgtggctgtctgccgacgacatgatcagtgtcagaccggtcacaaatcggtcattcttgtccaccacgcgtcagcttagcaacgtgcatgtttgcccttcttcacacaacatcttgcttgtaatggttaggatgaagcctggcatatatccgaccggggctaacgtgccatctctgggaggtaacacgctagctccagctggggacgagtgcctagaagctctcgtcttgacgggatggggcgaagcgtgcgtcagaccgcctgtcgcctcctaacccgcgatctgaccggtctgtgactggtcacagaccggataaacgagtgcactgcactgtatttcgtgcggcgtgacacgtttagccgagccgcaataaatgcggttaggtgagccccgctgtgctcacctaacccatacacgcggagtagaacccgcgaggggtcggggcgcctcggccctcgggggcgaggcaggagtggtccgaccccccctcggggagaccaagaggtgggcgcacacatcaccctcgggcccgacgtcccccgagggtgccaggccacgtgggcgattgtgtctgcctcaagcctctagtcgtgatactcccggtcccatgtcaccgacagtagcccccggcgttatgccagggcgatcacctttttcaagggaagcggtcgggcgtgacgccatccctaaagcctggtgacaagtgggaccggtctctacaaataggcagaaacccaacggtcacaaactacgcacatcggcaatggtaactcggctgtcagtaatgagcggtctcttccagactgccacattactcgagtagcacacgaatctggacatggcgattcgtttcatctgaagatatggtaacgtcgcttcggttggcgagcgtaattaacgcgcgcacgatatgatctacctcgaccgccacaaccacatatccacctcatgcgccgcaagcgggcgaatgggattagtggaagcgtgggcgcgagaaacgagggggcgaaatagtgggcgcgagaaacgaggagccgggcacagcattggcaagggtataaaggcactgggaagggatttgtttccttcctttcgccattattccccttgtctttaccgcttgcgccctaactccttcttccctgcgcccttctttcgccacacgcgctcgctctccatcttctcttcgtccggcgccatggcacggggctccgcactgcttgatggtagcgtgctgccgccttcccgcatcgtgagcgagaagcaggctgggttgccgcgccgcttcatgccggaatctgccaccggccgtgagatagtcatgctgggcgagggacgcccggcgccagactacccggggcggtccgtcttctttctcccctttgcaatggcagggctggttccgccattttcttctttcttcatggatgtcctggagttctacgatctccagatggcgcaccttacccccaacgcagtgatgacattagccatcttcgcgcacctgtgcgagatgttcattggggtgcgcccatctcttcggctgttccggtggttcttcaccgtgcagtcggtgtcgccgccgtcggtggtcggtggctgctacttcctgccgcgggggccggtgttgaaccgctacatcccctgcgtcctccgcaagaagtgggatgactggaagagtgactggttctacacccccctcgccgacgaagcgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactatctccgtcgtcggattgcgccactccagcggcgcgctcggggcgcctgggagtacaccgggtccgaagactacatgcggacccaccagggagtcagatgggattgggctcctgaggacttcaagatattggtccaacgggtgctgaatctcaactccgtggaggcggccctcattccccaaggaatcctccccctctgcagcgatccagaccgcgcctcgatcctgaccattatgatgggggtcggggcctctgaggagcaagctccaaagggccatgacggcgcaggagggagccgccggggggagcaatctaccccgagagggggtcgtgcttctgggtcccgtgtcaggggcccggggagcagccgccctaccgacgcccgggggaagaggaagcagggaggaacacctcccccatctcctccccgagggggcggggcggcgcgtgctagcagcaagcgcccggagggggccgcgccagcatcgcagctcgagggggagcgcaagaagaagcggccccgcaaaatggaggagacagaaccatctcggggaaacctcatttcccttccaaagtggtcgtttaaccgaccccctcgcaggttcgtctctcacccatcgtggctgtattcattctctcaacatgagttttcactcgcccatcttgttcgtcttctggtcttttcttttgtttcagcgagatcccgtcgcgtccctcccatcattccaagtccggccagcctgaggccgaggatccggcggccgcagaggcccgcaggcgggaagctgaccggcgagaggccgcagatcgcctacgggaagccgaggaggccgcccaggaggccgcccgggctcgccaggccgaggaaactgctcaggaggaggctgcccgagcccaccaggccgaggaagctgcttgggaggaggccggatttcgccaggacgaggcgatggcgacttccgaggcagctcgcgaggaggccgcgggcgcgtcgctcgggcccactccctcgggcgacgctcaggcgacaacttccggggcagctggcgacgaggcagcgggcgcgtcgcttgggcccactccctcgggcgacgctcaggctcaaccaggtccggaggacatccctgcgtctggcacgtccatcggcgggccgagccgcgcggcatcttttccgaggcgacttttccccacgccttctgctgccctactgagcgcagagccccttctgcaagccttggccgccgcaaacaccacggtgttggacgggttaagtgcccaggtggaggccctgcaggcagagcgggcggagctcgacgccgcgtgggcgcgcgtcgaagaggggcgacgctcggtggaggccatggtggaggtgggccgtaaggctcaccgccggcatgtctcggagcttgaaacccgtaagaaggtgttggcggagatcgccaaggaagtggaggaggagcggggggctgccctcattgccaccaccgtaatgaacgaggcgcaggacaccctccgccttcaatacgggagctgggaggcggagctagggaagaagctcgacgccgcccagggggtgcttgacgctgccgctgcccgagaacagcgggcggtggagaccgaagcggcgtcccggcggcgcgaagagaccctcgaggcgcgcgccatggcgctggaagagcgcgcctgtgtcgtggagagggatctggcggaccgcgaggccgctgtcaccatccgggaagcgacactggcagcgcacgaggctgcctgcgccgaagaagagctcgcgctccgcctccgcgaggacgcgctcaccgagcgggagcgagctcttgagggggccgaggccgcggcacaacagctggcggacagcctgtccctccgcgaggcagcgcaggaggagcaggcgcgccgcaatctggaaggtgcccgcgccgagagggccacactgaaccaacgggccgctgagctcgaggcgcgggcgaaggagctggacgcgagggcgcgcagcggcggggcggccgcgggcgaaagcgacttaaccgcccgcctcgcagctgccgaacacaccatcgccgatttgcagggcgcactagactcgtccgccggggaggtcgaggccctccgcttggcaggcgaggtagggcccggcatgcttcgggacgctgtctcccgtctagaccgcgccggccggcaagtgggcctctggggcgggcggactgcgaagtacgccgccaaccaggggggcctcgcccagcgcctctcggagatagccgggactctccaacggctccccgaggagctcgagaggacgattaagtcatcctcgagggacctcgcccgcggagcggtggagctcgtactggcgagttaccaagccagggatcccgatttctccccatggacggcgctggacgagttccctcccgggaccgaggatggtgcgcgcgcgcaggtccgggacgccgccgaccatatcgtccacagcttcgagggttcggcccctcggctcgcgttcgccctcaactccgacgaggaggacgatgacggcagagtcggcgacagtggcgacgaggctggcgacccgggtgcatcggggtgagcccccaggcccccgccaatctttaaatagtttcttcttttcttcttccgaggccttcgggcctcttttttgtatagatcaacttaatctgtaatcaaaaatgaagaaatttttgtgttaatttcatcttgctatgtgtatgagatgaggatgatctgtgccgtggtccttttgtgtcttagcttgaataagggctcgtgcccaggttctggtcctcaaaaggcgcgggtcggggcttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaaacaaaagaaactggagctaagccttgactaaactacagcgggaacaccactccacaggcatcctcgacggcacggacgaagcctactcctcggggaaaccttcatctgacacatacccgtcctctggggttgggaaaagtagagcaagactgagtagtacccactgtactcagcaagtcataccggaataggggtatgatgcagggaa

SEQ ID NO: 60600 - DNA, 6033 bp, Oryza sativa
ttattgtggttcacggatttaggcttgacgcaaaacttctaaacttgggtagctgaaggacaactcatagcagacaattaattccacaagtaatttctgagaccattgttgatcaaatttccactttattacagcagcagcatctagcccatagcatgatttcagcttagaataaatctggtgaagcctatattcaccctcacaatttgccaaatgcctaaagcaactattagtaacaaccccaccccacgtgtagctttaaacattttaccacaatgagaacaccgagcttccgccagcgcatcaccatcatatattggatcaaaatcatttcatatagttgatgttaatttgtgtttttagttatagatgataaacctaattatttgaattaagcatacattaaaacacatgatcgaacaaagcggtcaattaaattatatgcatcaattgcatgaataaatagcagtagaattacatgaaaaaaaaataagtaaagaaaaagaccatgtctttcggatcaaaatacttacattgtcaagtttaattgtttcctcttcaattgcttcctcaaaagatggagacggtgacatcacaatcctaatctccggagatctaacgatttatacaataggtgatttgagccgctttgttgccggagtctgttgcttttctgtcgaggctttacgtttatatcccttaaggtacttgaggagagtatctcttttgaggcacaatgggcaacatctacaacagtaaaaggaatttttgtctgccatgaaataaattgtaagcataaactctgctaataacaaaaattcaaaccagcatatagggaacacttcaccttataaaagaaaaaaagcaattggaacagtaacatctgttttggtaataagtttctgctaaattattgattcatcagcatgctatgttgagaaatggacagggtataagctatatagccaaaacagttacggttaaatttcagcatagcacattgtaatcatataggtacagcagacatgattattagtatattatcttacttcagacgttatcatgataaaaaggtaggcacgagatggaaccaaatcatgtccttcatccatcccccacatgtttgatgagaaaattccatctatagatttttttttcgcaagaatttagccactacatatccagtaagcatcatgtatgtttttttaccaagcattatgtatgtttttttaccatgatcaagtactaaattggcatgagttatttaacaaaggaaattcatatatttagtaataacaatagggggttgattctacagccataagcaaaaatcattgcatcgccaaaataaagattcaagaactcacctgcgtagaaaccaatggggatggagaagccaatctggtaggagccatagcaagcaggggtgatggaggaagtgagatgggcagcggagtgagcgtcacgacaggcaccagagtgggcgccacgaccggtgatggcgtcaccatggctggttgcggaggaggtcggccgagaggaagatgagcacggccatgagaggcatcaatggacggcgtgtcaacaacggcagtagtggctgaggactgccgttgaggaggcggctgctagggttgagccggcagcactctagatcttgtctagcgtgattcgatcccctcctcccctgcatgcgcgataagtgggttgtggcgccactgggccactgtgggcagtcgcattaactcacatatcttctattgggttgcacataagtgagttagtgggtaagtggggtgggctagcccagtgggttagtggcaggccaccccacttttagccttactctgacgcatctctctcatcatcgagtaggtcatattgctagctgcgcagcgaacaatgcgttgatgtccaccctggccaccagctcatttgctcagccactacaaaaccatcaaatccaaacaactcttcaagaagcagagcagcaagaaagtgggtgacggtaaccaacattgtcgatggtgacgatctgcatgcgatattgcgacttgaagtagaagtagacgtactcgatgtagctgagggagaagttatcgagccactcgccagagacgatgccctctaggtactcattgatagcccatgtgcaggttccccagcaccagggctgccaccacgctctgcagcacgttgagtaatgatggtagtcaactccaaccaatgaagccgccacgacactgagatccgtgttgaggccgatgtgggtgctcaagaaaagggcagaggtatcaggggcggtgtagaggcatctacaccgccggagagcggagagcaaatgcgtcgatgggtgcgcaggggagtagatcgaagcgatggcagcgtggtggaggtgacggcggagcaggaagagcaagagcagctgagtggattgggtgacagtgtgtgggggattgattggaggaaataaggtgcgatgtttgcgttggaggaagttgcggcatgcgccatgcgtgactgaggaatgatccggcgtctgcgtgatttcattgttggatcgcatctcacatcagggatttttatatctggaccattggataggatgatctaatggttagggagggcctgcataacattctatgtgcgttttcgtgggtgcatctagcaaaagagtgaactgcttcttttcatattagtatcaatgatacttgctcttagaaatagttggatatatctattccaataaatgtgcatccttcctccatttcaaatttttaagacaatagatgagactactgtcggtctctatattaacaagtggatatacacggatctattaatgctgcatatcccatcatttcaatgtgcatatctgatatctctccaacgtcactagtagtaaggtctaataaataaatatacaggctagctataaaaacagagccttcccctatagacacaaaacgatactagaaattagaaaaggaaagcagccaagtcgatcatcacatcacctgatcgttcttgtgagctcgggtgacaacgttaattaattcgtaagaaactgcggcaccggcagtagcatcaatggcacggggaagcgccgccgcgccggggctgctgctggcgctttgctgcgcggctgccgccatcgccgtcgtccacggcgaggattgggccgtcggcgacaacaagggatggtccttcggcgtcgccggctgggagaacggcaagcgaatccagcccggcgacgagcttggtgagatcgatgctcgatcgagcaacataatttatactttctcccttttgtattttgtattacaagtttgctttcacttttaagagaagtcgaacatttttaagtttgattaagtttatagaaatataatattttttaaatattatcaagatatatttaataaaactaatttagcgttgtagttggacaaacctaaatttgtcttaaaaaacaaaaacgacttaatccaatttgatcatgagtttgatatataaatacatatggatgtggatacgcagtgttcaagtatgacgcgaagattcacaacgtggtggaggtggaccgggccgggtacggcgggtgcacggtgaccgggccgtccaaggtgtacaactccggcgacgaccggatcaagctcgccggcggcgaggccttcttcatctgcagcatccgggaccactgcaccgcgggcatgaaggtcaaggtcgcggtcacggccaacgcgtaggtcgtacctagctagacttgcatgatgatagtctcgtctagattaagcagaatctattccgaccctcattgattatactctaataagtcaaaaccaaagctaaaaccaaaattgaattttcaacttaaatttgatgctgattttaacatacttttatcagtgtcctctagtgagctccaaatttaaaaactttaaaaacgaccgtaatgagcccaaaattttacttgggctgaactacgagagggaggtcgcaatgcggacatgggctgaaaattggactattatacgttggcccaactagcgcaaaattaaggaataagttcacccgaggtccctcgacttaacagcgagattttttgaggtcccttaaccacgaaaccagaaatgtgtacccctcaattatgtaaaaccgtccaaaaaaaagtccctaggcagtatagacgtccggtttcgctgacgtgacgtcctagttagcaaaaaaaataaaaaaataatatggcacccacgagtgagtgagaaggaaatagtaagggcccacttgtcagcatcatcctcttcctttctctttcttcttctcttttcccttttcttgccgcagaggggagagctgcagtagtcgccgcggcagcaaagcggccggagtggcggcggcggagagcggagtcggcggctgcgaagcaggcaggacggggcagcggcgggcgagcgtggctgcgagtgccgacggcggacaagcaggcaggtggagcgttggagagcggagcaggcgggaggcagcgacgggcgagcgcggctactagcggcgacggcgggcgagcaggcacgcggagcagcggagagcggagcctgcggcgggcggtggccgcagccacccgcatgccgtagctcgacccttccctgcccattatcccgctcgccgccgagccctctcccggcgctcccatcggtgcacgcgaccacaccgggacgctggggagcctgcagctgctgatgttgagcggcgtcggactgcgtgggcagctggagaagcacggcatcctcccgtgttggaccagcccatggacgggcagggcatggtggacaaccccatgaatccggttggctagctagctgcatgcagcgtgcaaactaattaatgggtgtttcataacgacgacgacggcgactggaggcagacggggcagctggggacggtgccgccgaaggagcggacgccggaggcgatgcgtcggctagacagacgcgcattctgtggcgggttcgggaggcaggcgaagcggcggcggagcatcgacggcctgcccatctgcctgctcgtcgtcgagccctctcccggcgctcccatcggcgcacgcgtcaccccggccgctctcctccgcatcctctgccggtgtcgcgccgaggaggtgcgcggcgccgtggaggcggcgtggctggcgatagcgagtacgccgttcgcttgctaacccgccgtggctccggatggggagaggcgcgcgccggccgccgctcccgccgtcgcgggcggtcgcgccggccgcctctctccccttctctggcgccggccgcctcctctccccctctcctgcttcttccccgcgcgccgcagcgcccgctgcgttggcaaccgcgcccgctccgctgtcggccgccatcttcccgcctgcgcgtgagagctgagaagttgagaagagaagagaaaaagaaaaaaaaagagatgtggggcccacatcattttctctcactgacatgtgggcccctacatatttattttaattatttttgctgactaggatgccacatcatcaaaaccagccatgtatactgtcttgggacccaaattagatggttttgtaaagttgaggggtgaagatttctggttttgtggttaagggaactcaaaaaatctcgctgttaagttgagggacctccggtgaacttattcccaaaattaaaaatcccgcgttgggccggctctcatgccggatcaacaggacatgacatggcttagcatatcaaggaataagtacactttgactcccttaaaagtgacccatatctaatccatgacactaaaccgcaaaatcagatatattgacctctaagctgttaaaattggtgcaatttaactctctcagtggttttggagaacggattttctgacatggcgtctacgtagcagtgttgacctagtctgctattgacgtggcgctagggtggcattacaattaaaaacatacatgtggggcccattcgtcattcacacaaaaggaaattttggggg

SEQ ID NO: 60601 - DNA, 1140 bp, Oryza sativa
aaaagacgtgttgtcggagtcgtccgtcaagcctgagtggaagagctagccctagaaggaattggagcacgcaagtgacgtaataatataaatgattgttatatttgtaatgcaattaattaagattattagacctgtaattggacttatcatataagattgtgtagtgttctaatattatttgagttttaatataagattactttatttgtaattagacttagtatgtataattattgactacggaattggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttataattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtaacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggccggcacatcataacggaagtgcaagaagatggacgtcctagtgccccggccgaagccgccaagaactatgtacgtcacagcggttgggttgtgcgggataacgtgcct

SEQ ID NO: 60602 - DNA, 10411 bp, Oryza sativa
gaccactctttcatgacttgattaacaaccaactaagaatctccacgaactattagatgctgaattcccaaagatatcgcgatccttaatccgtgatgaagcacctcatattccgccatgttatgggacgcagaaaaatatatccacaatacgtaactcagcctttctccagtcggggaaatcaggacaacacctgctccggtgcctaaaagcctctttgactcgtcaaaatgcatggtccaatactccatcttttctatcggcatgtcttcttggaactcggtccactcggcgacgaagtctgctaaggtttggaacttgatcaaagttcgtggtttgaaagatagatccaaagacatcaactctaaggcccactttgcaatccgtccatttgcctctcgattatgaagtatgtccccgagtggaaaacgacgtgaccaccgtgaccgagtgaccttgaaaatagtgagataatttcctaacggtaattaaaacaccacataacaatttttgcacctgaggatatcttgtcttggagtcgaccaaaacctcgctgacgaagtaaattggttgttggactttttaaacatggccatcatcttcacgctcgacaaccaggaccatgctcacaacctgagatgttgtcgacacatataacaacagcggctcttgtggatgcggtgaagataagaccggtggagtagtgagaagtttcttgaagtcttcaaaggctttttgtgattcgggtccccactggaaattgtcagctttctttggcaacttgaaaaagagcatcccccactctccgagtcgtgaaacgaaccagctgagtgccaccatgcatccagttaacttttgaacgtcattctgggaactcggcggtttcatgttgaggatggcgttgattttctccgagttggcctgtatgcccctatgggacgccataaagccaagcaacttccctgacgttactccgaagatgcactttttagggtttaatttcatcttgaagaagcagatgctcgcaaaggtttcttctagatccgcgatcaaatcatccctctgcttggtcttgacgactacatcatcaacataagcttcaacgttacgaccaatctgagttgaaaagcatctctggatcatgcgttgataagttgctcctgcgttctttaatccaaaaggcatggtgatgtagcagtaggccccgaagggcgtgatgaatgaagtcttcaagtagttggactcctttaaatggatctgatgatatcctgagtagcaatccaaaaagctgagtagctcgcagccggccgttgagtcaactacctggtcaatgcgaggtaacccgaagggatctttgggacaagatttgttgaggtcggtgtaatcaacacacatacgccattgtcccgtcttcttcagaaccaggaccagattggccagccagtcgggatgtaggacttctttgatgaagcctgttgctaacagcttggtcagttcctccttgatcgcatccttcctatcctgtgcgaagcagcggagtcgttgctttatgggtttagcgtcttccttaacatgtaaagagtgctcaatcacctctctaggaataccaggcatatcagatggtttccacggaaagatatctttattattttgaagaaaggtgatgagcgcgctttcctatttacaatctaactcggcgcctattacaacagttttagtgggatcagagggatctagaggaattttcttagtcttggcatcgccctctccgttctttggcatcttggttgcaggcacttctccttcggttgctgtggatgcagccagtcggatttcctctcgagcgagcgtaatctcgcgggtctgggccatctcgcagctttccttgtggcaagtcctggcatcttcatcatcatgtaggtatagtgcgggacggccaagaacttggctaacaccgggcgttcgagtatagcatggtacgctgtctcaaaatcaacaacttcgaagcaaatgttctttgtgcgaaagttctcccaagtgccgaaagtaaccggcaaagtgatctggtcaagtggagtagaagatagcccggggatgactccgtgaaagggcgcattactcggcttcagttctgtgcgagggatctgcatgtcgtccagagtcttggcaaaaaggatattgagtgcgctgccaccatcgatgagggatcgtcggagcttgacgttacgaaccactaggtctagtaccatggggtaccgccccgggtggaccactcagtcaggatgatctaagcggtcaaacttgatagctgtctctgaccaccgaagatattgtggcgtatcgggctgaacggcgttgatctcccgctcggttagcttttgctttcgcttacattcataagccaggggtccgccaaagatatggttgagttccttgcgtgagtcttggaaaccagtaggggcatcatcttcatcatccttcttcttcgacgtgctttgaactccgtcagtcggtttgcttgagttcttggcgtattgctctgcgaactatttgtagacgaagcaatccttggccgcgtgatttgaattcggatgatgtgggcattgggagtgcatgatcttgtcgaaagtgttgacgcgcgaacgctgtcgggaggatggtgtagtagttgccacaagttcttcgggcttacgcttgcgatctttgtaattggtacttccactcccccttgtcgtcggcgtatctttctttggcttccaggtggtgcctgactgcttggatgcggtgacgacgtcttcagcttttgcgtactcattggccttttcaaacatctgcttgacagtcctgggaggcttgccgactaagagttcatgacgaatgcccttggtgaaggcggcaatgatgacgtcgtcggtgatatcagagatcttgttatgttgctcggaaaaacgtcggatgtaatctcagagggattctccagacttctggacaacgttgtaaagatttaactgagtaccagggcgttcaaaagtgccctggaagttggcgatgaagtggtcgcgaagctccgcccaagatccgattgtgccacgggatagcccatgaagccaggaccgagcagagtctgctagggccacaggcagataatttgccatggctttgctgtctcctcctgttgtgcggatcgcgagcctatagacagtgagctaagactcaggatttgtcgtgccatcatacttctcgattccagtcggtttgaagccggtcggccaatccactcgacgcaggtcacttgtgaaggcagcatctccatccacatcgtcatcgtaatgatccagtgaatggtgggggatgtagcctcttgccgtgcggcgctggttgatagtttcgcaaagatcgacgggacgactgcgacgtggggagcgaggctgttcggctcgacgctccctgtgtcggtcaggaggcgagtggacatatcgttcgccatgatccctactcctgcggctagatccggcgccgacgacgctgaggcttggttggtgatagtcttgagatcgaagaggcggaactcggctgccagtcggcgtacggacacttgcagagttcaccgggactgaagcgacgatcatggtcttgatctgatttaagatgttgacgacgtgattggcctgattgagtgcatcttccttaaggagagtgtcgagaagggtgatcgctgcaaccgcgttctgctggggggtgcgaaaaaccgccgtcccttcgacgtcttgttgcccaataagttctcgtgctcgtcgcccggcctccaaggcgcgctgtcgccggtcctcagcctccttcgtagcccgttcgtgctcttgttgctcacgctgtagccgttctcgctcttgtgcttgacgctcctcctccagtcggcgacgttcggcttcttgtcgcacatgctgttcttctgcttctcgggcttgacgctgttcttccgtgtcattgtcggccatgaaaacgccgaagaagagaggcgcgtagttatcttcgtggccttcgtcgaagttgtcgaggttgcggtagtcgtagtggtagtcgaagtagtcgtactctacaatctccgttggtcgagaatcgacaccgggggagctgaggaagccatacaattcttccgtcgaaaccgtcccgagacgttggagtatgacgccgacttccctggagctaggctggatcgaagccgaggctggatctggcctaggcctacgggaagaagacgcccttgtggtgaagactgtggccaagtcgtcggggagactcatcaggattgagggataggccccattgtcttgatcaggtcgtgttgaagtagattggatctcgtccgactggtttgaagccgactcggttgagatgatcttggagtagatctcggccgagttcgggataccgaacggggcggagacctggcctccccccgactggttcggatccgagtcgaggagagaaatcttgccgaagtcgttggtgatgaagtcgaggctgccaaaccggaacgcctgcccgggagggaagacgaagtcgtcgatgccggagacgaaacccatcgcactagtcggcgaagaacttgacactaccctacctggcgcgccaactgtcgaaacaagatttcggcaatactaaaagggggtggctatcaagctggaaaagtggatgggtttaaagacaaaaaattttatacaggttcaggccttcttaataagaagtaataccctactcctgtccagggattgatccgtcgagtgatctaggagaaaaatcgtgccccaagagacacccggacccctccttatataggagaaggggtccgtattacaaagtacagcccatactcctaacggaataggtagttacagataagatacaatcgtaaccgactaggatcccgggtatttccttgacataaaagtttggaatttaacccgagtccctttaaagatattctatctatacatggcaccccatacccagtcggatatacatgccgtgtaggtatggggtatccataatctccacagatagagtcctgagaaggcaattgtatctatcaattaggatattttatgtaatttccttagagatatatttgggcaaaagtctgccgcaaagacttatggtatcttagagtttgttagagataagagtcgtatccgataaggacatagtttgtaattctcgggtataaatagaccctgaaccccatgtaatcaatgaacacacatgttcaatacaatctcggcgcatcgccaccctttttactttcgttttgtttcgacgagttcttgctttcgggttgagctgtatcggtttcgatctttaacaagaggtaaaacttgttatgacggcttgcgttctcgggattagtgcttccatctttacgacactctaatcttgtttatgtaattcatcgagttatcatatatcctgcataatctctggcaatatcgttatctggcctacaatcggctaacatctatcggtagaaggcagccgattaggttaaatagtgacgttggcttggattatataggatatctaccactctatgaaacttctaatggcttgattgtctagatatttgtcacgcccggaaattcactagtaatttcaaacttatttgtgcataaaatcctcgtctaggaatcagccgaggtacacaaactgataatttaatatacaaatccatcataataataacgttacatacatacaaaagaaaagaaaacagcagcggaataacggtctagcgatggcttcagctccactcccacaagcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatatagtctcatttgcgaaagcagcatttagtaaagatttaagagtagtgaaacagtagagtaattaatcagaaattttaatcaacactgaacagcacacccatgctgctcaggcccaaccaaacctgaacaaccaaccccggtcgtacagatcaaacctccaaaccaggaatttaccattccaaaccaggagtcaaatttattatcacattattatcattaatgagtagtgtgggactaatcacgaaaaacattgctcaacccgcccatgaccgcgggcacggctattcgaatagttttactctggccagaggtataccactatacccacaagacacgattccacacatgttgccatgcctcgaagtaccaccacggcactgcaaagggggaaatcatgacaatacccttcgcacaacacaactcaccacagtgcaccattcctgaatcataatcaacccctctataaatataaccagaggcatggactccctagcgatccccacggacttctcaccgcttctcagtctggtgccccgtaatgaatcatgctatacaaaaggtaaagccgttgcccacgctggcttgtggttggcacggttaatgtctcacaacagtagctcgcgaaccggtccttaattgccataagcacgaccttcaaaaccatgtgctgacaacccaccattaattatattttaattaccaattaattatcataacacgattaaccatcgtgagctaccattaaatataaccataaataataatgtagtatatatgattcatcccattagtgagctaatgtttctaagcatggctaagcaattatatatataacatttagctgaaccaaaccaatacataaggttcaagctaatcaatttattacccaaggtatcaaggaatagggcattcaatgcaaattggccataacaaaggaataggttcacaccacccggtgacattcgaaaataaatgtacagttgaaataaatagagaatttaaatataggatcaacatgctcaaaggattgtgtttaggatctgtgtgacttgccttgcaataatcgatcttcaattaatcttcttgaacacttccgacgcactcacgaaccttcgcaacgacggaaacgacaaagctagcacgcaaaacgaagaaaaagactaataaaaaccaaataaacagtacaaaaacaagcataaacagtatatgtggatatttttaacatgtagatcttgattttagaaaaatttagcaactagaaccagtcgaatccgagttacgacgatttagttatgaagttccgaagtttaatcgattttcatctaataaagaaaacctagaaaaagggatttatgacgtcatcgctgacatcatcatcgccggccatggcacggttgacacgaccaccggcaaaagagggctcggttgggctatccgaggacacctacgcgtagaggacgacgacgcgaactcaccggtgcaaagaacaacgaaggacgacgacgaacgacggccggcgacgaggttcaacggcggctcgactcgggtccccgacggcgacgctccggcggtcttcggcggctgcgaaggggcggacgggattcctctcctcctcacgaacccgactgtgacgacggacggcagcggcgacgatactagcggcagcgcgacgcgaccggaggatcgccggcgacggcggcggctaaaacaacgcggcggcaactctacgggcgacggctcggttgggacttggggtaaacggaagaggacgactaggggatgctttatatcggcatgggtggaggagatcggctcaggaacggatggatttggtgaaagaagagtcgggcttatcccgagttcacccgaataaaaacggccaaaattcgtgagatagataacgaatttgatgggggtttcttcgggattaggtggaggagatagagaggaatccgtttttgcaatcaattttggaagggaagcaacggatgcaccggatttgatggaggaggaggcgactgcacaggttggctcggctctgtctggagctggaagacgacactgtagcagtagggaggccaactagactttttgggctgggccggaagggagcaacaaaggacttccaatttaataaattaatcaatgagatgagctttgaattgttaaaaatacttccaatgctcaaataatttcaagaaaaatcctgaaaatacttggacactcaaagtatttaacaaaattaaaatcagatcattaaatgattaatttaatatttaaataattgctgaactgctctttgtatgattaaaattaagagttgagctccgaaaaatccgagaaaattccagagagtataattaaccatggagaatttaataaaaattaaatccatccattctttatatttaggaaattttatttcccacatttaacttcacttgtaaattaataaacatttaatataaattctaataataatttattaaataatttataaatcctgaaacgaaaatcaggatgtgacaatattgtccttcttttcatacttatagctgtatcagttgagtttgatcttatgagtcatgattagaatctcaatctctagcctgcttcttggtagccgattagggtagtatcagggtttcagccgatcttacctgattgaactacaatacttgttttatatgcttcgttgatatgttaaatctgccctttatgctaagatcttatagcatttaaatatattaggctttcgtttgatatattctgcttgctttaatatcttaatatagagtggtatcggagtattagccgatacatgctaaatctacctgattggctatgctatgaacctatatagtcccattattaatatatatttcgatctaagtgatttatactgtctcggcatggcgaccgatctatcccaatcacttgatttaagtatatatcgatataaggagtatatattgttaatatctacagccaatcgagtagatttggttccttcttgtttactcatgactgtcgatcgatacatatatgacatcggctcaaaaataaatgatatgtcatcggccaagggtcgatcggctgtcatttatgaatttaaccgcggtttctttgtctttgttcttgttgattgcaggatcaaatcaactggcacgcttgcatacccgaaggcgagttttggacctgcactggagttaagcagatctcccaggcctcgtgttttacgtcaacacgcttttggcatgcccggtgggactgattagaagtcagagttttcctcatggatgagaagccgccagcatcgttgtcttcggctggtgaacccggctctgttaaagctaagatccagaagctaggtctatctgaagtcgaagaaggcaacatcgtgaatatcactccggacaagttgacacctgatcagcagaaggatcttgaagcaatgatgcaacaagcacgtaacctattcttgaactcattcatgcaaacccgcaaggggacagttgtgcagaaatatgaagtaaaggtagttgctgatgtccctgggaccggttcttctaaggatagagaagtgaaacaagctccaagtgatgtggctcaaccgagtgataagggtgctgcagatggttctcaaggaaatcaaggtgttggctctaatcaggatggcaatatggcgcagttacagtttaacaactttcaggatcaggttgactatgccgtgcaccatgctttgatcaatcaatctggaatattggtcaatactttgtcaaacatggtgaagacaatggttgatggttcaatggctgaatatcaggctataggactggtttatctaccaggaggggtgttccccaattatcggccgttagtcactgataatcagccagctgttcaaccaatttctctgaatgcaccatcagctcagccgacggcaccattatcggctccttcacctgctgcaccatcatcggcaccgggccaattagttaatccccggttgctggtgagagaacaaccacagcatagtggacaaaatgtaaatcggctaacgcaagatcaggttgcggctaagttcttacctcctcaacctactgttgatccaacccagcagcagccgattcagcaaacaccaccaaggcagcaggttgcgcagtcgattcaacaaacacccgcagtccaacaagttgtgcaaccaattcagcagacgccaccaagacggcagattttgcaaccagttcagcaaacgccatcaaggcaacaggtcattcaaccgattcaacagcaaggcttgatgaatgcatcggctgggtttgcaacacctggcagtcagccagggcagcatgctgcgaattaagttgtcccagagcacttggttcatcatgtacagccagatcaaacggtgatccctcaagttgttcctgaacatttgg

SEQ ID NO: 60603 - DNA, 827 bp, Oryza sativa
gagggggcatggaattttgcaggcggcccccttgccgccctgggggagggcgatttttgcctcccccctataaagcccagcccctcccctgtgaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttgagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatc

SEQ ID NO: 60604 - DNA, 1568 bp, Oryza sativa
aatatgatttgtttgtgtcatttgtgagagggaggaggccacacatgagtctgccacaccaaatctggttggaaaggagccaaatgattggaaaagtatatttattgtcaatctaacccttccatccaaacatctctagggctagagttagttcagggttagttgagagctggaaactaactctaacctctaactctaacccttagatccaaacagggccaatattaccatgccagtcaaattggtgtgacatcgttgttttgtcacatcagttgtgctggtgtggctaaaatgttcaattcttcaaaataagatttgaaaggtttatttttaatattaaaatttttaaaaagttaaaaaaaatcgatggcataggagtatatgtaaaagcagctactcaagtctgatctgatgagagtttttaatactgtagtggatatgttgagtactccagatgagattaaggccgagtttagttctaaactttttcttcaaatttttaactttttcatcacattaaaactttcctacacatcagggtatcccaaaccgttggggccggggttaccgcgccccggtggtaaagcacggttaccgcgcggtaaccgtgaaaaaccgtacaaaatttatcaaaaattcaaattattttttaaatttatttgaatttaaggatgttaccacgatatttatattaccgtacccctcacggtaagcccggtaaccgcgcggttaccggcggtaagagaaaccctgcacgcataaactttcaattttcccgtcacatcgttccaatttcaaccaaacttttaactttagcgtgaactaaacacaccgtaatacaggtgagagaggggggggggggggagggtgaatgacgtggcatgtcgacgatagacaagggaaggaggggtgtgggaccaggttagcatagggtggtctggctggaacgcctctctgtgctgtgctccactcccctcgtcttcttccttcctcggcccggcctcgctcgctgcctgccagctgcagctgcaactctccatccatcgatcgatctcctcctactcccccgccgccgccccgtccaagacaagccaaggtatgccaatccattcctacctactactacctcctcctcagcttcactcactagtctatctaatctcccctagtgagactgagactcgcttgccatttctgttcctgtgctaaattgctaagctacgggtagtgtcttgtgcagccagccaccactccctgcatgccatggcctcacggaggccaacgcaccgccaccataccgaggctccagatcctggtggaagagggagagggagaggccgtgccgcccgatatgctcagcctcagcctcagcctcagcagcagcagcagcagcaaggacgaggatgccgtgctagaggtgcctcgccgccgccgccgccgcagcagcagcagcagcaacagccaaggtctactcctactcgtgctaccactgtcaccgtggcttcctcttcatctaccacggccaccgcatcatcaagccctctagctcccgagctgcgccaagcaat

SEQ ID NO: 60605 - DNA, 697 bp, Oryza sativa
gggtgtaaactgaaaggcactaccacatatgagaatggcatgtgggacccagagccacacgccagtgacatgtcaaatggtaatgagaaacataacctctatatttggggtagatgggaggattatgaaactattattttgtattcaacgtgaagatgacaactagaatgatatgtacggtcctgatgttccactattatattttgggcatttatgaatgattgtttaactaaacaactgactaactgatggattgacatcattttcgtagttccatttttttttaaaaaaaataagtagttgtaaaaatatttccagaagacatactaattttcagttctattggttataggaaaaaaaacatgtgaatttcaagaagaaacatcgggtcatatgttgttgtgttgtcaaccatgcatgtcacatggaggtcgatgtgcatgaggctccagtatgagtatcacaaggttaggttttaatggaaacattaggaggcgcgagaaaaatcaagtaacgtagcaaacacttggtagcaggaacagttgtggctgaaatccataggtgaaagataagaaaggtcattttcatactttcgagatcttggattaaaatcttgaggtgtacacgttcttcgtcttggcgtatcttcatctctgttgttaccaaaacatgagagacacaacatttataggtcgcg

SEQ ID NO: 60606 - DNA, 629 bp, Oryza sativa
gtctaacactcccgtctctagcgagattcatttgtattaaacctttcagtcagtttccactccatgcatttccttaattttctatcactggtgataaccttattacatcaggtaattaaccctagctagctagctactccttctctctttccgttttaaaatataataaacataggatcaaattagatatcatctagtacattaattattacgaatctagatatagcgttactgaaattcataatattattagatggtgtctaatctaattctgccttactgtattctgagacacggggagcaaataactgagatgttggtttggcagttgatggatccttccaacacatgtagcgtcaagtcgtcacgccgatcgagggctccacaccccccgcctgccccgccgacgtcggtcgtatcgtacacccaccacatggccgcgcgcgcacaatgcatggcactgcagctacctacctgcatgctacgccgtgcgtacgccggctggaggctggccggccgggccggcgaccgcgcgtacgtcgtcgttcatcccgaaataccaacagcagcagcaccagcatctactccagcatactccctccatcaaaaaaaaaaagacaaatcctagt

SEQ ID NO: 60607 - DNA, 4814 bp, Oryza sativa
ccggatgcctcaccgatgacggcatcccgtatgacccgtcagaggtgacggtcatcagtgaccatttcgattgcccgtcacaggtatcccgtcagagatgtgaggatctggtgtagtggttcaacatgcaatatctctgaagatgcttagttgagtgtgtggtgggctctgcttcaatacgcaccatgttttttgcattttggatggatgtccttgtcagcctacacgatcaggagtcaaacaaaagcgctaagaacctaagacccttctttttcagactttaaaactgaagaccgagactaaacaactcgtatagtttaacggattatagtggattgtttatacatgagaacaatagttttatagtattcaaattcaattgtgacacaatttggatctatagtctgctatctgcaagagattacatttcacaatctagcttattcctaggtttttctgctaggcccgttttttttctagtgttctacatcttccttccacgacaccaccattttttctcatcctaaatagctagctgtaaattaaaccgtcgtcaaaacatgaaaaatgaaaaaaaaacctagccgattttgttgtgcaattagttgcacaaaactacttgatctacaactttttttaaaaaatggaattatatcagttgaagaaactaagttcaattttacaaattattaacgcaactgtgtagttcttatatataaaaaaaaataaacaccagtttaatatttatatatttgatcaattaatctacaccattacaatttattacagttaagtcagttctcttaagttatttactcattcctttggttttgtacttggttatacattcctgcacgaatgttcgtaacccatgacgtacgtttttggagaatagtcatgtgttatgcatgatcttcattctagcaaataaactatatattcatttgtgacgactggcctgcaggtttcttggacgaacctcatatagatagagtcaaagatatatctgggactatatggcattagagaagagagtaaatgttgcttgctaatgtcgatatttgccgtgctgtccaagtttaattattttaattgtttgtttttgtgtaatgtgtcaaactaatgggtccctctcgggagatcttttctccctgcaggtaccaagttcaattgggtgaattccacacaattgcaatccattttcttaggaaacatgttgatggaagacacacatgtctcgtgtggtagcttcctctgctctgctacgtactgattgattctttcgttgattttgacgtgagcatgaattttccttgcatgattcgagcagtctcattgcttagtctgcttaagtagctagattaattctgagaagcagctggtgagtatccagttaaccagaatttgggatagctattgaggcttgaatctatattaattagcagtgaatttctaaaacctatatggtcattttaagctagcacgtggttttgtcactaacttatactaccttcatttaagagaaaattgcctttatgggtgtgtttgattgcctacattgatcttgacgtgtatgtgcgagtgcaggtgagtggtgtttggttgtttgcacatttgtccaatctagaccgaactcgtgcgaaaggcaccttggaaccaaacccaaagagaatacatgtttcaacctttgctacctagccaggcccgacgcgtgcaggcgtggtgcaacagtgcgagcgtgagggtaggcacggatgcaggggtgtgggttgactcatccccccaccccattcgtctcacagaagtgcgaggaactcgaccttgcaaagggtgatgagaaaagctcgacgttgtctccaatccacttgccggatcgccatcatatctcatccaaccagatttggcttgggatggtagctatgagcacgctgtcactatatctggcctgcacgagcttactatcatcgtcctcttcttgttgtcgcctctactgttatgccccaacatcatctcttcctcctccttgtttagccggatctggtagcaaggtgtatgaggccactagatctgccatcttggttgccaaattcgaccactccggtgatgacaagcaacaatgacataggagcgcgagcgagatagagaagggcggagagcgagagtaatgggcctagaggagcgacgaacggcaagggagagtgggagttgttgtcggtagaggaagtggggaacgacaggtggcagaaaagttgggaatggctgacaatgcagtggctcatcgttttgttttttctttcttttcttttttcacctgtttgttgtaaaaagggtcaaacacatattttatttttttagacaaagaatgctacaatgatttcacacatatattattttttatatgtaataacttgtttacatctactaattgattaaatctcttttttttatgatatgatattatataggtaaccttatccaactttaaattttaaccacacttaaattcaaacaaccaatcaaacaaaatcagttcccaactggattactcatagaagcaattagataaaatctgatactatcttaggctaattaaattagtgcaaataaccaaatagttgtctatatgtgtacctctctagccaaaccaaattcaacctaaaggagagacgagcatgctagagagataccagtatacaaaacatacacttatttataggacaaaagtttaaaatttaatgacatgggcttacttgaaaaaggagggattggagtaactatcaagggaaaattcaacgtagtactttctgatgccactgcacagaatggaaaaaatgcagtacctttgcatcgatttaccacatgtggttcaattcactatttccatttgattgattccggaaataaatgcaaatgcattttcttccaaattgtactgcttttacacgcgcacgtgcgtcgtactgctagagtacgtgccggttaccatcagtacccacgaaccaatatatgcgcacaaagaaaaatgcaggaaaaaagcacttgtaaaaatgtcaattaagcagaaaatctcatgcatgacgtggcaattcctgcacatacattatccatccctacagggcacagtatactccacatcactagtactatactactatgtactatactagtagtaatatttatccagaaattaattaataattaatcatgttaaccaattctacatattcaacctcgtgctttgacttgctagctagtcctcgggcttcaggcatctgtcaggattaggtgaagattaccacaaaatgaatcaattaattagggtgttttagatgttgccatgaagctaacagagtgtgatattctccacagaggccactgctcggccgagccaggacaaattccggtgagaaaaaaccaataatgcacactgctggacaacggcgacgtgtacccttggcacgtgcaatctctcactgtcattttggtagtttatgcatgaccggcacaaggcccaatgttaagcttcatatgtgcactaaattacatgttgtatctaatgatcgatcattgggttcagattttgggaaatcgagacagaatgattgtttgatcgacgccggcacatgtgtagatatggttgttaacaaggggattaattaacggaagctagtgtatgtgatcagtcaatcattggcaagattagtccagatatgtttagcttaggccctgtttagattaattggcaaaaattttcactctgtcacatcgaatgtttaaacgcatacatgaaatattaaatataaacgaaaaaaataactaattacacagattacgtgtaaattacgagacgaatattttataaatctaactgctgcatgatctgacaatgtggtgctacagtaaatatttgttaataacggattaattaggcttaataaattcgtctagcagtttacaggcggattctgtaatttggtttgttattagtctatgtttaatactttaaaagtgtatccgtatatccgatgtgacacgccaaaactttacccccttatctaaatacagccttaattaagccttaattaggtagtaactaatgagtatatctgtggtggaataaagtttgcttgttgcgttgccgtcgtcgcaatcagcggcacatgctgcaggggggagaagacgccatggagggacagcaaggccaccatgcgttttgtgcagatgcagccatggagaggtgatcgtgtttcgattctcgtatcgatcatttttgccaatttgccatggccggattacggcggcggctcagctttgggcagcacaaaagcagctaggtgacacggtagaggtcaagagatggtgagcagactgtttttttttcttcacttctattccaactcacctttttcgttttctgggtatacgttttctaaatttctaaacgagtatgttttttagcaaaaaaattctatagaaaaattactttaaaaattatattaatctatcttttattttttaaattaatatttaattaatctcgctctaatcgtttgatttatttttcgcgtcaggaggcaagtttgggcgatgcttttatggctgcaatgacggctcggcccatatgctcgattgctgcggcatgtggcccaggcgccgcggcccgtgcatgatcggggcacacccaaagcgttttcagttgttaggatgtgtttggatgaattttttttatttataattttttgtattaaaagttttacaaaaataattttccattttgaaaattgacggaaatagtcgcctaccgccctctggga

SEQ ID NO: 60608 - DNA, 1283 bp, Oryza sativa
gatttatactgtctcggcatggtgaccgatgaccgatctatcccaatcacttgatttaagtatatattaatataagaactatatgtctttaatatctacagccgatcgaatagatttagttcctcactgtctatttataaccgccgatcgatttatatatgacatcggctcaaagataaatgatatgtcatcggcacctagccgatcggctatcatttatagatttaactacgaattctttgtctctatttcttgttgattacaggatcaaatcaactggcacgctcatacattcgaaggcgagctttggacctgcactggagttaagcagatctcccaggcctcatgttttctgtcaacagaaatgctagaatgacttacattgtgaaacggaggaagttacctacagctggtaaattaaggatgagaaaattcttcttaatgcctctgaatttttcacaatttctttaatcttcctaagtttttgccatcttttttaagaccattatgatgctctttgctactagtatttttctatcagtattatcatattagaagtgataccaatcgttaatttacgagttctaccagcagaaaaaaaaatattgtaatacaagtagttgatgtggttgtgtaaatagctatgatctattggattaggaaaaataaagggtttagattgattctactagtagaaaatattgtaaaacacttttttttaaccctgacttttgtatattgatgccctacccacttattccgctagttgactgtcaactgactaatttttttttccaaaataactatatatactgccccgttttcactgaataataattttcagttattaaagaaaatattagagtggccgaatctcatggtgtagagaagggatagagtgaaaatttagaagcacgttatagggaattttctcactgaattgaacaatgaccggttttcaactatgcacgaatatgatcaagcaagaaaataataataaaaccatcatatatatatacacacacttttgaggcaatgtctaaaaaaaattgatcacaaaaactatttgaacaaagcaggcattcttgtttgaagaaatatactagaggaaaaaatggaaattgtgagatacctacattatatttgaaattactaaaactatattatattgaaatatatgttgctcatatgggtgcacgggtcgacaaccagtagatacaattaggaatgtcaacggggaatgcccccgcatggaaatgtattctcatctacgttctcacaag

SEQ ID NO: 60609 - DNA, 5805 bp, Oryza sativa
cgccgccggtgaggttgttctcggcgacgttgaactgcgtgaacctcgcgatgcccggccatagctcgccagtgaagttgttggtgctgaggtcgatgtactcgagcttggggcagccgtcgaagaggccggtgatgtcgccggtgaagccgttgccggagacgttgagcacggcgaggtcgccgcacgccgccgggacgaagctcgccgcggcgccgcccacgaaccggttcccggacacgtcgagcgtgcgcagcttggtcaggccggagacgtcgagccccccggcgatgaggttgtgcgacaggttgaggtgcacgaggccgcggcattgggcgaggtcgccggcggggagctcgccgccgatgccgttgtcggagaggtcgagccacgtgagcgccgtgagccgggagaagttgccgaacgcggcgccgctgatggccgagccggagaggtcgagcgccgtgacgcggccgcgcccgtcgcaggtcacgccggcccaccggcacggcgacgcgtcggactccggccaccggtcatactccccccggttgaacctgttgttcgcctgaagaaacctcttcagctcgacgagcacctccctgtcgtcgtcgctggctaccaccgccacctgacctacaaaaaattcaccaaaattcggtcaaattccgcgcaaaaccgagcaaaccaaaccaaaccaaaccaagaacagagagctacctgcgaagaggagtaagcagaggaatccaagaagcaggggagacatggcacgccttcgagaatcatggaagaacaaggggagctacgacgaggacgaggcgggaggacgaatcctcatgtgctagctgcgtctccgcctcagctaccgctgctactccgtctcgccaattccagtggcaagatagaaagaagaaagtgagagggacgaactgacgaagtgagatgagagtttagaaaaaaaaggataaagtttttgagtgctaaaccggaggttatttaaggcctaataagcgacatgtgactgcgttgaattgaaccgggtaaggtaatggccgtcgctgtttcatacaagtagtattcctctcttcttctttttttcttttctcggtttttaattggggtttcaaacttcgccactgctgctgaccacacgggggacacagggtgatggaccgactgacgatggctcgttggttatggcctctgaattttcttcctctcctttatagtacaacttgtactattttccttccctcacaaaactgatgaaatttcgtaaaaatcgaccggcttttatgaatctgtcagatatgaaaaaccaattgccggttttcgtatgacattgatcaaaatttatcggtttttacggtttttgattggatttcagtaaactaatgaggagcggcttttactttgatatcgaaaagttagggccggtttgatttgaggcctaaattaggcttaccaatatttggtaattttaatagtgtttagtgtctatttgttttgaagccaaattttggcatgcctaagaaaataggacatttcaatagtaaacttaggctattttggcttcaatccaaacacaattttaccttatcaaaattagtaatgccaaaatttggcattaacaaaatttggtaagacctatctagaccataaaccaaaccaacccttaaacccttgctactacctttctgctcaatgtatgagctgcgagtataactgcgattagtaacgtaccaatcgacacgtctgaaactaattcccgattaatcacgggtttttttcctatggtttagaagttaatctcgtgggtctctcttgcttgttggaagaagagggaaggaaagccgccgttgttgacgacgagcgactcggcctggtcgggtcgggtcagtccaccaccgtgccggggaggagaagggcgcgggcgcggacacacgcacgcgcgcgcgtgatcgatcgcggatgcgtgcgggcgaccaggcgtgcggcccatgcatgcgctgaccagaacacgaacagcacgcggccttcggatttttggaattttccaggcggaggaggggctcgcggtcgggcggagtaaactgtaactgcaagtggggtggggagcgcgataccaccgcgacgatgcgtgatccggcatgagtgagtgaccggcgaccggcgatggcgaagggggcggatgggcgcgccgcgcggtggtcggggtggcgctgttgcttacgctgaactagtttcagtcgtatcctatctagggtttacgattccaagatggctgtctatttcgggctatggcgaaataatggttttagcgaaaaccggtagaaagccgatatattctgaacaaatttcacaaaccaaattttgaatacagattccttaagtttaccgataagctcgcgaaaactcgtcggctttggcaaaattccgagggaaatcattgaaatttcaattgtagctagaaaaagaggtaaactgaaattgttttccttttttaattcgttattattttctttactactgtaaatctcagtaaatacacagaatacatcaattttatcaaaaatttatatcccaataggttctatgaatatcgtactattttataagattttattttccttttttatccattcaaatttgaatttggatgaaactcatcgaaatctcagacggcttctactttcgagcctcgtcgaaacctcaaaatttcacagaattcgaccggttttcgtcggaattgtgaaccttaatcccatcctacacccaggataacttattttggaatagagaaagtagttacgattcgacttatctcatcatttgccctataataaataagccgatgttaagatttaaattttaaattatgttgtttattttaaaacattaacatttaatcactaaaaatacaacatgtatataaaatttttagtctaattattcttttttaaataaaccgtttaatatataaccagcctttggcctactaataggattctatgtgtccgcggacattattttttaaaatatttaggtccttgtcatatgttcattcgcttataggctacaactaaaatttaaaattttgaaatgtaattttagtcctacagttcatttgacagtttttaatcatataatttatttttcagctttggtttttatattgctaatgatataaatataatattttacactcaatcatttttgttgcttcattcatttcaaattttggttgctttattcatttatccatgacgtatgagtggtactaaaactgattagagatcctgtcgggtatttaggaggtctgaaattatcgagttattcgaggttgagtaatacgattattcttaatcaatgcatgtacttgtatatggaggtgaatgctagttgcttttgggttttagaaagggtaggggttcgaatccgaatcgaactcggaattattacaatccagcccaaggcaggggatgctgtacaaagatttttgcacttctagcgttatctgaaaaaggaactttgcacaaaacgtaaagcataaaagaaattgagaagatggagacctacgtgcatagcaactttagcaagatagatgcttccaagtccaagctcgagctaccatttcaagagatatgctcgatgggattctggtttgagtattgaaattctgtctaaccatctatatatgcacatagaatgcacaaagaaattatgtataaccatctatatacagggctgtgttctttagcctaaggtcccaactcatctccatcgtttttcgtgcgcacactttttaaattgcttaactttttttaaaaaatatttatataggaaagttgttttttaaaaatcatattaatctatttttaagtttttttaagttaacacttaattaatcatatattaatccatcgttttattttgtgtgggtaggggaggtcccacccctccaaaaaaaaaaaaaaacacagccgcaatcatgccctttatattattagcctaaagttcagcacacaaggcctagccttttaattaacctcatcatatatgcatgacatacatcaaacaccaatatataggataaatttatggtgggaacttaacctatgtgaaaactcatgtaagccacacccgaaaagccatctaaaaaaatcccacatgaagctaaaatgatgatgaatagaccgtgtaaagaatctttgcgggatataaaaacaaatttcgaaccagaaaacagtgtccaatcctttgtctgaaatttgtcatttttatctcacaattgaagttgaatttaggcaagatttttcacacaacaattcatcgtcatctatctacatatgagatttttttttgtgattttagatgactttgtggtgtggtttacacgagttttcacctaagttcaaaatcttcacttcttggcgtgacaaagcttgcaatcccttaaatcttttctttttgcagggacaatatctcagatatgttcaaacatatacttgagtataaacgcaatttgcttggttcactacagcagaacaagttagcagtgacgggctcaaactctcatctgtgacggatacaccccctcgtcacagatcagtggtcactgatgactcaagtcatctttgacgggtggaggtccgtcagaggtgtcattcccctctgacgagttgtatcatgtgacccgtcacatatgagaaaaatcaccccaaaaaaaaaagcaaaaaagagccacaaccacagctcaacacccgtcactgatgtagattccgatgaaaaaaaacaaaaaaaaagtatttctgggtagttgccatcgcattcatcacacacaaaaatctagaacatttcatcacagataaaagtctttatgaacatatcacacataaaacagccatggcaagcaagcaattcatcaaacacctgacgagcaacaaaaaaaaaacgaaggtgcccttcttcttctctccttccttgtctttctcgatcaatgccttcacaagaggaataatctgcaaggcaaaaccaaatcgaatcagatcaaattcaccagaataaccacgagagagatggatgcagaaatcagatctgggttcaaatcacaagttgagatcgaatcataccacgatgggcttgaactccttggcatgctggaccttcttgagctcggtctggaggcgacctcgtccccattgctgctcgacgccgccctcttcgccttctgcacccgggaagcggcgtacgggcggatctgcacccggcagttggggacgcagccggcggacggaggagacgacgcccggcagttgaggacgacggatccggcgccaggcggacggggattgaggccgcggcgccgccgctcacctcctcctcgcggtcgaggatgcaggccgccgaactgccgctcgccgttggaaccacctcgctgcaagaaaaaccggatcgggaagggggaggaggggagaaagaagggggaggaggatgggggtaccgccgccgcaccacctcgccgccgccacgcatcgctgagccaccgcccagcgtcgccgctgccacgcgccgccgcaccacctcgccgcttcgccaccgcaccgccgccgccgccacgcaccgctgagccgcagcccggcgccacgtgtcgccgaaccagagccgccgcccagcgccaccgccgccgccgcgcatcgccaaaccaccgccgccgcctcgcccgagctagggccgtcgggtcctccgccgccgccgcaagtcgtgagagggagagagagagagagagagtgaggataagggaga

SEQ ID NO: 60610 - DNA, 2672 bp, Oryza sativa
aaaaatacctaaatatttcagaaaatttgtatttcatttaattaaatacctaaatatgttttaattcaattttatcttttttatctttacccgtagcgaagaacgggcattttgctatccattaaaacatcatgtggcatctaaaccgttacatggctctctaataaattagtgaaatctattatataataaagtccattaatctttttagaaatacttttaaaccgtcatggggcaacctacaaatgctcgtaaaccatcacatgacactctaataaattagagaaaatcctagaaattataagaaaaaaagcaaaatatctagccatctgttctaccttaaattgattttatggacctgttattttcaacctttagatcttgagatgatctcaaatatatgtctaaaaaaatctcctttatctcggcatgcgtacttcccctcctcccttaacatacgtgcatgtccatgtgcaaaagttgcgttttgggttagcagaatgaaagaaagggactgtggatgtgaattgttgatcttcgatcaaacggctgtggcactttcaagtgatttagctgaatgtcagcacaggaaaattgatattaactacactaagtggggatgaagtgtataggtttatattcaccgtgctctgctttccccacctcatccgtactcccgctctcgcatcttcccgcgccaccagaccgagtagacttcatggttggcattcaagaaaccatcgccctgcctccacatcgatcatgctcagccgagccgagccgagccccttccttcccctcactgaattcacctcctactgggggtctccatcaccggaaagcgtcgttcaattcggaaggttcgcttgttgaaccatatttgttcactcaatcttttggtcttgatttcttctttcattcacgctctattgatgcaggttgatccgttcctgttgtccctcagattatttaagcattaaaaaatagagagagagagagagagagagagagagagagatttggttttggcaattcttcaggtttctactatccctattcaacaggattcaaactttattcagcctgctgtacactttgttaaaggatccaattcattcgtggtattagatcaggactctaaacatcactggtgggtataccaattttacatcattgctgcacctataatttgttttatttctgaattccgattgcagaacgctgtagtagtagtagcagtgctgctactaaaacaaattataaccgtcagggatgtaacaatccatttactttatgtccaaaaacttacgtcttttgaaatgtgctcaattgaaaagacaaactaaataagctaatttttcatatttataagtggactaaaatatattctacatcctcgtttaatcgactttataagttgttttatataaactttttagtatatcacaaattcatttactttctgtgcactttaatgccattaaaaacacgaagttgtctctgctgattgatttgttggtcttacagccgtgccaagccgccgctaccggccgggaaggggggtgcaagcgacctttgcttgacgccggccttgcattgcctcgtcgccaacaactcgtgggcctctccgccgctggtgtcctgtcccgtgctagctgtctccctttactggacgatcgcctcgcctcatcgcccgccaccccgacctctccaccggccatctccgcaggttgctccacccccaacgctctctattcgcagcgccatccaccggcttgcttgtttaggaaagaagtttggtcccggggggcaaatctatcattttacgaaaattctctctccaaaaatagcaggaaatcattaaataacgcgtatggtgtctatcagcaaactaccacattttgttgagtgtcccaagaaaattcaatcgagttcttacagtgctcccaacaaatgtttttttaagtatcttgtagcaaattttaccagaaaattatgtatatgttgttttaagcatagacaagaaccctaaggcgattaattccccggggcaaggatgggaacaacgttctcccccattgtatttgccggtaataggtacagggatttttttttttgacttgtgagaacgtagatgagaatacatttccatgcgggggcattccccgttgacattcctaattgtatctactggttgtcgacccgtgcacccatatgagcaacatatatttcaatataatatagttttagtaatttcaaatataatgtaggtatctcacaatttccattttttcctctagtatatttcttcaaacaagaatgcctgctttgttcaaatagtttttgtgatcaattttttttagacattgcctcaaaagtgtgtgtatatatatatgatggttttattattattttcttgcttgatcatattcgtgcatagttgaaaaccggtcattgttcaattcagtgagaaaattccctataacgtgcttctaaattttcactctatcccttctctacaccatgagattcggccactctaatattttctttaataactgaaaattattattcagtgaaaacggggcagtatatatagttattttggaaaaaaaaattagtcagttgacagtcaactagcggaataagtgggtagggcatcaatatacaaa

SEQ ID NO: 60611 - DNA, 13308 bp, Oryza sativa
tgcactgcactgtatttcgtgcggcgtgacacgtttagccgagccgcaataaatgcggttaggtgagccccgctgtgctcacctaacccatacacgcggagtagaacccgcgaggggtcggggcgcctcggccctcgggggcgaggcaggagtggtccgaccccccctcggggagaccaagaggtgggcgcacacatcaccctcgggcccgacgtcccccgagggtgccaggccacgtgggcgattgtgtctgcctcaagcctctagtcgtgatactcccggtcccatgtcaccgacaatatatatatatatatatatatatatatatatatatatatatatatatatatatatatatatatattgtaagttacttttgtcatatatgtgatttaagctctttaataacttatatattttaaatcacgtattgtttttggatctatttgcgtcattatgctctacataaaatatgtgacaatgcaatatccatattggatatatattcaaatattttattaatttaaaagtcatgtatttaaattgcagagtaatttagctatacaatagaagtaacttagctatataatagaagtaacttagctatgcaatagaaataagtttctgtagtagaagtaattatatgcaacagaagtaatttagttatgtaatagaagtacttctaactctctgtagtataaataataatttacataaatcataaaagtaacttagcataaaatgcaagtaaattgttacaagtaaattcgttgtaggaaagaaaatatggtctatcgaaaaattaaatttaaagtccacaaattacagaattgactaaaaacaataatacaaataatcaatttagagcattatgaatgtataagaagtaacttagtcaaatataaaagtaatatatatatatatatatatatatatatatatatatatatatatatatatatatatgataaaagtaacttacgtatataataaaagtaatttacaaacataaatattttttcgtcgcaatataatcatgtaagatcttgttgtaaagatttaattgtaacgaacacaatggtgtaatcggattgtatatcggataagtaattttagagaaaattttataagaagggtaaaaagaaatgcatatctatatagatgtgtaggcgtttgtctgctgtcttccgttcagatgtgtaggctttctctgctatgtacgtaagctttctataccgtctccgttaagactaaacagagaggcaaacactgatattttacaaagtatatctgtggattatatgagccattaatatattgttattgcgcatgtataggagacatggaatattgcgtggagttgaccagtatgtcggcactttgttggcgtgtagcaaatgtcatgatgcaaaaattctatgggcgccataggttttcctgtggtggaacgagttgacgtgagtttaaattctagattagtactgttgctcgtatttacggtttttttttcataaataaccgatgtactctttaacaataagataagacctttgtcaatctcgagttatacactttcggtgagttcgtcaattataatatatacaccttcatcaatctcaagatgcatgtgctggctcagtattcatataagtaggggtgtgcaacatattcatgtgtatcaatctctcaatatgcatgtcggctcagtctttaaatgtgctcatatgggtaaaggtgtgtgatacgttcatgtgtatcaatctcgatatgcatgtgccggctcagtctttatatgtgtttataggggtagggatgtgtgtgcatatttatagaggtgactgcgtatgtgtatatataagcgtctacgtttgtgtcttgtaaaagaaaaaaaaatttaaaatcaaaagtaaggtagaggcacgtgagaaaatgttttttttcttgactatagacgtttttatttgtcattttgtgtttagatgattctgttaatccctacgtgtaaataatattcttctagttacttttagcagggctacgtgtaaacaatattcttctagctacacggctgagctactttcttattatttgtagacacgctttctaaactgttaaacattatattttcgtgaagaacatgtgtccagttcagcgggaacgtgccagttacatggttacgggacgagttggatgcagataccacaagcaaacaagaggtggcagttacagtctcggtaacatggaaagtcaaatgcaagtaaatacttcatccattttatattataagtcgttttgattttagtcaaagtcaagcagtttcaaatttaatcaaatttgtagagaaactagtaaaaatttcaatccaaaacaaatacatttatgaaaatatattcaattatatatttataatgaaactaatttgataatattactatatttttctataaacttgaaatggtttgactttgactaaagttaaaacgacttataatttgatacaaatgaagtaataaggattggattaagtcaagtatagccttctataacttgtgttaaagcttaaatgtgaggcacaaatatgtgactgttgtgtgtttcgttgctagttgctacaaacctgcaaacacacctcttatttgtttataaattcaaaaagacaatgtaagctaatgtgcatgcagttcaagattgacataatacctcctttgattggagtagatagctttgcaagccggtggttgcatattagctagggaaggaccaaattagagcgcaagaaactgcactccatcgttttggttactgggatgatccacaaaaatgtaagaccagtgtctttcgtgggatgacatatacggcacaaagagctaacaaagacaataacaatgatgaaggagctatgaatttgattgtatgtaaggatctagactaatagctaaaaaatgttctattttaggaggtagtataatatagcggttatccggctcatgcgagctagctagcctatgatattatatatgagtctaagctgagctatgtgatttatgggtccgagttttttttctcaatccatggttgtacgatgtttttgtgagcctcttaagttctacggcgtaattagctttggccaacaatttatttaccgtgttttatttatattatctatggtggtgtttgaatctcctgaaaataaagacgaagataaagattaagtgtttcatgcaaaaatgaattggtaataacgtgtgattaattgagttttaattattacaaacttaaaaaatagattaatacgatattttagagcaattttcatatagaaagtattcccataaaacgcaccgtttagccgtttgaaaaatatgtcactgagtatccaaaattttatctctgctagtagaggaaacgaacagggctcacattaaagaagaatgttgctaagcaaaatgcaagtactcagccaacaacccacttgctaaccaaaacctcgatatctatcacatgaactaaacatggcacttgcaggagcatcaacaacaacccacctgacacctacacttaaccctaacctgaaacgcaacgaactgcaagttagtaccactccacgtgaccgcgcgcccatctagcacgtcaaaaacgctcgcgacgcgcagtagaaaagccacccccacccggtcggagtcggaaaccgaccgagcccaacgcaccgcaccgcaccggccaaccagtccacggactcgcgagcccaaaccgctcagccgccgatggcgacgccgccgccgccgccggcgccgacgccggaggtgttcgacgtcgtcatcttcggggcttcggggttcaccggaaggtacgtcatccgcgaggcgctcaagttcctgcccccgtcgtcgtccccgctccgctcgctcgcgctcgccggccgcagccgcgaccgtgtcgccgccgcgctccgctgggcggcggggcccgggggggcggcgcccgacctgccgatcctcgtcgcggacgcctccgacccggcgtccctcgccgcgctcgcggcgcgggcgcgcgtcgtgctgtcctgcgcgggccccttccgcctccacggcaggcaggtcgcggcggcctgcgccgccgcgggggccgactgcctcgacatctccggggagcccgagttcatggagcgcgtcgaggcggagttccacgaggccgccgccaagaacgggtcgctgatcatctcggcctgcgggtttgactccatccccgcggagctcgggttcttgttccactccaggcagtgggcgccgccgtccgtgccggtgactgtgcaggcgtacctgagcctggagtcggacaagaggatcgtcgggaacttcgggacgtacgagtcggccgtgctcggtgtggccaacgccggtgaacttcaggcgctgcgccggtcgcggccaaggcgacccaggcccaatgtgagctaccgacttctctcagtttgtgaattgatttacgagttctatcaaatgctaattcaatcatctataaagttgctaattcgatcattcaatggcgtggtagttgataagggaactaaggctacctcaccgaaacaacatttgcatacagttagaacttagaaggatgattcgtcccctaattggatatgctgctcagtgttgataaccttctagttttattggtccattgtgaaatttcttttgttattggtgtcattgacttattgtgaatggttgtgatttcctttgtgctgttttctagtttgcccgaggatgaaattttccctgttttgatatagaatacatcctaagtcccaaatgctccaaacattgtttgacaaaatgatgattggtaatgacaattggttaagagcaaacttattgtccttatgataaaattgagaatttggtttttgtcgatcaatgtttatttcatgctgaatagagtttttcttttgaagggaaaacaacacgagattgtgccttttcattgaatatagcaggaaaaaataaaacccctaggggtatgctgaatagagttttgtactggagcagtacaattttattttccaaacgaggaatagactcttaatataagtataagatggttgaaggttacagaatagatacaatgaagaagggcgatccacatatttcgactgctattaagacgatatacaccactactgatgtctgtgaaacatgctgtgtgggcgccctttaattaactcagtatcattctttccctttttaatttgtccacaaaagatctatatgtcctactctaaccatcacctttgtttcaagtggtctgttgttggtacttggtacaatcacatgccaagcaaactctgccacttaatccactattctatcaagttgttgccatattatgcaccatctttgagctaatgaataacttttcaccttttttagaaaaaaagtctcggtactgtcatactggtgacatgtaaactaaatgactggtaccgtgccttttgtgtgaatgtgacgctaatccatgaggaataggttctcttgtttctttgtgcatcatattgacatttgctagttctttatgtgtcttacatgtctatatgagtactccacacttccccttgatgtccttgataatgattaattgcttccctctccaagttgttagtattgtgttcttagggcctgctattttcttccgctctattaatacatgagtcaagacagagcctcttttctttcacagggcctgttatcctttgattaagatcagagtgatgtattaacctacacgcctaattttaccacaacaccaaggctcttaagtatcactgcgctattttcacatagaaatagttaaaatcctacttaatcatgaaaactagcatggctagccgcgcagattgcgcggctagcatcattatattttctctcgtataatagcatatatgttttctcaatgtattattcaaatatattaaaataacaacataattttaaattttgtgctaacttacgaatctactaatgtgtaaattcatattgcattttatatacgtgttatttattaattatatttaatatcaaattttagttatttgtaaattatattcctatatggactctagactcgtctttcaatattattttaattccgaattttcgttatctgtaaattgtatttctatatagaatctaggctgttcttccaatattatttatttttaattctgaatatttctattatttcgatgtggactctaaactcatctatcaatattctttaattttaaattttgaatttcagttacttctaaattgtattcttatattgactttagactcttcttcccatgtttttttaattttgaattttagttatttgtaaattgtactatttttatatgaactgtaaactctactttcaattttattatgtttatttcgaattttagttagtttaaaattcctatatggactatatactccacttctaatattccttatttttaattccgaatttctattatttcttagttgtatttctatatggactttatactctacttctaacaatccttatttttaattccgaatttctattatttcttagttgtatttttatatgtactctatgctctacttctaatattccttatttttaattccgaatttctattatttcttagttgtatttttatatgtactctatgctctacttctaatattccttatttttaattccgaatttctattatttcttagttgtatttctatatggactctatactctacttctaatattccttatttttaattccgaatttctattatttctgaattgtatttctatatggactctagtctcctcttccaatattccttattttttaattccgaatttcaactatttctaaattgtatttctatatggactctgtttttctttttctccgattaatgtgggaatttctaagccgtgagagcgaacgtggaggcttctttttctattcctttaataagttaatagatagatcttgttaaatggcaggctactgccaaaatatgaagagagcaacaggagttaggaaagcaatagctacatgaatttatgatgtaaagttgactttaatgtgttttttcattttagttattgacctattgcaatagaagtaagagggtgaggaagggaaaaatctcaatgtagaggaactaaataaggaatttgattccacagtctgttctgaatgaatatccaactaactgttgcaggaatcttactcattacaacttatgagttgcaaatttgagaattgcaaaattttgaagagcatcttgtaagatgtttcttactacttaccctattgaaggactgaagcatggaaacacttttcatgttgttattgttgttgtttctgctgctgcttaaactaaaacccttaaattcattgcatgcgatggtgcctattgggtgaaattatgatagaaaccaaactattttctttggagataataatcacatttgatgctaacgcttattgctttcgacagattccaggccctccacctcccaaaggatctctggttgaacatgacaaggcactgggattgtggactataaagttaccttctgcagacacagtggttgtgaagagaaccctatcaacagtgacacagcatcctgagggccttcctggggtggaagaatccacggatttcgctgagcataggaagagcttctggtcttctgttaaaccagcgcatttcggagtgaagctcacctccaaatccttgctgggcattgcgcagttcatcttcactggactctgcatcggcctgctgggaggtttctcctttggcaggtccctcctactaaaattcccctcattcttctccgctggttggttcaggaagagcggaccgacggaggaacaggtgagcagcgcctcgttcaagatgtggttcgtcgggcgtggctacagcgacgcggctcgtgcatcggaccgcgggagcaagcctgacaaggagatcatcacgagggtttcgggaccagagatcggctacatcacaaccccgatcgtcctggtccaatgcgccctcgtcctgctgagccagcgagggaacctacctaagggcggggtgtacacaccgggtgccgttttcggccctaccgatatccagcagcgcctccaggagaatggcctgtcgttcgaccttgtctcaactaggacactgtgatcagaacttcagaagctgagcatctaccggtttgttcctgaacctgttgcccttttcctggaacctgcctcttgttgctaccttacactgaagaaacgtactgtagtagtctcttgctacgtgtgttgtgtttgtgtgaagtaacagtgtgtttctacatgtcgaaactcgaaactatgtgttgtccttgtgtgtagtacaagttgttatactgttccatctgaaatgaaaatgacgttcctgtgtaatgagaatcatctgggttccacgagtgtagcgtagatggttgttggcctgtgaaagcaagggcattgtcttgtctacgacatttaaatttaatttagggtgtgtttagttcacgctaaaattgaaagtttggttgaaattgaaatgatgtgatggaaaagttagaagtttgtgtgtgtaggaaagttttgatatgatggaaaagttggaagtacggagaaaaagtttggaactaaactcggccttattatggtatgattttgctgctatatatatacagtagtatatagaaaattaagttaaatattagttttttaagagttaatgttttttttgagaaaaaggtactcacgaagcgtgcatattcatcctctataaatgcgcacacgcacatcctatccctagaagtatctttgacagattgaatcgacatcttgctgtcgacgatatatctaaggaaatgattagccgtaaatacaagcaacagtgttaagtttagagtgttccactgtaaagaacctgatcagtcttaacttttcttgaaacattaaatttgatggtgccttattccgtggaacagtgaaaatactaacattggggccgtagcaatgttgtctcgtactctcgtgcattctgtatcctatttttctcaaagaaagtcgctgtgcaattcgggcaaaatttatccatcggtgatgtgccagaagcttccgtgccggttggagccacacggccacgcacgcatgggcgcgcgcgcacacgtgcgaaagccgcagcagctgctgctcctgcttcgcgtcgtcgccgtcgccgtcgtccctcccacaggttcctcgttcaaagccacgacttttgcttattctccccgtgggcccccgcgacgaccgaccgaccagcggcggccgctttcgtggaccggacaaaaggaaacgaagcccatgccgaaacggcaaatccaatccaaaatcatctcgtgaaaactttcaaattactcatacagcaaattcaaatcccgatgtttcaaataggattaatgttttttttcgcgaacgtgtaaaaaaaattatatgtcaatatattaaaagaaaagagcgtttgatacgcaccgcaatccgtcagaccgacttatgccaaaaaaataaagaaaaaatgagaaaaaaaacgagaaaaagaaagaaactactacggtggctaaacgcaacttaaaaaatagggagggacagagccccactaccctcttaagaagaccctaaaatagcaacaccagctaacaatcaaatggccctcgtagatgattaatctgcaaaccggcaagattactccggggatccgggcgagcgcgttcgaacgcgaattcgagagggaaattgggtgggaataatgatggattaccagtacgcgtttcttctcttttcttcttgtctcccatttggtttcgcgtgcacgcctcctgcagatggatggatggagtagtgctccatacggatttcattcgatagcaggcagcggcagcagcatcttgcctggactggaccgtgtgctttccatgagagctttctgttcgaacacctttgtccccctcctccccgttgcatggagtatgcgtgcaaagtggtgtgtgtgctggtgatggcccaaaaaacgttcgatccctttggctgtctcgtctttgaccatctcgctttctcagtgcgatgcatcatgactagtgagaggggaagagtgtgcgtgtgtgcgtgcatagagacgtcacggtccaagaaagcgagcgtgaaaccaaagcgaaataggcgttctgatggtggttgcaattgcgatgcatgggaacgttttctcgagggatcataatccatcttctacgtgagggtaatatagtagaagaatattgggatggtgagggtagtatagtagaagaatattgggatggtggtttgtaattgaatgcgagagaatgtcctctcgagtgatcggaatctgtcttccgcatgaggtggtgtgggagaagaacacaacgggagaaaaaaaagattgttgtgcttgaactattgaatgcatttacattgtgggggagaatgtgatggatacaaccaaaatttgcttctcttttgatgatcctacttgtgttattcacatcaagaattggggctaaaattaaagggaaaaaaaagagattttggaaacaaaattttgtacgaagaaaaaaagaagaattgtttgttggtgagatttttttatctacacctacgttgactatgtgagcttgtttgcttactcgccgccgccgccggacccggcgatgtcgagtaaggcggcgagcacgtccggcatgtccggccgctcctgcggcgagtcggcggtgcaccgcatgccgagcatgagcatgtcccagagcaccgcgccgctcgacgccgccgcctccctcgccggccacccctcctgggccatcctccggctccactcgaccaggcactcctcctcgccgccgtcgacggcgcgccgccccgtggcgagctccatgagcagcacgccgtagctgtacacgtcgcccttggtcgtggcgcgccacgtctgcccgtactccggcgccacgtaccccaccgtgccggccaccatcgtgctgacgtgggtgtcgccggggcggaccaccctggccagcccgaagtccgtcaccttgacgccgccgtcgcggccgaggagcacgttgctggccttcacgtcgcggtgcaccacggcggggcggcactcgtggtgcaggaacaccagcgcgcgcgccacgccgatggccgcgtccagccgccgccgccgcccgaacgcggcgtggtcgccgatgagggactccaggttgccgccgtcgaggtactcgtagaccaggatcttggccgagccggcgaggcaccagccgtaaagcgtgaccaggttcgggtgcggccacgtgaaccccatccggtcggcgagcacctccatctcggcgcggaactcgcgctcgccgctgtcctcgccgccgccgccgccgccgcagtcgcggagcctcgcgagcttcttgaccgccacgtcgcggccgtcggggagcacgccgcggtacaccacgccgtagccgccacgcccgaccacgcggtcgtcggagaagccgctggtcgccgccacgatgtcgcggtacgtgaacgccgtcttgtcgagcctgaacaccttcaccccctccgacgacgacgagcaacccgtcacgcacgacgacgagcacccggacggcggcgacgacgtggccgacatatggaacgcgccgcacttgcctccgccgccgccgccgccgccgcacttggggttctcgcaggagagcgactcggggtccgggtcctggtccaccggaaacctcgcccgcaggttggccatgatgaacaccaccgtgccggcgatgaaggcgatgatgagggagaagacgaaccacagcgcgatggttctcggagacatcccgcgccctctaatggcggcctgtggcgctctctgccggcgagggcctcgatcctgcaacgtgatgagggggtcgccgaggaaggagagctcgtcgaaggtcccgagctggccggtggtcgggacgtcgccggagaggagcgggttgtacgacacgttgaacttgttcaggccggtcaggttgccgaggctcgccgggagctcgccggagaagttgttgtacgccaggtcgagtatctcgaggcacaggatgtggccgatctccggcgggatcccgccggagatgctgttgttcgagacgttcagcacgacgagcggcaggtggctgatcgccggcggcagccggcccgtgagctggttgttgtcgaggtggagcaggctgaggttccgcattgcgccgatctgggatggtatctcgccggagagcttgttgccggagagctgcacgtagccggagatcgtgttcgacctcaccggcgacgacgagttggtgcagatcgggatgatcccgtagcccttgaggaggcgatcccatatgctgcggcaattctcccgcgtcatcaccgtgtacacgaagttgaacggcgggtaggtcgccggaatccaccgcctcatggcctggcactcgccggagccggcgagcacgctgacatccttccggttcttctcgaacgtcggcgcggggttcctccctatctctgccatctccggcgggatcctgccggtcaaccggttgtcggccaggttcagccagagcaagctgctgcagttgccgatctccggcggtatctcgccggagagctggttcccggcgagcatcagccagagcagcgacgtgaggttcccgatgctcgccggtatcctgccggtgaggccgttgtacgacaagtccagcgcctggagctcggcgaggcggccgtactccggcgggatcccaccggagaagctattcgccgggagcatcaggtacttgaggctcttcatgtcggccacctcgagggggagctcgccggagaactggttgaagctgaggtcgagccttgcgagcagcggcagccggagcacgccggaggagacgatgccgccggtgtagttgttgtggtgcaacacgaggtacttcaacgtcacgaactcgccgaggatcccctgcatgtcgccgccgaacgcgttggtgctcatgtccaagaactgcagcgacgtgcagttcgtcagctccggcggaatccggcgatcgaatcggttcttaccaaggatcagcgtctcgagtccggcgagctccccgatcccggcggatatcttgccggcgaaaccgttcccccacagcgacaggtacgtcaggttcgagcagcttgcgatggagtccgggaat

SEQ ID NO: 60612 - DNA, 513 bp, Oryza sativa
gacgcaagtcactggttgtttattcgttggatggttatgaaagggtaaaatatgtcatgcacctccgaaatgtaaagattatagtaaatgtagacagcaaatgcaaagggcgcaagcatgtgggtaggcaagtaaataaaagtaggaaactggaaattacatgggaggctccgttggcgttgcattagcaaaagagatggcgccatcatcttcagcaacagcatggggagcattggtggcaagaggggtgatgtgtcgccggtttatgagcaactttggcaggtttgatggggaggagactctggttggtctgctacccaacagggctgaggaggaggaggaagagataggccttggacagcgcgcagggcgtgccgcgtgatggtggtgcatcatcactgccttcatctcgatctcgaaatctggatggaggaatcaattaaattgaagggggaggcagagcaagaagagagatggagctggaccagccggcaggagaggacagcaagttgc

SEQ ID NO: 60613 - DNA, 5665 bp, Oryza sativa
cggtggttgcacggaaaattttgtggaagctgtaaagttctaaaaaaatggattgaagtgaatttgtgacccctagctttcgctggtgtggttttgcattgtagctgagggtggggaaagtggcaaaggttttggcgggaaagacaaatcacctcgacttaatgtcgtaccccaagtcgtattgtccgaatcggctgtatcacctaacccagtctgactcggacttagctgatctcaatcgtatccgatccggactcccgccgattcttgctctgtttccgcgacaatcctcgtcttagattccgtttcgatctaatcttcttttccaatgctgatattaccaaatttggttgttaacaaaaggcgagcaagtgccaccctcactgatcaatctagctcgcccaagaatccaccaaagtattcaacgagatcatcccaccggcaacattttaggagacatcaacaagggagtatccactcattctcgtattgcaaatttttgtgagcattactcgtttgtgtcttctcttgaacctttaagggtggaagaatcttttgggaggccgattgggtgaaggccaatccagaagaacttgaccatttcaccccgaatggaagtgggacttttgtggagcgaccttcgcaaaacctgattggccttaaatggatctttcccaaccagccagaccaaggccgggtcgtaataaagaacaaggccaggttagtggcgcaagggttcacccaaatcgaaggattagatttcggtgaaacttttgcaccggtagctagacttgagttgattcgcatattgcttgcttttgctagtaacctcaattttaagctatatcaaatggatgtcaaaagcgccttcctcaacgggcctatcaacgagttggtatacgtggagcaaccaccgggcttcgaggatccgaactatcccaaccacgtgtacaagctccacaaggcactctacgggcttaagcaagcccctagagcttggtatgagtgtcttcacaattttcttgtgaaaaacggctttgagatcgggaaagccgattcaactctttttactaaaagagacatgataatgatacttttgtctaccaaacatatgtcgataacattatatttggttctactaacaagtcttttagtgaagagtttagtaggatgatgaccatacgatttgagatgtccatgatgggtgaattgaagttcttcctcgaccttcaaatcaagcaactcaaggaaggaaccttcatttgccaaacaaagtatttgaaggacatgctcaagaagtttgggatggaaaatgccaagccaatccacactcccatgccatcaaatggccacctcgacctcaacgagcaaggtaaagacgtcgaccaaaaggtataccgttccatcattggctcacttctttacctttgtgcatctaggcccgatattatgcttagtgtgtgcatgtgtgcaagatttcaagccgctccgaaggagtgtcaccttgtggccgtgaagagaattcttagatatttagtgcacacacctaaccatggtctttggtatcctaagggagcgaggcttgatctcattggctataccgatgcggattatgccgggtgcaaagtggatagtaaaagcatatcgggtacttgccaattcttgggtaggtctgttgtttcttggtcttccaagaagcaaaactctgtcgccctatccaccacggaagcggaatatgtttcggcgggggagttgttgtgctcaacttctttgggtgaagcaaaccttgagagactatggcctcaatgtatccaaaatcccactcctatgtgacaatgagagcgccattaagatagccaacaaccccgtccaacactcccgaaccaaacatatcgatattcgccaccatttcttgagagatcattccacaagaggcgacatagatatccaacatgtgagaaccgataaacaattggcggatatcttcaccaagcctctagatgaagctaggttttgtgagttgagaagtgaactaaatatcttggattctcggaatgtggcttgatctattgcatgcatgtttgcttggtagaataggtttgcatactactttgtgacaaaatggtcattcaactcatggatggacactagtcacttttgtggagaacttgaatctatgtgtattgggatctcatttttcaacaaattttggtcgtagcacaacttgaaatagattcacacattccctctctcgagggtgaattatcttgtctcatggtaattccctctcttttgatccctcggattgtccatttgacttgtggctattgttttgtgtgattgattgtgtgctagtcacaagttcaagtggaccctctagagctcgaccatccctcctttcctaatcctatcaaaaatctttgtgaaatgtgtttttgaaaaaaatttcccggtgcttgtcccctacaaaattcctttcaaatgtttgcaaaatagtttcatcaaaattcccggcgaaatccccttgcaaaactgtgttttccaggaattttcggactttccgaaaaattttcggaccttccgaaaatttcccatcctgtcgctcttctattcatgctattccaggatttttcggactttccgaaaaattttcggatatatccgaaaatcatcaaaaccgtgtgcttcccctctagatccgttcggacttatccgaaaattttcggaaatgtccgaaaatttcggggctcatatattttgacccgtggactcctctctctctctctcttcctcactttttcccaacgggtttgactccctcctccactccgcaccggcgaccccattctccggcgacctcccgcggctcccctcctctccaacattgtgggagcgcgtttggggcacttattgggacttgcgttgtcgatcatcaccgcgttcttcaagtgttcttcgtgttcttgaggtatccgccctaaaatcaaatcctttgattcctcaagttttatcttgtgattccctttggtggagatgttcccctagtgccctaggacctgcagattcattttcccaagtttttgttggcggatttgtgctgcatccggatgataaggttcggccggatttttccggaaaatccgaaaattgtttccggatatatccgaaaattcctggccgacccctatcacctcggttttgcacgattcttgccttcacttacttggtccttgcttctttggcttccattcactgattcattgtctatatcttgtttgaaggatgcctccacgcaagcaaacctcccacaagtccaagcaccaaagggaccgctctcccaccccatcctctcatgatgatttggacagtgattggtccgggagagaggatgcggttcctcaggttgcgcgtgtggcttgggccgacactctccctcctcggcggtccactcaagctcttggtggtggtggtgatggtgagggctcctctcatcaaccgcaaacaccaccgcaccaacccaatgtccccacaggtccttttcgcattcatacacccaagagggatccggcggtgattcgccaagtgtatgattggaagcggaagactgaggttgttgctcctcgccgggatgaggatccgcgcccccttcgccgcaccgccacggattcgcggttttggactctctttcaacaagactttgatgagtctgtgatcaagtccaaagctcatcccaccgttcccatgcaatggatcaactaggaggagctgcaggcgcatgatgatccggtgctaaactttgtgattgcaaattgtgagctcatgggaattcgctctttcgtgactttgcagcagaattggtgcagcgaagtcatcgctcaattatatgccaccgttttctttgatccttattgtgccatgcattggatgacccaaggctcttactattatgtctcctgtccgcgatttgttgagatttggggttttgacgtctgttccttgctaaaccttcctgatatgcatgatcttcccattcctgccaacactaatctcctccctctttacactccaaatgatcctaatgtggtgttgggtaaagtcgacggtctcaaaccgtactttgcctgcttgaaccggatgttttgccggtcctttgtgcctaaggatggtgatgccagcagcattaaccacctctccaggaccgtacttctcaggttcaatcccctcctcatcgctttcatgttttgcactttgtgtgggaggagatccgcatggcctccattcagtacaagaaggggttggtctatgctcctcacattatgcggatgatcgagactgtcactcagcttcagtttcatcatgatgtgactcattcccagcttcacttgcgccttgttaaggcagtaaccccgacaaataaattcttcaaacacccgaacggaaatattattgaaggatttgggattgtacaagatgtacctgtctgctttgaagacaaggaggcagtcttggatttccacgtctttgtgaaagtgcgactaggcccctagtgattttggtgattaattacaatgcgattagagaggattaaaatttttattcacgtaaatgtgaaggttgttatgtcctcaatgagttaaagtaatgcatttcccacccaatgcattgacatgatgtgatgcggcaaatgagcaaatgctatattgtaccttttcttttccttgagttaataggaaagccgcactattaagagggatgatgcattgacatacgaggagtgatcaaagtgctcaaaatcaatttttaaaagtgtttctccttagtttggtgtgttctggaatttttttggagttttccgaaattcattttcggactttccgaaaatacacagagccagtttttcgcttctggaaattttcggatatgtccaaaaggcattttcggactttccgaaaatgactgagaaggcaaatatggttctgcatattttcagacttgtccaaaactgattttcggattttttgaaaaacatcaatagagtcttttcgcttctgtaaattgtcggagttttccgaaaggaattttcggacttttcgaaaatgtccagaagggtgtttttggttctggaaatattcggacttgtccgaaaagttttcggaatgtccgaaatatcttcagttaactttactgtcggtgccgagctggaattttcggacatgtctgaaagagaattttcggacatgtccaaaaatctttcggaatatctgaaaatcacaattattgtgcataacgggcataatttaggctgtggctataaatagccccctcccctcacttgtgagggctgctggtcacattggagattcttgtgctcttggcttgctcttgttgagattcacttttgagccttgctttcttgtttcccctctcacccgtgttcgattcggatttggtgtgtgtgagagttgtggattcgagtttgtgtgagtgcttgttgttgacttcgtgaagatttgtgagcacttgcatcatctccaggagttcattgcttcatttgttactcttggaggctgaggactcctaggcggctaggtgtcgctcccgagccaccgatctacttgtgattggccgggagaagtttgtgatggtcagatctcacctccgaaag

SEQ ID NO: 60614 - DNA, 15667 bp, Oryza sativa
aaaacgagaaaggggaggtttccatggggtccagatcccttagagttagctataacttcaccaggtggatttgaccaaatccatgacatcaattgtttcctatggctaagatgaagccacgtattaacttatattaattaactccctcaatcacatatgcttgaatgaaaattacttaccttttcttctttttatgttcctaatgagtatgtttctgccaacaacattaacaaagtttgcacgctctcttcttctccaaacaagaagctatggtcatgtatagaactatgttaaacatttagtacgtgcaaacatgcataaacaatatacacacaaacatattgctaaaacattagagccacaagcccaatatgatttttatattgtggatgaaccatgaaatttctaggttatgcaagtaaaattagtttgtatattctttagatatatagatatatagtattcattgatttgttacaaatattaggatgaagaaaaaaaaactagtgggaattagttagttcatcccaaccgttgttatacagagacgactgagatttgatcaaatatctatcgggtggagttggagtgaactccagggaatccccacccatcctccctaagctcactcgagctccagctcttttgctgctcaaaactggagcgctatctcctctaacacaaagtgtaattcacttttctttttttaacccttaacatgaaagagcaaagatattttaccttgtaaaatagaaaaagactttttgctttgttctttcttggaattgggggttcacggatcggaggaattgaggtgggggcgactgtgcagcaggtggaatcttctgtgtgagcgagcggtttatcgtgttaatggacgagacgtcaaagaagatcaagcagggaccagcagagccaatatcatcctgcgttcttgtgatgttgcattatattgcatggtgtgctttgcactttgcacagtcaccatcgcatcaactggtgagcgtcgacagtgccttttttctaggctgggtgcctgggttttaatttgctgcatttttatttggaagaaagaaatgtattactcaatcaaagcgtcctcgcatacaagttgcgagataaaattacagctttctcccaaccaaaaaaccagaaaaggaatcaactctagccttatttgctaaaaaatggctaacacaattttgactacggaaaacttattaactgcttaaatattgtattaaattgtgcttagctaatgtatgcagtataaaactaagtgcttatatggaaatcctgtaacatcttggttagttttcactctctttggggcactgcttttgtttttttaaagaaaattatcaaaaaaaaaaactactacatgcatcccaaaataatcctatctaggataagatttgacctatcctatgataacaaatttagaccaagggaaaactctgaaatggtaaaaaaaaagaagctaaataggagaaatcgtaaatacgaaattgagcaaatgaaaggaaaactcgagagaattatttagttatttctctaaggtttgtttattctagaaaaaggaaagtaaaaatacttgacaagagtgaaaaagagattataacgatctcctcttagtcctacggcctccaccatcctcatgctggtgtagtcgttacccagtgtcacccctcgccccaaaatctaaactctaggttttttttctagcggactttcatgtcattattgttggtgagttcctccccttcttccctcaatctagtgctaggttttaatgtgactgagattcttagtaattttatcatctaagatatatctagcaattcctatacacctgacaatgtcgtagcatgaatataatccattagggtaggcttaagttatgcatggctgaaattcactaatatccacatatgcaggaccttttgcttgtacacatcctggctgacaagccggccgactgaaaacggccgtgtgttgtgtttttagcggtgggtcgcttggcgtttgttgacggccatgtgacactgttaggcccaatggccgatgcaccgatatggccagctttgtgtgtgcgatgctgtgcacagtgctcttgctggggtccaaaaggtaggagacaaacggaacttcgtccatttgcaggggcattgtggtccttatatatgactcccaagttcaacgcacgcatgattttccgttcaaaagtgcatatatactctcctcgttatttgttactacaagtcagcctagctacctacatgtggatttcacgcccagcccttagaacatatcaattcaatagatattagtagccaccgcgaaatttggaaggagcgaaacacaacaaaacattgctttgacgccaagctcaatgctgggtaagaatgtaaggtcatttcacagtggcattgtttgtccacatagacagattgcatgtgtggagaagaaaagggatggggaccatgtttttgtggagtcctcgcatcctctgttggtacctgatgaggacatcctccactattacccactggcaaagacgctaaagtcgggcggcgaccgtgtgagcctctgaataatcccaccttgcttagcgagccattcttcccctattggactagtcttttagggagattgggcttgtgccaaagaactgttggggtccgagcaaccttaagttattgggcctcggccaaccccacctggaccggattgttatcagtaccgatggcctcgtcaaaaaaaaaacagtttcatcgaggaaagctatcgatggcctcgtggctaaaagcgtgtgaggtgtgtgtgagagaggggagaggatgggtgggtggggacgacctggagctgatcagcccaatctgctcatcgcccaacagcaccacacccttgcccctggccgttctcctgcagcgccagattgacaggcagcatccgacaacttcggatcgagaagagagatggaggtgacgctcgctagatccaccccatccgatggtgaggacatgagtcattgcctgagagagaggggagaggcagcagtgacgcagtctgacagagaggggagctcatcccaccgcttgatctgcgccacggagctcccgccatccctctctcccacaccgagtccacgccgtcgagctcatcggtgcactaagggtggagggtcattgatctgggttggaggagaagagggtcgtggccggcggtgacggagaggagcgggtgtcaccgctgttcgtcgtgccgtgcattgtgggaactgagagggagggaggggataagggagagagaaggtggtgagtggattttatattcttttctggattttagggtgtgcaatacgtaatttggtacttctatgtaaattagaaaaagcataagaactgaaacatgaagtattaggggtgaaatataaaattaaaatcactcctatagccaattgcactgtgaagaacccagattttgaacccatggagtctatgtggcactccgaggtcttatatatgggtgaaacgcactacgagtgccctatgatggaggaggagacactagtgtggtcatgaggaggggacaacatcacccctcccccccaccaccaccacgagtttgaccttaaagcacgaacctttacctgccccttgattccatcttgtatatagcttttgtatcacttaaactctattctgacatacaatataatcttcttttattgacaagataacatgcatatataatatgatccattcaattagaccataattaagctccacaaaagctctaaacacctatatatagttcatcatatcctgatttaggagaaacactagtggtgtgatggactgatggtagagttgtgggtgtatgaatttacacatcagttcaaattctagtttccacaagtactacgcacatataaatgggctttcaacataaatttgttaagatcaggaacgggtatcagagacgcattcaaggatgtgtgagtgtagtgttgcatctatagtgttgtgtgcgtgcgtgtgcgtctaccgtgtaatctaaaaaagaaaaaaaatcatctctctttcggcattgtctatgaaaaatataactatgcaaacatgctagtataagcctctttcgtcagtgctgataattggcccaatgtgaaagacagatgattcgtaggcagaataagtttatttttcctccctcatgtcttgctctagtcgaatcgcatccctcaagcataaaactaggtataatgtctctctcaatttcaaaaaccagtacaaatcaacttctttctatggtttgtgaaacgatttatgcttacgtgataggttgacttggtcccctgttctgacaaggtaacccattcattaaagaggttaaaaatagaagtgggatccatatctaagtgataagggtaaaatttttttaaaaaatacagtgggacctacttttcagcctactcctctctcgagccccaaacagcggcacctccatgtgttgctctggcgtcgcctctactggaggggtccgtcactgcgccagaggacgcggtcgacgggtagaagtgggcagtgatgggcctgacacatagaaggaacacctccatcgagagcgtgatctcgttgacctctggtgacgcatctggttcctcccagagagggtatcaccatcgcctgtggcgacgacacccaccgctgtagcacatgtcgccacacgctcgtccttgaaagaggtcccccattgaagtcgggtgcagatacaatgatgtgggcaatgtgggtacagccaagtaaggtgacggctggcctcctacttcacggatggcttcctcgcctgacaggatggtgcatcgtatactactcaatctaaacaaaccaactagtaaaatatggaatactactatatcttattcggcatgcaatcatcaaagcttcatcaccaaatctctgaatgcatatatatgatcaaatcaatccagcatgtacacaatgcacagcaggaactcccggtcgtagcagcacatgcatcaccacgccgatccaaacgctgcagctccccagcaactcgtacaccttcaggtgcatcacaaattcctgcacatatcaagctaaccaattcttaagcacaccacccaacgattgcaccaactattctaaataatctggcctgctcaaatgaaatcaaccgtgagccaaattatggcgtaaacattaagtccgattttacaattgagggagatggttcaatacgagcaagacatgagggaggtcaagttgacttatcagtttgtttcataagcataattcggatgggcagcgtctcgtcttgtgtccgtccaccagcagcatcccacgtaggaaaaagtacaccgaaggtctcttaacttgtcatcgagttacaaaatcgtacaaaaccggatatataaaatccctcagcttacaaaaccgtttgcttcggtggttttgagttttgaccctggttttgtcctacatggcggctgagtcagcgtaggacccgtgtgggccccacatgttagtaagccatgtcatcacctctctctctttcccctcctctctctcacttttctgaggccgacgacgggcggcgctgtggggaggaggccgccgggggagggggggagggcagaggaggaggtccggcggccggcgtcgcgccggcggaggcaacgccgccgcccgcatcctcgttgccgccgccatgccgtgcagcctgatgaagggcgcgtcggactactgcaacatctatgtggtggcgaagggcaagtcggtgaacgtgaggcttgccaagtgcggcgtagctgcgctgccgttgctgcccacccgctcgccgcttgccagtgaacgttgtagccttttcgccgctcgcctctccgacggtacgatccgtcgacgccgctgtcgggcgccgccgcgctgccggacaggacgatggccaccaccggcactccaatctgaaagaaaaacaacgcacaatctacattccgtcagtgtcgaaaaagagaaaaaagaaactcctggtgcagatcaaatcagcgaccttaaaattcccaatttgatgtacacaggctacaacgtttgcaagcactctaaaaaggagcaaaagcacgaagagaacaatgaacaacaccactggtaggagtatatgcacacattacgcccaaatcacaggctttggagtttggtctaacttaatcataagattagcacgcgaagccaaaaaaagggaaaaggaaaaatctcctgtaatcccccctcactccggcatgctcgccgatgatctccggtgccggaacgccttgagcgggctcgggaagtgccaaccccaccacgccttcgccgtcacggccgccgctttttcctccactgccgtcgcggagaccgagctcgacctcacgagccccatctcctcctcgtcgtcctcctccgctgcagcaatacctcgacgcgtccgccggcggcagcttcccccactgcgaaggctgccgccgccgccctcctctcccgcctcgccccggcggcctcctccccagccgccggccggcttgcccacagaagaggagaggagaagagaagaggagaggagaggagaggagagagagagagaggaggaggaagggagagagatgacgtagcatcctgataggtggagtctacgtggatcccacgctgacttagctgtcaggtaggataaaaccggaatcagaaccactgaaggatttattgtgaccgattgttaagtaaggatgccgcatatatgtttttgctgttgagggatgattttgtatcttgatgataagttgagggaccttttcgtgtactttttcctcccacgtagaagaacgcaatttcggctgccggccttctgggctggataaggcaacggcccacgtaaggaagacgcgtgatgggcctttcgagggaacaaagggccgtcgtagtttcaggcccaaaaagaaagtctagaggccgagagagatgctccgttttctctgcctctcctcacagaattccacgcattgcctcgttttttctgctctgctcgattaaagctgcagagaagggcagagttttcatggccatgtccatgtccatgtccagcacaacgctccaaggccggcataggtagactttttgaacggtacacctacgcctcaccgaccgctcagcctggccccgggccccggcggccggcgcggtgaaaaacgtcggccaccagccaccgtccgtgcggagaactgcgggcgccgccgcacacgcgcccgcggtgagaaatggatggacgcgacgcgagtgcgagtgcgagcgcgaccaaggacgggataggaggaggccgagatgtgtatggccaaggccatacgcataccctttgtgggggcaggggaagcggccgcgcgcgacgggacgacgaggggattttgggtggggtgggggcgcaagggggtgacatggcggcgcgacgctgcagattttggggggccgaaatccccgatagggagagacgaggatgaggcctctgctggccattggttcgccccaatcgtgtccttccaagaaaatccacctcatccccttcctctccatccccccgttgctctcaccacacgtacgcgcgcggcgcaaccctacaaactacaaactcaactcgactcgcctctccatcctcccttgattatttgttctctctttccctttccagcctcggtttagctacctccatcagcagcacacgaaccactaattaattacgccatgttctaaaccaggattcggcttggctactttctcgattttcattagcacgattttaacgattttaaagctgctaaacagcgtgtgtttttttcttctaatttttatatagaagttgttttgaaaaatccaaataaatttattgatcatttcttactaaactgattatatgccaatcacgtttctccttttgcgtgcaagttttcaacatctatttagaaagcgcccgagtttcacacacaattctcacctcaattacttgctctccaggaaatgcttatttgcaatgtcaatttttttacagcacccattaaccaacactgctatatgcaatagtagccttgactatatctaccaagaattcaaatcccaaaacaaaacatcgctgtaaccctatagtattttagtactgcttcttttgtttaaaattttcctatagtattgtgtttacatgaaacactcacacacactaggcacatcgatggcaaatctacaaccccactaaatttctattgaaaatatatatgctaaacacctttttagctgcttatcgtgttccacttataaagttgttctccatacaaaaatatacaacaaaaccagtctaatattaattacatatcagcatatggcacaccgtttgattatattattctagggcccacatgtaaatatactaccccacgaaattaaattctttgtaaattccactatatatcatactatctctgttttttaatagataaagccgttgatttttgaacacatatttaaccatttgtcttattaaaagaaaactagctaggtgccccgcgtaattgagcggctaacacccaagcaaaatcatatattttcagtatgattttgcttaaaatttattaaatagctatcttgttgtcttaagactttgaaagaccaaaccttatcatctccgtatttctaattatatagtttttaaaagtcacaccagctgctaccccttacttctgccatatccttctttatttgctcgctcaatctaccattatttctattaattatcctttaaatcttaaacaattggatcttatagtttttagagtttattgtctcgttgggtttcgtttttataatttgtaaaagtcccgtcaaacgctgccataatattcctctacggtccgtccactgtctttttctctttattgtttgggattttaaaaatcgaacataattattgttcaggttcattttttttactttttagaagtctcgccaaactgtcagcggctttgccattgtactcctttatggctcgcccgctgcctcccttctttagtgtcattgagatattaaaatcgaacataattatcattgtttttttaccttttaagaagttccgaacctttagaaattggactttgtagtttttagagtttattttcttgttgggttttattttttataatttttagaagtcccgtcaaacgataccactatactcccctacgacccatccgccgcctactctttgttttcattgggattctaaaaatcgaacataactatcgttggaatttattttttatttttaagaagtcccgccaacagttaacagctctgcaactatactcttatacaccccgcccgctgcttctcctttttactgtcattgagattttaaaaaccgaatatgattatcaacgggtttttttttactttctagaagtcccggcaaccgtcttgcctgtttgcttcatggcctgcctgtcgtccctccttttaatcgtcattaggattctatttggtgttttattaacagtttttatacgtcgtatcaaccgtcaccactctactcctttataggcttgttacttaatttacctcatcatttattttagatggtcttctctttcaatagtctttattttttctcaccaattttagttatttataaattgtattcctaactaaaatattttttctttttctaatttcagaatttatttttttttcaaattttaattaatactgtatagtgttcttttaatatttttattttttatttttgaattttagttgtttcaaaattgtattcctactttaactctcttttaatttttctaatttttgatattattttatttttattttgaattttaattaatctcgtattaggttcttatatgaattcttctttcaatattgcttatttttaattatgaatttcagttattttcaaattgtattcctacttgaactcttcttttcgttttgctaattttggattttatttttatttttattctgaatattaattaatctcgctttgggtttttatatggactcttctctcaatattccttattttaaatttcgaatttcagttatttttaaattgtattcctacttagactcttaatttttttctattttcagattttattttatttttattctgaatttcgattaatctcatattgggttcctatatggagttttctttcaatattacttatttttaattccgaattcagctatttttaaattgtatttctatttggactctccttttctttttctccgattaatgtgggaatttctagcccccacggcggcaaagtggtgccttcatttaaggctgttttaataatataatagattatgcagaagtataagatataaatcatgtttaaagtattttgagggataaaataactcacaacaaaataaattataattacgtatttttgaataagacggatggtcaaacgtgtgacagaaaattaacgacgtcatctattaaaaaagcagaggtagtattaatttagactaaaataattcaccaaacacttcaccggttcaccctttgtcctattccgttctgcagagaaaacagtgcttgaggttcagagttagtagaagctgcaactctcagctttgctagctagctagaagcagctatatatcccttatcctcttatcgcctctcaccctctagcttccctctccactgcctccctcgctcgctatctcctgcctaagcgctaagctaagcgacctgcagttctgcaatgctaaggccaacgtagagctgccgcttaatcccgtctcgcttgattggtttctgacaagaacgagattatcgagaggtttcaattcattagcttagcttagctaattagcttgagggacgccagccatggcgcccaaggcagggaaggccaagccgcacaaggccaagggagacaagaagaagaaggaagagaaaggtgcagcttaactgatggctaactgaatcttcttcacttcccatctgaattttcatcgaattcatcagctcggatgattggtttaatttaattcgttttcaagacaaaagttattttcagatgcaaggattaattaattaagctagcttgcctctttcaatatttgaaagttcatattgtttcagtattaacatgtgagtggtttttgcgtggaaatattgatatgatgctgctgcagttctgcccaccgtgctggacgtcaccgttgagacgccggactacacgcagctgacgctcaaggtgagcgccggggcgcgtattatctccgtcttctcgcatggatattttcgcgtaattaattaattaatatggaccacccagtattctgaccagtgaccactgtaactgaatatgtactgttccttctattcgatggccttaattgtgcttgcatgttaaacgacaaaattaagtaaattcttctctagctttcacttgcaacactttcatcttgtttttttttaaaaaaaagaaaaaaaaactttgtttaaagcgaaagtgcctaccacttttctcttagaaacttctatatttatttttttcaattgcacagaaaacgtgtttttcttgtgctaattagcaatggcgagcgaccgagcataagcggcaacttaacaaagctggcaaagaatgaccccactcgttgaaatgtacatgatgagaatttttattttctatacgaacattacacaaaaaagttcatgggcaatttacacatcctaattatttttgagcaagttagcaatggttgtgttagcttaagtacatagtaccattttgtgcaatggcatgtagcctactgattatagtaacctgagtagcgtcccaattcccaaggttttgagttcaaatctcctagtgaattttagattagggctgtgtttagttccacgctaaaattaaaaatttgaagaaaaaaattagaagtttatgtgtgtaggaaagttttgatgtgatggaaaagttgaaagtttgaagaaaaagttgaaaactaaacaagactgggttatttttggggttaaagttccgagtttaaatctcaaattttatattgggttatttgtgtgcctaaattatcaatttaaatatggtacttataattcgcagtggtaggtgccaactcgctgcctagctcattttgtgtttgtggtgctttgttcagggcatatcaacggacaagatcctcgacgtccggaagctcctggccgtccacgtggacacatgccacctcaccaactactccctgtcccacgaggtcggtcagaggatcccaacggctcacatccgcctcgagattcgtgcccactgacagcctgtactttctccctctctgccaccaatgcaggttcgtggggcccagctcaaggacacggtggaggtcgcctccctgaagccgtgccacgtcagcatcgtcgagggtaagtctgaacgagcaaatcccgtatttctcgaggaccaaaacgcaaaaaaataaaaaactcaccgtctcgtctcccatggcgcgcggcagagggctacacggaggagctcgccgtggcgcacgtgcggcggctgctcgacatcgtcgcctgcaccgccgcgttcgggccgaggaagagtgcgcccgagcagaagcccgcatcgccgtcgtctcccgatgcgccaccgccaccgcccccgccggcgtcgcccgacgccgccaagacccccgggtcgcccgccggcggcggcggcggcgttggcgccggaggcggtggaggagaggagccgatgtacccgccgccgaagctgggacagttctacgagttcttctccttctcccacctctccccgcccctccattgtgagtgctagtagtttcgttcttctcattcatttttgttttcttttttttttatttgagcgcattcggaacagcagaagatggtgagccggttcgggtgatatttattttttttcttccacttttgttaagtgaaaatgcgattggtttcagatattaggaggtcgacgcgcccattcgttgatgacaagacagaggacgacttcttccagatcgatgtgagtttgcttgaagaaaaatagcacaaatgtgatgtttctttttagtttaattgattcgattgcattacattagagtagctagataaggtttgccaatagttgtttcaaaatctcatgctaatttaactatatattcattagattagactgcaactcatatatatgaaaactacaattaattaatttatcatagcacgcacgtaaccatcaatatggccaatgtcataaaaaaatgcaatatgacactcatttgcacctgtataattctccaagcgttctgcaattgggtgttggtgtgcaggtaagggtttgtagtgggaagccggtgaccatcgtggcctccaaagctggattctatccagcagggaagcgagcgctcatcagccactcccttgttgggctgttgcagcagacgagccgggcgtttgatggagtacgtgtgaccttggagattttgtgatttgattattaatgaatggtatctcattgatgtggaaatatgtgtgcgattttgtaggcttacaaggctcttatgaaggcttttgttgagcataataaggtgaggtcttgctaatgcttgatttcttgattattttcagacatgcctgaatatgtgactatttaaaaattattaatttcaaagctaaactttaggttagagatcattttctaggtttattggtcaatgcatttgaagagacataccctattttccacggaaacaattgaattcgtggaattggaaataagctaatgcattttgtttcactaaactgaatagtgtgcttgttttaatgtacctatatatatattttgtttgcatgtattaacacaactttgcaattgcatttgagagatttatagttcacattttattgacatttccttgcagtttggaaatcttccttatggattccggtcaaacacttgggtggtccctcctgctgttgctgatttgccatcggtgtttccaccccttccaactgaagatgaaacatggggtagcaatggtggtggtcagggaagagatggaaaacatgaccataggccatgggcaaaagaatttgccatactggctgcaatgccttgcaaaacagctgaggagaggcaaatccgagacaggaaggctttcctactccatagtttatttgtagatgttgcagttcttaaagctgttgcagctattcagcaaatggtccctgacaagagttcacttgaaacaccgaatgacaccacaaatccagatttgcacacgcaacaaattggagatatgaaaataacagtcacaaaggacaaagcggatgcaagttctaagttagatgtcaagttagatggaagtcaagctccaggaatgctgtctgatgaacttgctaagagaaatctgttgaagggcatcactgctgacgagagtgcaacagtacatgtaagactttcttctttgatacgggctgttgcagtttacttttatccattttcctgtttattgtcgatgtaattttattagtttacaggatactgctactcttggtgtggtggttgtgaagcattgtggatacacagctgttgttcaagttccagcagatgctcaactgacaactgtttctctagcacaacatgatattgacattgaagatcagcctgaaggaggtagcaacgcactgaatgtcaataggttagtacttggaaaattgattttatatatatatatatatatatatatatatatatatatatatatatatatatatatatatatatatatatatataatcttatgctaacctgataattctaaaccatgggtttacccaaatcagtcctaagtgatttactttacctctgttcgtcttggtccatttcattctttctctcttttcttaatctatttttaccattgtattggttggataaaatctatgacaatcatgtttatctcttttcagcttaaggatgctgcttcataaaccatgtattcaaccatctggaggagttcagcggttgcaaagttctcctcaagagagtgaatatagtacaaattttgtccgtaagataatgacagatagtctgcagaagcttgaatgtgaagctccaagagaaacaagaccaataagatgggagcttggagcttgctgggtgcagcacctacagaatcagacttctgagaaggccgacactaagaaaaatgaggagaccaaggatgttcctacagtgaaaggtctggggaaacagtttggtcagctgaaggagatcaagaagaagacagatgaaaagagtggaaagggtgcatccacaaaagaaaatacttcgacaaatacaaatgatgcgcaaacagtcaactcttccagcacaaaggaggataatgaggcaattctacagagatggcttccagaagctgctttccagagactaaaggaatctgaaactggactgcatgctaaggtttttccctgatcatttctgtttggagatttctcaaatgtcgtcccaagaaattacctcatttttaccggccccttcttctccaaacaacag

SEQ ID NO: 60615 - DNA, 604 bp, Oryza sativa
gccgccgccgccatttggtactcggtagtggtggggggtttgggtggttgacgagtgggagtcgagtcgacccgtgtggtggagtgggtttaggtaactgagactgacaagtatggcccaccaaccaatcgcaaattcaccatcccatccaatcttgacgacgatgccgccgagatcgccgcttctcgccctcgtcttcctcgccgccggcgtcctatcctcggccacctctccgcctccgccgccgtgcagccgctcgtgcgccgccctcaactgcgactgtgcgtcgtgagcgcttacctccaactgattggcgtcccccaccatctaatcctccaactctttgtctctgcagccgtagggatccggtatggcaagtactgcggcgttggctggagcggctgcgatggagaggagccctgcgatgacctcgacgcctgctgccgcgaccacgaccactgcgtcgacaagaaaggttaggagtttctttcttcctctctggatctctctaccaattacttcactcctacaataataagcatactacacatttactctaactcaattcactgtcttagacttgaatgattgcacacgaaacaat

SEQ ID NO: 60616 - DNA, 6051 bp, Oryza sativa
atgctttcttgcacaatgacagagaagcccctatcataatcagtgacaagctttctgaagacgagactcaacgtcttctgtctatgttagaaaagcatcgtgttgttcttggctattcccttcaagacctcagagggattaatcctgcactttgcactcattgtatccctattgaccttgagagtactccctccagggaacctcaacacgactcaataatgcgatacgagaggttgtaaagaaagaggtcctgaaactcctgcatgccgggattatttaccccataccatacagtgagtgggttagcccagtccaggttgtgccaaagaagggaggaatgatggtcgttgcaaatgctcaaaatgaacttattctgcaacgaaccataactggatggaggatgtgcatagaacaaggctacgaaaaaggatcattttccgctacccttctttgatgaaatgttggaacggctggcaaatcattcctttttctgtttccttgatgggtattgcaggtatcatcaaattcccatccatacggaggaccaaagtaagactacgttcatatgtccgtacgacacatatgcttatcgtaggatgtctttcggactgtgcaacgctcttgcatcttttcaaacgtgcatgatgtctattttctcgaatatgatcgaggacattatggaagtcttcatggatgacttctctatctatggaaggaccttcggtcattgtctgcaaacgctcgacctctgaccaacctgttagccaaagatggtcccattgagttcgatgacgcgtgcctaaaatactttgaaattctcaaaaaggcactcatctctgctccaatcattcaacctcctgattggactctgcccttcgagattatgtgtgatacaagcgatttcactgttggcgcggtcttgggccaaaccaaagacaaaaaacatcatgcaatctgctatgctagcaaaactttaaccagagctcagttgaattatgcaactaccgagaaagagctgctcgcgattgtttttgctatcgataagtttagatcttacttgatgggacgtaagtgataatttacactgatcatgctgctctaaaatacttgctcactaagaaggatgctaaaccacgcctcttaagatggattttgctgctccaagaatttgacttagaaattaaggataaaaagggagtagaaaattctgtagcagatcatttttctaggctgcacatcactgacatgcaggaataactgataaatgatttcttgagagacgacatgctgatgacggtacgtgactccaacccgtggatggaaacatagtgaactacatggtatcaaaatacataccaccgggagaaaatcaaaggaagttgaaatacgatagccgccgtaacatatgggatgagccatacctatatagggtctgctccgttggtttactaagaagatgtgtgccgactgaacagggacttaagattatagaacgatgccatgcctcaccttatggtggccattatggcgcattccgcacccaagccaagatttggcaatgcggtttcttctggccaacgatgtatgaagattcaaaagaattcgtcagaagatgtccaagttgtcagaggcaaggaggaatcactgctcgtgatgcaatgcccctcacatacaacctgcaagtcgagatattcgatgtttggggtattgacctttttctaagtcatgtaactgcgagttgcaagtttattctggtggcagtcgactatgtctccaagtgggttgaggctatgttgtgcagcgctgcggatgcgaagcataccaagaagatgttgatagagatcatcttcccaaggtttggtaccccaaggatggtcataagtgacggaggttcgcacttcattgacaaaaccttttgagacctcctacgagacatgggagtgaagcacaacgtggccacaccttaccatccacagaccagcagtcaagcagaaacgtcaaataaacaaatcacgaatattgtgcaaaagacggtcaacaaaatgggaacaggataaaaggagaaattgccagactcattgtgggcataccggacagcatacaagacacccattggaatttctccctatcagattgtctacgggaagtcatgccaactccctgtagaacttgaggacagagcatattaggccatcaggaactggaatatggactttgaaggagtaggagaatggaggatgatgcaaattgctgaacttgaagaatggagagagaaggcatatcacaacactaagatatacaaagagaggatgaagcgctggcatgataagaggataaaaatcaagaaattcaagcaatgagacaaactgctgatgttcaactcgagggttaagcttttcggccacggaaaattgcgcagtaaatgggaaggaccgttcgacgttatcgacacctcttcgcacggggcaatcacactctgcgacgactcaaataacatatttaaggtaaacagttaacgtttaaaaatttttcatgagcctaatgaatctttagatgaagaagtggatattattgaattaatcgattatgaaccataatgatctcatctaaagcatgcttaatttcctgtaaaattgtcatttctgagcttagaataagtttgcttgagcgtgtgaaaattttggtagccagctgagcccactagggttcggccgaacccctggttccattctccttcaaagtccatattccattctcctgctcccaccagggtagcacccaatcggccccaagtttgaatagcttcctctccgcgctcgtttgagtttgtttagatgcgcattcggaggtagaacttttggatcagcaccataagacccttcttcctcctctcctccatctttgcaactcttctctccatcctagctcaattccttgatttacaccctcaactcaccaatggctggcaaatccctgatgccatacattggctcctcctcaaactccacctacaaccttgaaggagaaacaccggcgaatcaagtcatcccagtggaaaactacacaatggaagggggcattcaccccttgctacggtgcccagctccccagcaaatatggagccggccggcaaactcactggttcggccaaaccaggggttcggtcgaacccgtctcggccccgttcggctccccgttcggcagcacgatccctctcccctcgtcatgtcaccaagaccaaaatccgggggtattagcctgcacgacgaacaacgacgggtgaactcagcctattaaagcgagacgtcttttccaagacgatgacaaggccactccgcctcctgctgagcggtatgtgggcaccctctacaccaaggcaggggatgaggagctccacaactacatcacacccaccgccactccatccacccccaaggaggattggttttgcattcggagagtgcgaactcccggcggtaggtatggtaaaggcttgctccggccgttgacggcatcggagaaggaggggcagcggaatcccgttgccctccacctatgacggtgaagcgtcatttgacgccccctccaattgtaagggcgcttggccaatttcaagaggaagaagtgaagtcgccggaaccctcggtccataagctagcggcacaagtgaagaagctccgcaaggagaacattgagcttagggaccgtaacgcagaactaggggtagagcttgctgagcttaggaataattttgatactcttagtcgcggttcatgcgctagatcaagcgtgcattcgtagagatggggaaggagaataagtatgatgctaattaaatgtctcctttctcatgaataaatgtaattggtgcttggtcatttattttccaatcatgtaagcacttgctataaataatgtgactcattggtgttaaccccaatgtttgccaagatttgtttttgttttgtttaataaagatcaggttttgaataagtgtgggggagatatcctagcttctgacgtgcacatactctgaaatttgctgaatatctaaacacctgaggtacactgaactctgcagggaattgcagaggaattgggtaccaaggtggttgggctgaacccaaccagtgctagtcccaatccctctcaattttcctaggtaagcaggtgagcacgtctattatctgtatatctccaccatggtatagtactagagctgtgaattcagaaattaattagttcaagcataattaaaaagataaaatttccaactaatgaaattcttcctatgattaatcttgtatatttattattcttagctgaacttgtacttgtgaacgaacatccatgtttagggaacgttatgcatcaaagtaattgttatatgtgagatggttaaagatgaaggaagttcttcaactgttgtcattacttatgggaatttgtttttcaaaataaaattttgttttaaagagctcattcctccaattgactttattttatacctaccaaggccatatgcaagtatatcaatgataaactttattatgcatatgactgcttgacattatattgagctttgtcaaatctatgtgactcatgttagatatcttttatactctcatgatcaaggggtcatttccatatatataattaagctaagcttctacactggaagttggcttcccacaaaaattccattaaaatatacacctattttaaactatgttttcttctcctagaaaatccttggaaaaaggaaagaaaatgagaaaaggagggaaaggcatggctataaaaaagagagagaaataaagcttgctctcaaaacattgagcatgatgaaaaaaaaatatgcatatagccatgccacttccacattcatgcaagaaaaaaaaatggaggaggtataggaaaaaaaaggagacacatttctttattccatcattccacaaaatatttcacttttcctttttccaccacatataaagacccttgatctaggagtatgactgataatcttcttgagtccatatatttggctttgcaatatatatgatgcatgtatgtcacacttttacccctaccaagctccatatatcagccttagaataggggtaagtttggcacatttttgccttggtgaggatccacaagaaaaaaaattatttacttgagtgacaagggataaggtcaatatgaggaaaagagttagtttgtgaaaattcataaaaatcccatgagtctgaccggagaagcaagaaggactggagtcgagatcattccatttattaattacccaagatggcaagtaaccactgttaaagttcacaggtgtaggtatggttctgaataatttatatactcgaattatatcttggagaaatttattctacactaacttttactccgggacgagtaaagagctaagtgtagggggttttgttggcagttattcaatgccaattctataccgccaacatctgcataaagtccagacaataaaacatccaacatagagtgataggtgttaaatctcacatatttcacaagtgttggtgtatatttgtatgcaagtgataaactctaaagttgggaggaaaatcatactaaagtgagagaaaatatgtatccatacaaggatggtttttgaacttcatcaaaataccatagaatcaacacaaaactccgagaaatggatagagaagaaccaggagaggagatgggccgaaggccaggccggaagggcccatgtcacgtcctgataaattcatcccgaaataaaaatcattctctaaaaggaataatagaattaattaaaattcgaaaagaaattggttaacactaaaatatgtacaagaaaaattcgaatgtggcccggagaatttttgttaaattctccttggtctaaaatgagccctcaaattttacttgaattttcagagcaccggaaatatttattaagcaacaaaaacaattatcaaagtttattaaaaaaaacggtggttgtactcattcttgctctatctttccccccttcagtaagag

SEQ ID NO: 60617 - DNA, 705 bp, Oryza sativa
aggtgtgcgcattttgcactgcggtcccttgccgccctctgcaagggctgcaagggggcaaatgtaattttcaccctgccaaaaatgcatttttctttcttttttcatcttgtccgtctctcacgtcaccctgccgccctccttgcaatatttacttctgtaaaatatttacaccggtacaatatttctgtaaatattaaaaaataaaaatttaaaaatgaaaaaaaattcggcaaaggcagcggttagcatttagcaagaagtcaggtgggcctattttattttcgggaaaagtacacgcaaggtccctcaacttgtcatcgagatacaaaatcgtccctaaaccgcaaaaccggacatccggcatcccccaacttacaaaaccggtcataaaaggtccctaggcggttttcaccccggttttatcccacgtggtggctgactcagcgtgggacccacgtgtgccccatatgtcatggagaccacgtcagcctcctctctctctctcccttcctctcccttcctcatctctctctctcacttatctgcatcatccgtcgtcgtcttgcatccagcaaggagccgcggcggcagcgggagcgggaggccgtctccgccgcggccgacggggaaggagcggcggaaaggagatcgaccggccggctccccacccggcgaacgcgagcgcgagcatgaggttcatgc

SEQ ID NO: 60618 - DNA, 7882 bp, Oryza sativa
  unsure (1)..(7882): unsure at all n locations
aatttcagctacttacatgaacaggcacatgatctggcggatttagaagttcctttcacagaggaagagataaagagagcggttttccagtcaagatcagatagtgccccgggcccagatggtttcacaggtggtttcttcaaaaaatgttgggaaatcattcaacaggatctagtccaggctgtcaacagggccttctcctccccgccagaccgtcttagactaataaactcagcatacatcatcttattacccaaaaaagagaatgccttccgtgtaggtgatttcagaccgataagcctaattcatttcttcgggaaactgctctccaaactactagctaacagattggccccgagactacaacagatggtatcagcaaaccaaagtgcgttcataaaaggcaagaacattcaagacaacttcctctttgtcaacaacatggtaaaagagcttcactcctcgaaaacgccggcgattttgctcaaactagatatagccaaggccttcgactcggtcagttgggcctacctcgtagatcgactaaaagcgctaggctttggtcatagatggattgactggatcatttctatcctggcgagctcttcctccaaggtgattttaaatggcagggcaggactcagcttcatgcatggtaggggccttcgacaaggcgaccccctatctccgatgcttttcattctggcaattgaccccctacaaaaactcctcgccgcggcacaggaagaagacctccttcaacctctacaccgacgaatagcaaggtttaatgtcgccttgtatgctgacgatgcagtggtcttcacacggccagacaaacaggaacttcacacggtgcacagcattctacaacatttcggccaagccacagggatgatcacaaatctaacaaaaagtgaagtctactccattagatgtgagaaccttgatctacaggacatcctagcccctttcccagcacaacaaaagaccttcccctgcacttaccttgggcttcctctgcacatcagaaaactccggaaaatggatgtacaacccttaatagacaggttctcagcgcgactaccaaaatggaaaggaaaattgctaaataagacaggtcgctcagtcctcatcaaatccactctgtcggctctaccaacctatcatctcacggttttccctcttaagaagtgggcagcgaagaaaatggacaagatccgcagaggatttctttggacaggcgccgatcaggctaatggtgggcactgcctagtgaactggaaaaaggtatgcaaaccaaaaaatttgggcggactaggtataactaacttggagttttttaccgatccttgcgtcttaggtggctctggtatgactggaaagcagatgggaaactgaaagttcaagtgccattgatttggttttgatgattaataacaaatccaattatgtgagactaatatttttataagcattttttgcctagtctcatgtggatatganagtggagtgttggtggacctaaatcacaaggatgaaatgcatggagatcaagctatatgtatcactctttctcttcatatacatattgatatgtttgtatataatatttccacgtgattggcatatgcatgtgagactaatgttttgtttgagtattatctcttatttagtctatttacattgagaacgtggagatgatgaaggtatgtttttattttaatatctatatttgagaaatgtcttctattcttgtataggataagctctcaatgtttaatattttgttatgcatactcttgcttcacacaaatattttgtatgcatacatttagggggagcaaatcctatactttagttatgcatgtaattgattaaagttattcaccttcatttaattgggatctttacatttgaacatatatttgagtatatgacacttgtggtgttgattaatactcatcatttattcatatccttttatacatgcgatcggttggtcaacataaggaggttgacaaccggatcattgggactaataagtttattgagttgaatgaaagaaataggtcccaaggattacaaaagtgttgatgcttaagtgatatcattacacctaacaataccaagaatgacaaagtgaggatattgaagatgtgtgatacgaagtggctattatggcaagacggtgaagggcaagcgatgctcggtcgcgatggaccatgcggcggtgaagggcaagcaaggggcttggcgccgaagaaccaaatccggtggtgaagggcgagtgacggctttgtcatgatggaccatgagggactatttgaagctacaagtaaccgcatcaatcatttgaagaatatatggtgaaacggtatcggcattggtctccctcaagacaatgaaagaaagataaaaaaaaaggcattcctaatagtataattatcttcttatgtacatttgagtttaggaatgccgtactattaagagggatgcaacgtcgaggtgtttgtgtatgtctcggtgctcaaagtgacctatcatagtgctaccttgagagaaacccaagctttaacctatcctttgagtggttttagaccttgtttttcgttgacttgggtagtcctctgagtgagctttccatagagtctaagttcataaaaaaacggactcccgagcgaaaagttatagtcgttttactctgtgcttttcggaaagtccgaaaaattaccggaaactccgataatttttcggacaacttcgaaaatttccggacattccgaaaatggctgcgaatctgagatttgcttctgtaagttttcgaacttgtccgaaaatgcttttcggaaactccgaaaattacagtcttggcctccaacggctagtttttgaggggctcgggtatataaactcctccacccctcctttgagttgctgctgctcttggggagtattagacacatccaaagccaaatagcatccccatttccctacctttgtggtgcctctttgtgagggggatttgagaaggggagagagttggattgagagagtgaggagttgagagctagtgagcttcactccatcctttgtggtgcctctttgtgagaaggatttgagaagggaaaagagttggattgagtgattgagaagttgagagctagtgagcttcactccatactttaagcactcgagttcatagcaagcaaatcttcgattgtgtttgttactcttggggactaaggtctcctagacggctaggcgttgccggtgagcacccaaggttgtggtgtgccacggaaagtttgtgaaggcttcgatttcgcctccgcaagggaagaaatcaagagtgaaaccgaggagtgcatttgtgcaacctcgtgagaaaagggttgaaataggcccggcccttgtggctcctcaacggagacgtaggatccgtggattcgaacttcgggaaacaaatcgcgcgtctcccctcttggtttgcccgttcttgcattctctcatattgtgcttgagcttgtttttacccgatctacttgcatgcttatttgatttagttggtgaccttatatcttgcttagataccttatttgtcaccttttgattcatatacattttgtttgtttgagctacaagttcatagctagtgtttattccgttatccgccgaacttttcgattgagaccggaacttccaatcccataccggaagtttcgatttgaatcaaaagttatcatcactctaatgtgctatgaagttgtgataatttttaggaacacctattcaccccccctctaggcgacattaaggtcctttcagaaaccatggcaaggctccaccctaccatgcgatgaaacggacaagcaactcttcagggcctctacaatcatcacactaggcaatgggggcaagacaaagttctggcacgacagatggcttgatggccaatcccccaaagatctatctccttccctatacaagcttgctatgtggaaaaacaaaacagtggcccaagaactagaaaaccacaagtggttacggccactccgaaggatgaactcgacgaccgaggttcgagaatttatcctgctctagcacttgatacaacaggtacaactggatgaagacagggaggacgatctaatgtggaaatggaatgcgaatggaatctactcagccaactcggcctacaaaattcaattcactggaagcattcaggacaatcgtgctaacttcatttggtgagcaaaaacagaaaataaatgcaagttctttggatggctcatggtccaaaagaaaattctgacgtctgacaaactccaaatccgaggttgggacaacagtccaacttgctccctctgtgggacagaaccagaaacagcgacacatctcttcatggattgccccttcgcgaaacaggtatagacaaacatttggttgaaactaggactcaacatgcctaggtcttcttccttcaatggaaacatgatggattggtgggaagcttgccggagagaaatgatcaaagagcagagaagaaattttgatggcctcttcatctacacgacatgggggatttggctacaaagaaatgctataatttttaacaatgactatggtacagtgtcacatgtggttgacttcatcatcaacatgtgcaaagccttcgatgaagcgcaaatcgcttagatgataaaacgccgacttttgctgttagtggctttgcactttctcaaagtgctgtaacctcctccagtgtaaaatctgaagacacctcttggaggtgtccatgtacgtgaaactatttctttctcctctaatgaataggtagagctcctgccattatcccctcaaaaaaaaaaaacttcgggactagtagctatatatttgtgtcacattttctttgaaaaagtccaataattttttaggaaaggcaagcgtttttacactaataaattatacataaatcaagataatttttaataccttacactataatttttctattaagtagaattaggataaaaatcaatttattatctactttgaaagagaagagaagatagaacagatagaaactcaaaaggtaagtagtatacggtagcaagcatatgtaagtactcccttcgtttcaggtatataacatgttttgattttggtcaaagttaaactggttcaagtttaactaagtttatagacaaatatagtaatatttacattatcaaattagttttattaaatcaataattaaataaatttttataataaatttatcttgagtcgaaaatattactatttatttctataaacgtggttaaatttgaatcagtttgactttgaccaaagtcagaacatcttataacctgtaacggagggagtagtgactaaaagaatatgacgtcatattattttagcaaaattgtttttcttcccttgaaccgcgtgacatgacgttttgagcccgtttggtagagcttcaactcttaaatttaactctaggagtttggtctgaagtaaagttgtggagctgcacaaacccaacttcacatctctagttcattttgtgatagagctccacccaactccactcctattttaggtggagctgaaactgtttggctgggctctaggagaggtggagctggagttgtgccaaacaaaccatttcttttcgttttaatttggtccattaatttgacttccttttgacatatcgaaatcccgatcgacccatccaaatttgtgggcttaaagaaagcctgctttgatggagttcttttttcctatcgataagattcagatatatatgatccgagaaaaaaataaaataaaaagattgagctagatactttccacgcgaggtaacaaaagtcgattaatcggatgtcatcgacggtgacattttaaaagatggactttttatcctaaagtgaacatgtcctgtatatcatttgaaatagttttgattttttttttataaaaatatagtttgataagatatatcaataatcatcatatccctacacacacaaattcattatacctcaacatgttgcttaaaagaataaattatactctaactacaatacgcacaccatttcatgatcgtatttttttttcaccaaatttaaacttgtatgccgtgaagtaataaatcgtatattaatctgccttgtccttgtccattttgtttaaaaaaattcataactgttttcactgacttgcaagaaatgagagatggtatatatccttaaagagagagaaaaaaaatgctttcactcttttttcttcaattataaaagaaactatttttttcttattattatattgaaagataccacgtgcgcacactagcgcaaccgaaaatagaatagtcccaattaattcccaaatcactagtagtggaaccattttaatactaatccagtacaaacagacgaaccattggaaatatttggaaaataataagatttaagtcaaagaccagtaacccctatcaggacacgacacgctaaaatgatctgatcgagggcttattttaagccagatagcggtggacgagccgacaatcagctgacaaacacgtcctattcgagcccgatatctcttgatcgctttccctctagttgctgtcagccaaactcagactcaaccaactactgcactagacagtcaaatttaatttgaaataatgcacaaacttagcaagatttaaggagaaatttaacacaaactcacgaaggacaaagtggacgatatatatgataatggcaagtgtgtacagtaccttagaagtgacgattgacaacgctgtattttttttggacgggagagtaagccctgtttattttccaaacaaaatttttgactctatcccatcaaatatttagacacataaatagagtattaaatgtagaaaaaaaaccaattacatagttcgccagaaaattgcgagacgaatcttttaaccataattgtgcaatgatttgacaatatggtgctacaataaatatttgttaatgatggattaattaggcttaataaattcgtcttgtagtttcctggcggaatatgtaatttgttttgttattagactacgtttaataattcaaatgtgtgtccgtatatccgatgtgacatgtaggggtaaaattttttgccaactaaaccagctgttagtactactccctccggcccataataatatagtgtatcacatccatctatccagattcaatgtgtcacgttcctctaaaatctcttacattttagagggggaggagtgctagtttgttctcatcgtattcatgactgttcatgtaagtacttcatgctagttacatgattactcgcatgaacagtaacaagttgtcctaggaatctaggacgcatgccgtcagttcctgcatactatgtatatacaacacagtgtactgacaaagcagtcacgaggttgcacgccgtcgtgagctgtaaactaatctgccgatcgaccaatcgacgaccaaactaattaaccaagggatcgatcgatcgatcgattcgaggcagcagcgcacatgttgatttatacgcaccttggtgctgctggggtcgtgctgcagcggggtggcgatgaggaagacgaactcgcagccggcgatggcgggctcgaaggtggcggcgtcgtacatgtccgcctcgaacagcaccagccgctccgccgcgccgggcatcctcctcagcagcgccgtcttcttctcatcccctgtacgtacgatttcttcagatcagcaattaatccacagattctgaatgatggatttggcgatcttagcagctgagatcgagatcgaggtcgatggaattaatcatggaaaagagagagagagag

SEQ ID NO: 60619 - DNA, 566 bp, Oryza sativa
ctgcagccttgccgcccttcctcctcgccggaatggagctcgcgccgtcgctctctctctccgccgtcgctgccgagctccggtccgccaccgtcgtcgccccggaccacctcccacctcggcgccgcctccttcggcttcgccgcatcctcgccgacctcgtccacccctccgtttcgctcgtcgaccgccggagcgccgccgtcccggtcgacccgagccgcgccgccgccttcctccgctccggccgccttttcgtcatcgccgtcgacctagggtgagctgtggaccgccgcctcgtttccccctttccctcccttctctcggccgctgctccgccgtgcctatggccgccgccggcgaccgtaggggcgcgcgcgcgccgcctcccgccggccgcgccgccgtggccgccttcgggcgcaccgagcggctgccgcgtggggcctggccgtcagccgcccgcgccctcgggtgcggctgatgcgtggggcccacggcgccggccggtgcgagcccgggtgcgcccggtccaccgtggaccgtgaggctgccgcgtgggcccc

SEQ ID NO: 60620 - DNA, 725 bp, Oryza sativa
  unsure (1)..(725): unsure at all n locations
tgaagattattttgcacaaacaaagggcttacaaccaagccccattttactgtacagaaacagataaagcattcagcactgttccaggcatggagattatacttcacatgatagaacttgctgaacataaattgcaccaaactgaagatcctttgtaacagtatttgccatccaatttgccgccctttaagaaattaccatttgatctataagcctttcaattttaccatcaggactgcgaatttcttcattccgtgccacttcctttcggttcgagcgcatcgtctgtctaagtttgtccgtacgtccgtctgcctgctgacacgtgcatctgttcaccccatcgatggtgttgacgatcagcccgttggccccttgcctagggcatcccaacagtagcaccgnacgaggaccgtgaagcagcttttgggggtcgtcgttcctctgcagctttagagctcagcgacagctcctcctgccagtggacaggacccactgccgtcagatggacagttactattgtgaaatgcacttactcagccgttatgctgtgggctccgcacgaccggtttcaatgtggcaagtgggtgttncccggaaatccaaaagttgggaatggcagcgcttggtttctaggggacttaagaagatcggacaattggtgccccattgaaccatgctcacatgccctcaagcattaggtggaatcggttagcccccacggt

SEQ ID NO: 60621 - DNA, 583 bp, Oryza sativa
  unsure (1)..(583): unsure at all n locations
gatggccactaggactactgatataggccgacnncgagctcggtacccttagtgctttgctaggaagccgcttacaaaatcacttggtggtgttgtgtagccatttgaatcatcgctcagctcatgtacagatgccaaagattcagcgctccctccatatccaatgctcccggtatgttccagatgatcattgctgcattttagaatgatctcatccatgaacttgttgctagatttgatccaatattgctgcaggtgttgattatagattttggagaatatctcaaactatacctagtacacatgtgttttccattgataaccacccaaacctgacagcatttgcgcagcatcgcttcctttgacatgctcctgcataataccctggtttagcatgcgcatggagtaatatatgccaatagagaaatggatctcttttgaaagaaggaatggaaattcaaaatgtagaatttgggatcttaccttgaaccaatgataattctcttaattttgagcttctttatcagattcacaacaccagcaagaacatcatcgtgtgaaaggtaatgtgccctaacctgta

SEQ ID NO: 60622 - DNA, 22099 bp, Oryza sativa
atgaacgtgcaagttaatttgatcctgtattcacaaaaaataaagcaaagaattcgtagttaaatctataaatgatagccgatcggttaggtccgatgacatatcattaacctttgagccgatgtcatatataaacggatcggcggttataaatagacagtgaggaactaaatctattcgatcggctgtagatattaaagacatatagttcttatattaatatatacttaaatcaagtgattgggatagatcggtcatcggtcaccatgccgagacagtataaatcacttagatcgaaatatatattaataacaggattatatatgtttatagcatagccgatcagatagatctagcatgtatcggctaatactccgatactactctatataaagatatcaaaacaagtataatataccaaacaaaagcttaatatacttaaatgcaataatttcttgacataaagggcggatttaacatgtcactgaagcatatagatcgaatatggttaaattagataagatcggctgaaactccgatactaccctaatcggcaaccagaggacaggctagagatcgatattctaagcacgacttaatagatcaaactcaactgatgcagcattaagtatgaaaagaagaacaatatctagacaatcaagccgttggatgtttcataaagtggtagatatcttatataatctaggacaacgtcgctatttaacctaatcggctgccttctattagcagatgttagccgattgtaggttagatgacgatattgccaaagattatgtaagatatatgataactcgatgaattatatagacaagattagagtgtcataaagatggaagcagtaatctcgagaacacaagtcatcataacaagttttacctcttgttgaagatcgaaaccgatgcagctcaacccgaaagcaagaactcgtcgaaacaaaactaaagcaaaaaggtggcgatgcgccgaaattgtattgaacgtgtgtgttaaaaattacatagggctcggggtctatttatacccgagaattacaagatatgtccataccggacacgaccactatctctaacaaacactaagataccataagtctttgcggtagacttttgcccaaacatatctctaaggaagttacataaaatatcctaattaatagatacaattgccttctcaggactctatccatgtgccgataaaatagaatgtgactctagagaaagcttgcagcagaagtttgggtggttccggcaagggtgctgcctagacggcgtcaccagggagagaagcgacgaaagaatcgccactgctgtccattgaggtctcaagaaccttgactaggctttcgcccggcagccctactagagggggcgagacggcacgacaacaccctcaggagggggaatgacgctcaagcgccatcgttgccagcccggccacagccgggctgggttttcacccccccatccaccgcctgcttatccactattgatgcaccgatgctccaccgccttctgaacctctgccagcgcatgggcaccactacaacggtgccgcccgccaggtagcctccgcatgccaccggtgatcgcaccattcgctgcgccgttgcgcgggcagctacagtaccgcaatggcacactcctctcgaaccagtgccaccgccgatcaagcctcctcacgccacggccaaccccgtcgccgctgcccgcgcctcaccgacatacacaaccactagtcgtgttgagcctccacgcctcctcacgtcgtgggaccctcaccggtcaccgcagtcgtgcctccgcctccgctggcagccacaccggctcctccagccgctgttgccgccggccagccacctgctatcgtcgctgtcgccaccgtcaccacgagctccgtgccgctgttgccgccgcgacgtgctctcccgccgcgagttcaccctgttgtcgccgacgccatcgccgcgagtttgccccacaccagatctgcctttgggggggcgcagatccgcctccggcgcggctagatccggcccgctgttgccatccccgccgccatcggtccccaccactcggcgtagctcgccatcctcatcgccgtcgccttccccaccgtcagccgccaccccgccagatccggccagagcgtagcggatctggcgatcaccaccgccgccgccctcggtggcttcctaggtcacccgagcgtggccccgctggcgagaggcgagctccgccggcgccgtccttgcggctgcattgctttgctggcggcagcaaagcggaggagggaggtggggaagagggggtggccggagctcgtaatacaaggtttgtaaatactagtacgatacacaatcacgattcaattccttatttagagccataaaaattgcaaggaggaagaacactgaccccatttgatgccttaaccatgtcattcctagagagaaccctgacgtaagtctgcaaatggggcgggttgcggtagcccgccccacgtccgcatcgcccacaagaaatctggcgggtcacctacatcctgttgctctacccaatggatttgtttggtgggttttgctgacccgccaaccaacccactagacataaaatacgtacaacacactattgcactgcacacacataacatatatacttttccattctagcgcaacatggtagtgaatgaaaattctcaacaaagttgaaatagcaaagaagattaaagttccttgaaatttacactttaacagaataaggataactgaagtgctatcaaatggcattatgacatgcaaattagaaatgactaattcacatccaactcaaaatacatatgacatgctcccatcctactaagaaattgttcaaaatacatatgacaatctcagtcaaggctaacactataaattctagcatcaaatatcatgagaacatggacactaatgacagctcccaaggtgaagaaggtctcgaaattctgcaagctgaaaacagaacaactcccaaggtgttgacggctgttaaataccaaattaacgccgtcaatacctgtataaaaccataaaagtaaaacatcccacatagtggaaggatttatttctaaccatttccatgagtgttggtgtatattcgtatgcaggtaatcaaccaccaaagttgggagagaatgagcatgaagaatgcaaatatattttgcactgatgaacccacatggttttgagctataacatataaaatgtgcaatcattttgaacgaaaatatggtgtaccataaagtggggcccacatgtcagcatcttgaagaaggatgtgggctagggaagccgcctagggttcagccgaacccctagctggcccaatccagcctaactttggcaaggcagttactaccgacctcccaatgatggttgtgcctgtttctatcgatgtaaaccgtcataaagaggacacttgtcaagaggagagtgaagattccatttagatgcttagcatctccacattcccaaggcatctctccacctataaatacccctctctccctcattctcacacacaccaaagcatgagttgaattacaagaggctattgtactttgttgtatattagattagggagagagtagagtagaggaagtcggaggaatttcggagttgtcagcaatcctcttcttatttcttttactctgttaattactctgctttaatcgaatatcattctaagtaattaagatttattccgtgagagttactcttagttagtttctaatcaacgtatgggatcattgttcactatagtccactaaaatataataattgcttattttatcaattccaccacttaatgcatcaagcccatcttgaactataagattgattatatgtgcaccatagcgaaaatgaaagagatcacctttacatggtagcatattattctcaacaaaattttgttgcaaactactcacaaaactatcgtttaccgaaacattatccaatgaaatagaaaacaacttctgttcaatatgtcaatctttaatacccttaagtattgactcaacatagttttgctgtcgtggggcgcctcaaccaaactgaacttaattatccttttattcaagtttcacttttcatctatgaaattacaagtaatgcacaaataacccagcttttgatttgatgtccatatatcagccgtgggagaaactcttgaatttaagccattcaaaacctttagtaaggctacctttcgtttcttatatttcttaacacaataagcttttattgtggttcacggatttaggcttgacgcaaaacttctaaacttgggtagctgaaggacaactcatagcagacaattaattccacaagtaatttctgagaccattgttgatcaaatttccactttattacagcagcagcatctagcccatagcatgatttcagcttagaataaatctggtgaagcctatattcaccctcacaatttgccaaatgcctaaagcaactattagtaacaaccccaccccacgtgtagctttaaacattttaccacaatgagaacaccgagcttccgccagcgcatcaccatcatatattggatcaaaatcatttcatatagttgatgttaatttgtgtttttagttatagatgataaacctaattatttgaattaagcatacattaaaacacatgatcgaacaaagcggtcaattaaattatatgcatcaattgcatgaataaatagcagtagaattacatgaaaaaaaataagtaaagaaaaagatcatgtctttcggatcaaaatacttacattgtcaagtttaattgcttcctcttcaattgcttcctcaaaagatggagacggtgacatcacaatcctaatctccggagatctaacgatttatacaataggtgatttgagccgctttgttgccggagtctgttgcttttctatcgaggctttacgtttatatcccttaaggtacttgaggagagtatctcttttgaggcacaatgggcaacatctacaacagtaaaaggaatttttgtctgccatgaaataaattgtaagcataaactctgctaataacaaaaattcaaaccagcatatagggaacacttcaccttataaaagaaaaaagcaattggaacagtaacatctgttttggtaataagtttctgctaaattattgattcatcagcatgctatgttgagaaatggacagggtataagctatatagccaaaacagttacggttaaatttcagcatagcacattgtaatcatataggtacagcagacatgattattagtatattatcttacttcagacgttatcatgataaaaaggtaggcacgagatggaaccaaatcatgtccttcatccatcccccacatgtttgatgagaaaattccatctatagatttttttttcgcaagaatttggccactacatatccagtaagcatcatgtatgtttttttaccaagcattatgtatgtttttttaccatgatcaagtactaaattggcatgagttatttaacaaaggaaattcatatatttagtaataacaatagggggttgattctacagccataagcaaaaatcattgcatcgccaaaataaagattcaagaactcacctgcgtagaaaccaatggggatggagaagccaatctggtaggagccatagcaagcaggggtgatggaggaagtgagatgggcagcggagtgagcgtcacgacaggcaccagagtgggcgccacgaccggtgatggcgtcaccatggctggttgcggaggaggtcggccgagaggaagatgagcacggccatgagaggcatcaatggacggcgtgtcaacaacggcagtagtggctgaggactgccgttgaggaggcggctgctagggttgagccggcagcactctagatcttgtctagcgtgattcgatcccctcctcccctgcatgcgcgataagtgggttgtggcgccactgggccactgtgggcagtcgcattaactcacatatcttctattgggttgcacataagtgagttagtgggtaagtggggtgggctagcccagggggttagtggcaggcccaccccacttttagccttactctgacgcatctctctcatcatcgagtaggtcagattgctagctgcgcagcgaacaatgcgttgatgtccaccctggccaccagctcatttgcttagccactacaaaaccatcaaatccaaacaactcttcaagaagcagagcagcaagaaagtgggtgacggtaaccaacattgtcgatggtgacgatctgcatgcgatattgcgacttgaagtagaagtagacgtactcgatgtagctgagggagaagttatcgagccactcgccggagacgatgccctctaggtactcattgatagcccatgtgcaggttccccagcaccagggctgccaccacgctctgcagcacgttgagtaatgatggtagtcaactccaaccaatgaagccgccacgacactgagatccgtgttgaggccgatgtgggtgctcaagaaaagggcagaggtatcaggggcggtgtagaggcatctacaccgccggagagcggagagcaaatgcgtcgatgggtgcgcaggggagtagatcgaagcgatggcagcgtggtggaggtgacggcggagcaggaagagcaagagcagctgagtggattgggtgacagtgtgtgggggattgattggaggaaataaggtgcgatgtttgcgttggaggaagttgcggcatgcgccatgcgtgactgaggaatgatccggcgtctgcgtgatttcattgttggatcgcatctcacatcagggatttttatatctggaccattggataggatgatctaatggttagggagggcctgcataacattctatgtgcgttttcgtgggtgcatctagcaaaagagtgaactgcttcttttcatattagtatcaatgatacttgctcttagaaatagttggatatatctattccaataaatgtgcatccttcctccatttcaaatttttaagacaatagatgagactactgtcggtctctatattaacaagtggatatacacggatctattaatgctgcatatcccatcatttcaatgtgcatatctgatatctctccaacgtcactagtagtaaggtctaataaataaatatacaggctagctataaaaacagagccttcccctatagacacaaaacgatactagaaattagaaaaggaaagcagccaagtcgatcatcacatcacctgatcgttcttgtgagctcgggtgacaacgttaattaattcgtaagaaactgcggcaccggcagtagcatcaatggcacggggaagcgccgccgcgccggggctgctgctggcgctttgctgcgcggctgccgccatcgccgtcgtccacggcgaggattgggccgtcggcgacaacaagggatggtccttcggcgtcgccggctgggagaacggcaagcgaatccagcccggcgacgagcttggtgagatcgatgctcgatcgagcaacataatttatactttctcccttttgtattttgtattacaagtttgctttcacttttaagagaagtcgaacatttttaagtttgattaagtttatagaaatataatattttttaaatattatcaagatatatttaataaaactaatttagcgttgtagttggacaaacctaaatttgtcttaaaaaacaaaaacgacttaatccaatttgatcatgagtttgatatataaatacatatggatgtggatacgcagtgttcaagtatgacgcgaagattcacaacgtggtggaggtggaccgggccgggtacggcgggtgcacggtgaccgggccgtccaaggtgtacaactccggcgacgaccggatcaagctcgccggcggcgaggccttcttcatctgcagcatccgggaccactgcaccgcgggcatgaaggtcaaggtcgcggtcacggccaacgcgtaggtcgtacctagctagacttgcatgatgatagtctcgtctagattaagcagaatctattccgaccctcattgattatactctaataagtcaaaaccaaagctaaaaccaaaattgaattttcaacttaaatttgatgctgattttaacatacttttatcagtgtcctctagtgagctccaaatttaaaaactttaaaaacgaccgtaatgagcccaaaattttacttgggctgaactacgagagggaggtcgcaatgcggacatgggctgaaaattggactattatacgttggcccaactagcgcaaaattaaggaataagttcacccgaggtccctcaacttaacagcgagattttttgaggtcccttaaccacgaaaccagaaatgtgtacccctcaattatgtaaaaccgtccaaaaaaaagtccctaggcagtatagacgtccggtttcgctgacgtgacgtcctagttagcaaaaaaaataaaaaaataatatggcacccacgagtgagtgagaaggaaatagtaagggcccacttgtcagcatcatcctcttcctttctctttcttcttctcttttcccttttcttgccgcagaggggagagctgcagtagtcgccgcggcagcaaagcggccggagtggcggcggcggagagcggagtcggcggctgcgaagcaggcaggacggggcagcggcgggcgagcgtggctgcgagtgccgacggcggacaagcaggcaggtggagcgttggagagcggagcaggcgggaggcagcgacgggcgagcgcggctactagcggcgacggcgggcgagcaggcacgcggagcagcggagagcggagcctgcggcgggcggtggccgcagccacccgcatgccgtagctcgacccttccctgcccattatcccgctcgccgccgagccctctcccggcgctcccatcggtgcacgcgaccacaccgggacgctggggagcctgcagctgctgatgttgagcggcgtcggactgcgtgggcagctggagaagcacggcatcctcccgtgttggaccagcccatggacgggcagggcatggtggacaaccccatgaatccggttggctagctagctgcatgcagcgtgcaaactaattaatgggtgtttcataacgacgacgacggcgactggaggcagacggggcagctggggacggtgccgccgaaggagcggacgccggaggcgatgcgtcggctagacagacgcgcattctgtggcgggttccggaggcaggcgaagcggcggcggagcatcgacggcctgcccatctgcctgctcgtcgtcgagccctctcccggcgctcccatcggcgcacgcgtccaccccggccgctctcctccgcatcctctgccggtgtcgcgccgaggaggtgcgcggcgccgtggaggcggcgtggctggcgatagcgagtacgccgttcgcttgctaacccgccgtggctccggatggggagaggcgcgcgccggccgccgctcccgccgtcgcgggcggtcgcgccggccgcctctctccccttctctggcgccggccgcctcctctccccctctcctgcttcttccccgcgcgccgcagcgcccgctgcgttggcaaccgcgcccgctccgctgtcggccgccatcttcccgcctgcgcgtgagagctgagaagttgagaagagaagagaaaaagaaaaaaaaagagatgtggggcccacatcattttctctcactgacatgtggacccctacatatttattttaattatttttgctgactagaatgccacatcatcaaaaccagccatgtatactgtcttgggacccaaattagacggttttgtaaagttgaggggtgaagatttctggttttgtggttaagggacctcaaaaaatctcgctgttaagttaagggacctccggtaaacttattcccaaaattaaaaatcccgcgttgggccggctctcatgccggatcaacaggacatgacatggcttagcatatcaaggaataagtacactttgactcccttaaaagtgacccatatctaatccatgacactaaaccgcaaaatcagatatattgacctctaagctgttaaaattggtgcaatttaactttctcagtggttttagagaacggatttgctgacgtggcgtctacgtggcagtgttgacctagtctgctattgacgtggcgctagggtggcattacaattaaaaacatacatgtggggcccattcgtcattcacacaaaaggaaattttgtggggcccactgtgggtctatcccttctccctcctctctctctaccttatctctctctccctcttcggcatccgcccgggaggggggggggagggagggggcggaggcaccggcaacgccgggagagaggagcccgagatcgagggatgttgggaatcaaagcaactcacgcgaatacaagctacactttctgaacgaggcagcgaggaagaaacacaaacacagaagcaaacacacaggatctttgcggcaccaaaacaacttgtgcccttttcactggttttttctcttaactaaatgattacaatgagcacagcacatacacacacgaagctggttgttccgcttctcgagccacacacgacgcccacgtcctgtttacttggccgcaacttcacaagtactgagtcctcgccgacgtcgttgcttgcaccaaccaactaacctgcatgcatgcaaactgaccacttcctactcctaatcttgtgcaagactcggctaatcactagcccacaattatgcatggctaactaactaagctacatacatgtgctctcatctcctggctctttattggctcactactccctgccaaccactactcactaagccatgcagcacccacgtacatatagctagctcgccaggccatgcaatacacacatgcatatagataaacatgctgaaattaagaaacaacaagattaatttctaacaagggagccgtcggcgcgcgcgacatgtgggtctgtctctcccggcatgcggcgggaaccagcggcggcagaggcgggagtggcggcgatagccgtgagcttcgttggatgcctccataaatgacgacgacgacggggtctgccggcaacttctgcgacgaggcttcacccgatgagatggccccctccggcgaggacgacgagcttgatcgcatcctcccgcccgtcggtccctcccggactccgtagcgctctgcaccgcgcgtccccagctgtggcggcggcgcccctctacgtcgcggagctcgagctcctcatccgccgcgaacattactccgcctccatacactcctttcccaccacagcatctcgggcggggtcggcgggcggcaaacggcgtcgctactctgcgctactgccggggaaggaagcggttcgaccaatccatcctcctccgcacgctccgccgccactgccgccgaggaaggaagcccgccacgcgctcggcgatgagagaccggcccctccccgccaaggttcgaccagtccatcctcctcctcctccgcagctccggcgccgccccggcccctgcccgccgccgccggcggctgggtccctactcgttgtgttcctccaaaggggaggagaaagggggtgagaaagagagggatgaggggggagagagagagggaggacgaagaatgaagacggctgacttgtggggcccacatttatatttgtgtgatacaaatgggtcctgctcatttttttaaattataatacacataagtgccacgtcaactccacgtggaataaaaaccaagtcaacacctccacgtatgcatcacgtcagcgaaaccgctctccaaaaccaccgaatgagtcaaattgcactagttttaatagttgaggggttgaaatatctgatattatggatcaggatacgaatcagattcgaccatattaattaactgcattcaacggttaactggtaattttgctcgttaggttcgttttctttttttcggttttgctaggccctatttaatccggcagtgttacgttcgtcaattcctgaatctgctttcgtaaaagctgttggcaataactaattaatcaagccatagccttagcttcaagcaactaatacatactatgcatgtgtcgaaatctagaaacaatggtcatgcagatatttggtaaatccgattggagatttttaaatagacttgaataaatgtattctctattttatattggtattattagctattgtttagttatttcctgttttttacgtgctctatattgagtgaaatatataataagtagatctaacttatttagtcgcaaaggctgagattcttttctttatcttaaaaaatagccttgcttggccggatttggattaattgaagtaaagcccagtcattaggattggtaccagcctttggctttggttaatcagttaaagtaaagtactttcattataggataagggccttccttggaccgaggctcactgtgaccgtgtcacatgcaaacacaaacctagcttagttaacttcggttagctaaacacaccttttgcaaacacgaccctcgatatctggatttgattatggtcgatctcaatattccttcgttaactgacgtcactgcatacgcaaaattgaagtccaaggggagcttgataagggcatggttggcacagctccagctccacctcttctagagttggagctcagccaaatagttttagctccaccaaaactgggagttgagctgggtggagctctcttacaaaataaactagagttatgaagctgggtttagtcagctccacaactccactccaaacccaactcctggagttaaatttaagagttggagctgtaccaaatagacccttagggtatagccaactacaccctccggattaataatacttatcgtttttaacaacggtacggtcttaaaaaataactttgaccgttattttttattataatatatatataaatgttaacaaatatataattttttgaagtattttttaagattaatatatgcatatagtcaccatatttcattgacaaatattttacaaattataaataaccaaagattttaaagtttgacatcacacttgtccaaaacgataagtattattagcccggagaaagtactataactgatttaatagccaattcatacaatagttacctataaacctatattgcactattaatacaaggtttcatatgtcatacaaacattgtgttttagtccgtgctatagctggctacaaatctgtagcccgcttctcttctctcctcttttatatactcaatatgtgtttatagcggcttacagtctgctattgtacctgctctgcacccatctatatatagactgatcgaccacccggttctttcaaactaagggggtgtttggatgggactaaaattgtttagtccatgtcacatcggatgtttgacgctaattagaagtattaaacataaattaatgacaaaacccattccataagcctggactaattcgcgagacgaatctattgagactaattaatccatgattaggctatgtgatgctacaataattcaataaacacgtgctaattatagattaattaggtttaaaaaattgtctcgtgaattagctctcatttatgtaattatttttgtaagtagtctatgtttaatactctattttatatataaacatctgatgtggtaggaactaactttagtaactgtatccaaacatccccctatgtagatgcgttttgtagagacccaagtatccaaccaaacttttgtactttagataaataaatctctagacgaggcccctgtgtgtagttattacacgttgaaaaaaaaacaaaagaatggagagtttgcatttgccagcgtttccttcacatagacgcagggatatgaaaatggtcaatcggaaaactgccaatcccatttccatttctttcatatattttattttgggaaacataagcataatggttaaggcggaaatgataatggtaccgctattgttgggatttcaaagatgaaggggatgtttagatcgagtggtgtcggatattatatatggtgtcgcatgaaatattcgaacactaataaaaaactaattacagaatccttcagtaaaccgcgaggggcactaataaaaaaactaattacaacgtttcttcagtaaaactatttttgaaatagcaagtcatgtactactacctccgtcccaaaataagtgtagccatagatatccgtgtttagcattttgaccgtccgtcttatttgaaaaatttatgaaaaaattaaaaagaattagccacacataaagtactactcatgttttatcatgtaatagcaataaaaatgctaattatatttttttttcaaataagacaaatggtcaaacgttagtgtggagattatggataccccatatctacatgacagttataatttagtcggatatacggtaccaaatatagatagaatatctctataaggactcgggttagattctaaacttgtatgtcaaagaaatacccgggatcttagtcggttacgattgtattttatctataatcctatattccgttaggatatggactgtattttgtaaagcggacctcttcccctatataaggaggggtctgtgtgcctctcggggtatgatcttttttccaatttatagaatcaataacacactcggcggaatcatccccggacaggagggtattacttcttgaataagaaggcctaaacctatataaaattccttgtctccaaacccatccactttcctagcttgatcgcctcccccttttattattgctgaaatcttgtttcgacagttggacatgaacagtgctaaaactgcacttattttgggacgaagggagtaatagagaatacgatgaatgtaggcgaagtgctgttagtgttaggatatgtcatgacctgattcctagtactgggcagtattataatacctccgttttttaatagatgacgccgttgactttttctcatatgtttgaccattcgtcttattcaaaaaatttacgtaattataatttattttgttatgagttgttttatgactcatagtactttaagtgttatttatatcttatacatttgcataaaatttttgaataagatgaatggtcaaacatgtgagaaaaagtcaacggcgtcatctattaaaaaacggagtatttccttagtcaatttctacgactttgctcttcacttcgtaatattcctcaacataataatatattactccctctagttttaaaattttaatatttaataccgttaattcttttatatatgtttgatggtttgttttattagcaaaaatacataattattattcatttgttttgtcattaaatagttttttcatatttgtaaaaataataataagataaattaatgatcaaatatatattgaaaagtcaataataccatataaaaaacctaaaaaaactcgaaagaatatacgaataattttacggacttatttaaacactactagaaaaaatgttttttttagcaacgttggccttttatttttccaggcgggtatgaccctcggagctaaatagccgcctagaaaaatgtaaatcggggtggagctcaccatccgcctgcgaaaatcattttttccaggcggaccacttaagaggtccgcctgcgaaaataaatcggaaccttatgtggtccgtctacaaaaatcacaccgccaaaaaaaaagggtcatccttatcctctcctccaccattcttatcctctcctctccaccactcatcccccctcctctctctctccttctccctcacacacttagcaaaaaaaatcctccaccggctcacctcatccctgcctccgctgccggctgccctcctccctgcctccgccgccggctccctcctcgacgacgacgacgaccgcgacgccgcctccgctcgccgtcggctcccctcggtcgtgagatgatgaccttcgcaacgccgtgaagcagcggatccaccagctcccctcccccccgcctccgtcgtcagctgccctcctccccgtctccgccgccggctccctcctcgatgagacgccgcctcagtgagccgtcggctcccctcggccgcgacgatgatgaccttcgcggcgctgtgaagcggcggatctaccggctcccctcctccccgcctccaccgccggctgccctcctcgatgacgacgacgaccgcgacgccacctccgcgagccgtcggctcgcctcggccgcgacgacgacgacgacgttcgcggcaccatgaagcggcggatccaccggctcccctcctccctgcctccgccgccggttcccctcctcgccgtcggctccatctccgccaccggctccctcctcgcccccagcttcctccctctcgacgacgacggtgccaacgacgctaagacgaccacgacgtgacaacggcgccaccagcttcatcctcaacgacgacgaccacgacgcgacgacgatgacgatgcgacgacggcagcaacccctgtggggacggcagcagatggaggaggagagccgtcgtcagctagagggagagaccgacggcggtggtggggcgtcttttttttattcgctgaaatttgctttgcaggcgagtgaatctgccacctgcgaagatgccgtccgcctgcaaaaattgattttcgcaggcggacctcagatccgcctgcgaaaattatctattttcacagtcgtttgcttataggcggaacaccggtccgcctgaaaagacggatttggcccgcctgcaaaaaccttttttctagaagtgaaatacacacacgggggctagttatcgaatattatctctcaacatatttttctatcatctattaacttattaaaggaacagaaaaatgagccttcacattcgctctcacggcctagaaattaccatattaatcggagaaaaagaaaaacatagtccatatagaaatacaatttaaaaatagttaaaattcggaattaaaaaataaggaatagtggaagaggagactagagtccatatagaaataaaattaagaaataacagaaattcggaattaaaaataaggaatattagaagtagagtatagagtccatgtagaaatacaattaagaaataatagaaaatcagaattaaaaataaggaatatgagaagtagagtatagagtccatataggaatttaaaactaattaaaattcagaataaacataataaaattaaaagtagagtttagagttagtataaaatacaatttacaaataactaaaattcgaaattgaaaaaaatgggaagaagagtataaagtcaatataggaatacaatttagaagtaactgaaattcaagattaaaaattgaatattgtaagatgaatttagagtctacatagaaatacaattagaaataataaaaattcattattaaaaataaataatattagaagaagagcctagagtctatatagaaatacattttttagaaaacaaaaattcagaataaaaaaaagaaatattgaaattcagataggaatataatttataaataactaaaatttgatattgaaaataattaataactaacacgtatataaaatacaatatgaatattacacatgagtagtttcgtaaagttagtacaaaattttaaattatgttgccattttaatatatttgaataatacatttagaaaacatatatgctattatataagagaaaatataatgattctagccgcgcaatacgcgcggaccttttcctgaattattcggatgcatatggtacaacatattctacgtgagttacaagttgccaaaatgtcaaagtgcaacgtactatcctctaacccgtctgagtgtttaacttggaactcgtttgttaaaccaatcagatagtgccacgtcaaccatacagcccatcagtgggccccccacccgcggcctacaaagcaaatgcccccgccccccgcctcctctcgtcggtcaacgccgcgctcgatctctcgccgccatggcccgcctcgccgtcgccgccgcactcctcctcgtcgccctctgccgcgtcgtccacggcgaggccgatcaggagaccgcccccgcctacgccaaccgtgaagcctacgtcgagcacaatggtggtgacgccgccggcacgtccgtcgccatcgtcccgccctacctcgacgccgccgccgccgcccgtgacgagcccgcggcggcggcggcgagccccgaggggcctgtgatcccggtcgacgacgacgcggcggaccagcagggcttcctccgcttcccctgccgctaccactgccgctaccgccaccacatgcgccacggcggccatcgccatggggagggattccatggcaaggaggagaagcagcagctggtgttcgagatgccagtcgagccggcgacccgcggcgaggagcgcagggaggaggaggagggggtggttctccccgtcgcggagccagatccggactcgcgccgccagtatgccgccgtagccgccgccgaggaggaagacgaggatgagatggcgaggctccaccacggccgccgctcccaccaccaccatcatcgccaccaccatcatcaccacgacgagaacgaggaggacgagcacgagcaggccgacgaggcttcgcccgccgtggagcggttgatcagcttccaccgccgccgccaccaccaccaccaccacgaagacgaccacgagcagcgcgaggagggtgcgcccatgaagcggttccgccaccaccacgaggaggaggaggagtccgagatgaggaccaagcgcttccaccaccaccaccacaaggacgacgacgagcgcgagctggaggagatggcgaggcggtggatcaggaaggcgctgatgagcagcaggatgcaccaccaccgcggctgccgcttccaccaccaccaccaccacctcagcttccgccaccgcgcggaggacgccgccgccgccggcgaggaggaggagaaaggcggggtgatgagttggctcaaggactttgtgaaccgcttctaggtctctcgatcgatcagcctagcttgccgctgcttcttcttctccatcgtctgcttgtgttgttgtgtcgagttcattcatgattcatatggctgctgtgtattctacttttctacggccgtatatgtatttcgtataccgtatttgtgttgtggtactctcgacttatcccgagtgttcatgttgttgtttgtgtcacggatgttaataaattgttctcctatttcaaatgcgtgcattaattaatcatgtttctatgtaacaaattaaatgttgctcgatcgctatataaaccatttcagttgtctgaaaaccgctacgatcaaaatcgcagagaggcaacaacaagattgcgtgcatgaatactcagctgaaaacagacgactgacaagctagcttgattctggcagtcaccaacaagatttcctgaaatcaggggcgttcttaacctgcttaattaaatttcatggacataactacacagcgaccggtctctggtttgcataaagcagcgatcactccgtcctatatttaaatctctttttagcttaaaaagtactatagtgcacgttttttacctctttaatcacttgtatcttttaaatcacatattatttttaagatctatttgcatcattatactccacttaaaatatatgacaaaacgagatccctgttgaataaattaaaacattttattaatttaaaagtaatttatttaaattatagaagtaacttagctatgtaatagaagtaactctatatagcattagaagtaattacgttatgagtgagttccagtaagaaacttatgtggagtaaattcaaaagtgtagagaagattttcatgtaaatacatttatgaaagtaaatttaataaagcctgaaagtaatttacataaatcataaaagtaacttagcataaaatgaaagtaagttattacagtaagttattacgatattagaagtaaatttatcgtaggaataaaaatataagtctatttagaaattaaatttaatcagcacaaattatggaattgagtaaaaaaaaataaaagtaatcaactcaaagcattatgaaattacgagaagtaatttaatcaaatctaaaagtaatttatatataagataaaagtaatttgcatatataataaaaagtaatttacaacataaatgttttttcatcataatattatcatgtaagatcttgatataaagatttaattgcaacgaatacaatggtgtaatcggattatagatcgaataagtaatttaagagaaaattttataagaagaaaaaaaaatgcacaacctaatagcataaactacttgcatgcatgtctgtaacgctactagtgcttctcacgtaattatccgtgtcgctcgttaattctaaatcgagatgcctctcgaaatagattttgtgatatttcatcttgactttgaagcgggcatatatgaactccccgcatactcttgacgatattccctatgttcaatcaccaaagcctccttttgattgaagaaaattacagacattttgggcttattcaatttgttgtcaaaatcaaccaaaccaaattttggtattgctgaattttagtaaagtaacaagctaaacaagatttttaccatcgcaactttcccaatttctaccaatattgggtaattctctacaaacttctattcacaaaactatataccaaaatttgataaggtgttaaattaaacaccaaaatttggtaattctctacaaacttctattcacaaaactatataccaaaatttgataaggtgttaaattaaacaccaaattttggctttaccaataaatgataagttgtcttttaacattgaactaaacaagcccttcattataattgaattcattcataaagtgctgattaaattagttgctgaatagcaaacccctctctcgtattctttctcttcggcagtagtgttagcctccatctttaggaggtccctttcgggtttgctctttgataacatcttcgttagcttataatgcttttttttcggttttaccatccttcatgggcttatgcgtaaattaactgtcatctcagcaaacattatcacacacacacaaaatttgaggtattatatagtctcactttatgcttttaaaaagaatgagttcatgtaaaattactgttaacttccgcgtttaaatggagcaccgacagcagaaggcgcgagcagtgattgtatcatccgtgatttcactggtggagaaaccatctttggtcggtccaccagttttcacaatagtcccggttatattaaaaaccaggactaaaaatatctttaatcccgatttaaaagctctaccaaccgggactaaagatctatttatagtcccgattggtaacaccaaccaggaaaaaagatcgatataagctttactcccagttgatgttaccaaccgggactaaagattgatctttagtcccggttggtcacgcctaccgggaataaagtcgacataagcgggatagttgcacgcggatcggatcaatacaatctcctcctctccttttttaactcatctcctcacagagtcacccttatctcttcctctccctcctcctttcctctcctcctctccctcctcctttcctctcctcctcctttcctttcctcctctccctcctcctttcctctcctcctctccctcctccccacctccctctgcaacggcggggcgcggagggccggcccgcgcgacggcgcggcgagcggagggccatccggccggcgcggcggtgcggcgcgcggagggccgggcgaggcggcgcgctggcggctggcggccggcgcggcggcgcggcgcacggagggccgagcgaggccgcgtgcgggcggctggcggcgacgggcggctcgg

SEQ ID NO: 60623 - DNA, 9071 bp, Oryza sativa
ccccgctcgcccctcccaccacgtgcgcacctgttgggcccacctacttctccccccctttttccacaaaagatgtttcacctagtgtacttataatgtttcactatttatagatctaatgttgcggtgaattaaaatattcttttgtaacaaaaacccacatattttggaagctctctattaagagaatttggtttattttttgtttcacctagtgtactcacagtgtttcactatatatagatctaatgttgcagtgaacgaaacattccattgcaacaaaaaacccacatattttggaaaccccctattaagggaatttggtttatttttttgttccaccgaaaaatgttttacctaatgtactcacaatgtttcactatgtatagatctaatgttgcagtgaactgaaacattctttcgctatttgctgaaacattgtttttatataaggtgaaacaacactcgatttaaacgagtgaaacattttcgatctacttagtgaaacaattccgatatacctggtggaatatcgtgcaatatttaaaaataattcaataataagataattttttcgtcggaatatatctatgtgtggtcttgttttgaagatttaattacaatgaatttaatggtgtaatcggatcatgatttggataaataatttagaagaaaaatcagtttaaagtagttttgcacgtaaatcggacgctgacgttaacgcccgattttaacctcctcccatcggacgcccgagcgggagtcacatccaaaaaaccggcgacgataaaaaaacggatggaacaaaaaaaataaaccggaagctttatgtatttcttttattagatatagatttaacaaacaacgttgaaaaaatattaaaaacaacttcaaattaaatttaaaaatacaaaattttctaactaaggcaatcaatggggctccttgtgccatgatcgaagcttaagggtacgaataaaaacaaaacgaagtctgtatgtacacgttgtaattctattaccaatctctctgttcagtgagttcacaataaaaacgattgctttgggtggccttcggttgtaacgagctgggttttggattctacagtcaggcgtgtcaatccgtgttcggttctgctactttttgttgtgccatgcatggtggccatggaccaacatcgtgcacgtagtgtcgaacgacgatggatctcgctgcttcgtccgtgtgcgaatcggacacatgcgactgacgtaccaagccacggtaaaaacatcttccccatttttataatagtagagatagagatgtataaaaaatataatacttatatgaactttttatatatacacaaacattatatggggagtggattctaatccctcgaggagatatcccctcgtatacctttttcttctaaattcgatgcaaatagttgtgaaaaattctgaaaaaaattgacaatgtagagtataatggtacctactagtccaccaaaattcatgttcaaatttgatctacacatcgagaaacaaaaaagacaaatttagatataaacagtacgctactattcatacgctgaatttgtcttttttatatctcaacgtgtgagttgagtttggacttaagattttgtggagttgtatatatgtgttgtatgaatgttgtcaaatttttccagaatttttcataaccgtttagatggtttttgagcaaacgagggaacatcccctcgagagattagaatagtttcccattatatgtatatatacaaagtccatatacgtctatatacaaaaactatgccgttccgtccgcactcttctccgcacttccacgtgcgtgttgtccggccctcttccgtctttcccacgcggcacgtggcgcgtcacacggtgggcgccacgcgcgcctaggtgcggattagggatttcgcaaggcagtgcgtgcatggctgcatgcactctctctcttaaaaaaacataatctctaagaacttttaaatgaaagatatattttttttctttgtaaataatatctctgtagaattggttgtttcaattgaacagaatcctcactatctaaactaacaaagcggcaattgctttgcatcaaacacgtgaataagtatctaaataaacactgcactgctgactactatcctcttaatcttctatatttagttgctatccttttgatcttctttagttgctgccactatcttgctcctctacatcatctaccggcttctccaaatcaacgccccaaatccgcacgaccacatttctcctagctccggttggcggagttgtcggcactagctctcctccatctccatcttcagccacctccgcttctgcctccaccgcggcgatggccgctggagcaggagcaggtgtaggtgtaggcggcgcggcgagttgtccgggcggtgcgagggagagggtaagatcaaggtccttcctgtagtgcttcctcttgtggccaccgagcgccactcctgtcgggtactctttgccgcatacgttgcacgggtgcttgccctttggcttgccggcgccgccactgccgctggcggtggccatcttgtccctgttgatgtggccagcgacatggccacctagcccctggtgcgactcgtactccatgatgcaaccctcgtacttgcacttgtacggtccacctgatcgtgatgctccgcgtgtgggtagccgagcctggggatgaacgggcgccgccacctgcggcggcagcgacatcggctccttctcgttctcggcgtgatggaccctcatgtgcccgtgcaccgccttcctgctgccgaactccttgttgcacaagtggcacgggaacgacgcctctcgtcgcgccgccacgggggcagcgtcgtcgtcgccggcgccgatcacgtcgccgccgtggtcgcggtcgctgatcgtcccctccgaaccggaagaggtagacggcgtgggcggcgaaggaagcagcgcgaggatgtcgtcgaggcggcggcgccgcttgcaggccgtcgccggcagcacgccctcctcgtcgtcattgtcgttgtcgctgtcgcggcgggattggaacacataccggcagccgtcgtcgtcctcggtcgcagaagccgaattcatctcgacctcttccagtggatcggcatggcggctgctggacttgccctccatgatcgctccgatgccccttgttcttgctccgatcgatctatctgatggagatcgggcagcacaagcaagtagggagtaagtaatcactagggcttaatttgcttgatcgatcgctaagcgagatttttcctagggttttgctgcagtggagagagagagagagagacagggaggaaggaggattgtgttgtgggtgacggcagcactgaagatatctagtagtagaccgtgaaatacacaggattgagtcggtatgatgcgtgggcgctaagtcgggtgatccacgtcaccgtttcgcaccacaacacagcaacgaaacggaactgcagtaacaagtaacaaccgagatttcgtacggatataggagtatatatcttcttttgtttctagaaacttttttataggatatttcttactcgtttttaggagagaaattaactagcatacgtatacgtacgtatacgggcgcgttctctgatcacgtccatcgatcaatctgcgcttgcttcaacatacatacagggaagatctttatttggatttcagaacaaattttaatttgggcctgatgaggttcagtaattataattagtgggaggtgctccttaacgtgatttctggtgtggataagaatactgtttcgactgttatttacttctgttttgctgtgggatttgacgatggccattgacaataacttcccaacttgtttgtgaattcatatgccagcctcaccactctctttgaggctcgtagctctcgacgatgctaaacgttcagggaggcacaggcaccgtggctcgtcaggaaacgatggttttggttggggtcgtcggagaagaaaactccgacccctactgctccaaattgctgggccctagccattttgcttttgggccttccggcccactagattcgatggcggcccactcgattcgacgggcgacactctgtggacttcagcagattcccctcacgatctgataaacctgcattgggactacctatacatttgtcgacaaatttttccccaaaaatttgacagatgtaattatagtacaatcgtagtgtaattacactgtaacttatatgtaattacactgtaacttgcatgtaactacagtgtaacttatatttaagtgtcacataattttgaatcgttagatctattacacgatttgtttaagtgaggaagaaaacaaatcatagcacacacatatgtgaaagaatttgttcccacgacctccattttaccgaaataacatgttacggagagatttttgaaagttacatacaagttacactatagttacagtgtaattacatacaagttacagtgtaattacactacaattgtactgtaattacatctgtcaaatttttggggaaaaatttgtcgacaaatgtatagcaaaatcgacctgcatttgctcgctagataggccccgtttggctggggctgtgccaaacggtctagattcaccaaataatggagcggagcggggtgaatcgctccaacaaattatactaccgagatggagcggcaaaaacgtcgctatagtttagtttattgctcagttaaagacggataattgagcaggaacgaatttaccaacggataattgagcaggaacgaatttatcattcatcaatccgttctcacagaatgtacgcacacggtatacatgtacaggtcaagcgaagcaagggattttgctacacaacacatcacatcagactatcagagctctcccagcctcttggcacagtccacgctgctgtccagcgtctcctccactccatacctgtacttgaaccctaaatccacaagcttgttggtgtcagcttgcactctcaccccctccccaatgaccctgcgaaagacgaacacaaaaccaatctcacaaattcacaacacaaatcagatcaaagccgggtcaatgaaagttgatctgatttcaaaaaaaaaaaaaaaaaagaatctcacaaattcagttactacatactgtattcaacaacaactaactaatcaagataaatacgtaatgaatactacctcatatatacattaaaggaaggaggtagcatatcaagagttggattggtgacacatactctttgagcctgatctcgatgtcggggaacttggcggcgaagtggtcgacgcagtccttcatattggggtacccggcggcgcagaggaatcgtccggcgatggacggctgatccatacagaagacgtgcgcgtcgcaggcgtcctcgacgtgcaccagcggcacggaccccagcagcgcctgcaggaacttgagggagttgtgggagggctcgtcgccggtgagcggcgccaggatcaccgggatgctgctgctccacgggcatggctggagcgtgtcgccgccgacgaccgcgcacgtcagggtgaccacctcgaacgccggcgacggcgaggagccgttgtagctcaggagctccttctcggagagcgtcttggatgacacatagccctgcattatgcaaaatccatcagaaaattagtgtcaccgtgagagtgatcgagttggttaattatgttgatcgatcgattacggacgttcaggtaatcgttggtgaagtcgcaggtgaggttgggaggagaccagcaggactcgttgatgaagtccttgtagccgccgccgctgccgtcctcccggagcggcgaggcggcggtgacggagcccgtgtggatgacgcgacgcaccgtcctcgatcgctcgcactggtccaggatgatgcgcatcgcgtccgtggtcgcttcggcggtgttcttgtactgcgagagatggaattaacaaattaagttactgatgatacatatgaaaattagcaacgacaagttatgggttaattatatggccttttgggttcaatagtatactccctttgtcccttgaaaaaccaacataggttgtgttcttacccccaagttttccaactcgtttccctcgttttctgcgcgcacgcttttcaaactattaaacggtgtgattttttaaaaaagtttctatataaaagttgcttataaaaatgatattggtccatttttttaaaaaattagctaatgctccctccatctacttttgatagtcatatttccaaatctgaaaattttatttttgataggcatatttcaatccaacaacctatcatcttaatgattttctcgaatttaatgcatgactctccatttttccacatatgattggctacatgggctttgagaaatgtaaatattaatgaatcgcttgtttacgatgaatgactagtagcatgtttaaatggatgataagtagaattacttatccttggtctgtgtgttaagatgaaatatgactatcaaaagtagatggagggagtacttaattagtcatgtgctaatggactgttccgttttccgtgcatactgttccaggttggaaacatgctccagcgaacacagccatagtggtgcaacaaagacatatatatatctctttatagattcgttatactcacgtcgttcaatactagattcgtttttccgaggacggatgcgagcataccttggtgctggtggggtcgtgctgcatcggggtagcgacgaggaagacgaactcgcagccggcgatggcgggctcgaaggtgtcggcgtcgtacatgtccgcctcgaacagcaccagccgctccgccgcgccggggaactctctcaacggcgccgtcttcttctcatctcctgtcaagatatattatcagttttatcaccatctccatgaattggaaacacgaagcagagagaaagagagggagagacattggcagagtattcgttgtactgcataccaagatttctcaaggttccatggacgacgcagcctcgttccaagagcttcttgacgaggtaggccgcgatgtagccgctggccccggtgacacacaccctgctcatctctctctctctctctctctctctctcttctgaaaccgatcgattcagtgagtgggacgaattgtgaatttgtgatctcagcagtagttgtcatcgcactgttcatatccatccattcctgccctgctgacctgtgtggctaactgagtgcacccaagactttcgttgtttgatttcctttcctgcacgcaagtgggtgtcatatgtggctctgaacgaaacgagtttcaggtccatatctcgcaggactgaccggcttgagctgaaaaatatatagctcccacgagatatatgcattaaagatcactacaataaaatcctttattcgtgatggatgataacctacataatgtatgcctcgtcggtgatcactagtaataagaaaaatatcaactgttacaagtgcggacctgtcagagatgactatatctcaaaacagtccaaaagttgtgatccgttgatgatgactataacccaacatttcctcacatctcggatcgatctgcgtttacgaatattcgagcaagaacgaatttgtcgttcattcgtttcttaccgaacacacacacggtatacccatgtgtataaggtcaagcaattcacgaatttttgctacacatcatcacatcagagttctcccaacctcttcgcgcattccacactgcaatccagcgtctcctccaccccatacttatacttgaaccctaaatctacaagcttcttggtgtcagcttgcaccctcaccccctccccaatgaccctgagagagacgaacatgaaagcaaccacacacaatttagtcatgattcatcaattaatcaagatgaattaatatgtaataatcaagattttttttggtcacacgtactctttgagcttgatctcgatctctgggtacttagcggcgaagcggtcgatgtagtccttcatgttggggtacccggcggcgcagaggaagcggccggcgatggacggctgatccatgcagaagacgtgcgcgtcgcagacgtcgtcgatgtgcaccagcggcacggagcccagcagcgcctgcagaaacttgaggacgttgtggcagagctcgtcgccggtgagcggcgacatgatcaccgggatggtgctccacaggtacggctggagcgtgtcgccgccgacgaccgcgcacgccaaggtgaccacctcgaacgccggcgatggagaggagttgtagctcaggagctccttctcggagagcgacttggatgacacataaccctgtacaaaatccatcagagaaaatgtcaagctctagtaccagttgatgcggagactgaaatagggattgggatcctctaacgtgaagtcagaggaacgtggtgactgagatatggaccccgccgctcacgggcccaccagtcagtgatcacgtaagagggtagttcacgtcggaggatcctcttccctgaaatagtttgttaattagttggtgattaatttaacattacgtccagatgagcattggtgaagtcgtaggtgaggttgagtggagaccagaaggactcgttgatgaagtccttgtagccgccgctgccgtcctcccggagcggcgaggcggcggtgacggaggccgtgtggatgacacggcgcactgtcctggatcgctcgcactgctgcaggatgacgcgcatcgcgtccacggccgcttccgtgttgttcttgtactgcatgcaaaaggcgacacctattattatctacgtcttttatatataacgtcgttgttttcttttaaaacgtttgatctttcgtcctatttaaaatttttataaatataaagaaaatttaaatcacgtgtaaagataaatttaagttatatttaaaaagttaacgataccctgtattaaaagatggattgagtatgttttgatgctatgatccggccggagcatgtg

SEQ ID NO: 60624 - DNA, 22170 bp, Oryza sativa
attgtcactaccgcagaaaacgttaaaggtgccggttgttaaaccacctttatgtcagttttcccaaccggcgttttcccaaccggcaccatggaagcggcacagatgacagagccggcaccgatcgcatttttaaaaccggcacctttgataggttcatgagccaaaaaaaaattagctcgatgcaccggcttgaatcgagccgatacattgagccgatctcatctaacatagaaatcccaaatcaatcccaatccccaatcaaacaacatcacagaataacaaacatgaaaaacatcactaaaaatctttcactaacattgaatctttcacaaaaatcattcacaaacaacgtaaaaaatggatcgatgcggcagcttcaatcttttactaacaacaaaaatcaggaaaaaccagaggaaagtgccaccaccgccggtcaccaccacctcttgccgccggtccgccgccgcaagtcccccctccagatccgacggagggacggcaccaccactgccggtcaccaccacctcttgccgccaggccgccaccgcatgcccccctccagatccgacggagggagggcgccgccgcctctcgtcccgccgccggatctggcggacgggagggcgtcgcgcccagcccgccgcccctcccacctctgccgggccacagccgcctccacgcctccggatctggcggaggcgaggactggcccaccgcctccacgccgtccaccgccaccgccgccgcacctcccgtccacgcccatcctgccgccgcagagagagagaggagaagaaggatggagagaagggaagtagagagagggagagaaaaagccgagaagacgcagctcgaccgctcgaccttatctccccgtgggtgtgggccccaccgtgggaaaatatctacccgctggctcgactcgatcctgtgggtgtcgattttttaaaaaaaaaccggcacctacaatatattataggtgccggttcttataataagaaccggcacctataattgcttaaaggtgccggttttttgcgatttcaacccgtgggaagtgggaaaaggcatataggtgccggttttagcacttccggcacctataatgccgacacctatttgatgttttgtagtagtgtgtggagtgtagggcggttgattgatttaaaaataatttgaataatttaaaccgtcttgagctctagccttgatcgatctccacagggggttgaaaatttgagatgtctaggaaaaggaatacctgcggtcttgcgaaaattatttctgtatagtagggagttgttcttgtttttggaaccacgttagagactacagagaatgaaatggttaacaaagtactttctcggatggtagatgggcttgcatacttgaagtaagtttggaacatatcttcatgtaattgaccaattgaccacacttgtgcaaataatattgtacgactaatcgcatgacttgtgatcaaattaggacacctctggtgaggagctttaattaattattttcaatgtattttgttttgtttggagagtgcatgcatatatcattgaggtgcctatgcgtatatatgcatagtagtgagtatatgtatgtatttagacatgcatatatacgtatttacacgtatatacaggggccgatttgctatgcgtctgggtcacacatgttcagattcacgtagaatttgatgggtggacagatggacggatggatggatggcaagtggtagggagtgtatagatttgtaggagaatgttccacaatggcatttaatcgccgtggcatcatcaatcagctgtcttaatgcatgcaggttgtggagtatagttggcacataaagccaaacttgaattgaattgcattggatctcctttcatttataattaaaccacacgccatcaatcgaaaacggccacagcattgatgtatgcctcagaaatgcacttcattggcctgtgcagatgctccagaaattcaattatttcgacacgctcgggatgttttgatttgatcgatatgattggcgtgcgaattttgtaacagtccaagattttttttaaaaaaaaaactgcccattttaagaaaacttgaaatatgaacaacaaaaacagaagaagctagcagttttttcgatttatgaacacaattatataggaaatagttctccataatcaagaaggtactagcaagcaggggatgcagggatttggattaatgaaataaattggagccgtttctctgacagtatgcaaaacaatactccattgttgagtggcaaaagcaagcaaaggatggcccatgcaagcttgcagctgcgatgatatatgatggatgcatgcacaaatgcacatataattgttttggctgcctgcaattctgtttggtggtcacccggcgaaaacacaggagactcccttgtcgtctaattgttgttcgcttcttcccctgacggatctttcctctcttttcccctcccgacgacgtcagaatctctctctctctctgctcctgcctcctctgctatggcctctgcctctgtctctctgcgactctgccctccctctacgtagttacgtacgtacatgcaatcacaatgcctgcctgcctcatactatcatatacatactatactacgtacactccatccgttctgatcaaatactacccccgttctaaaatataacaagctagtattgaatagaacatattctagcaatacggatctgaacatacatatccccattacagatttttagtactaagaaaagtctcatatggtattatattgctatattttacaatggatgtagtataaatattttttggattcaaattttgtatataatataagcatttgcataacactaatttaaatatggaggaatctgtgcatttttagccgatcaggttttaggcgggcaatccaagtaattgaaaaacacgactgatcaagtgagactgaaaaggaatttttttccttttatctttaaaatttttgctaaataatctagaaataattatattttagaacagagtgagaatggtgcaacggagctattgaagctagtgactctgcatggcttggtaccacacctactactacaccaacagtggcatactacatgtattcatggggctggagctagcctagggtatatgttaccactgcaactacagtttcttcaagagggtcaggcaggaaggcaggcagctgctaggagagctctgctggaatagagataggaagagagagagagagaggtgtatagtaggtggttgaatgggattaaattgggggggaagaagaagtaaatgccccaatagcaggggatgagaaagcattgcatggctgatgctactatatgcatgatcctcttaatagggcctgcagcggcttatttatgtgttacttaactatgccatgacttctccgtgtcttgtatcattcaatccctcctctcatcaataaatcaaagctagctagcttgctcttcagcttgtagaaaagagagatactctacaaactcctcctactctctggccatagaagggggacagagtgagctaatgagcaagtggcaaaactatcagacaactaagccatcaaaaacattataacttcttttcctacttctcaagttagaatagtatacatgcatgattgcgtacctttgaatcatttcaggtgaccaaatatgaaagaacaaaataaagaacatgagatatatgtatgtatgcatgtgacatctatatatgtatactgtacatgagtacacatatctgaatgtactaaccatttagtagtactttgctgtgtgtaggtgcaatatatctcatatctgtacaatgcatgcaatggtgatgagagccggccggccggccaagatcagctgatgatcaaagctatgaacattatgcatccatcagcatgcagccggcatcctgtgcgtttccgtcagtatgtgcatgcatgcatatattatttgcacatgcatttctgtgccacacagcttgtccgcatgcgtttgtttgcgtccgagatggcatgtatacgtactgacatattgcttatggctacctatctgccatgcattattcccctttaattttctttaattatatatgcagttaataattatatacacgcgcatatacaccattactccgcggtacacgccgacgatcgactgtgttccataaacgcatattcaaataggtacactagttgtttttttttcctaccattttgaatgagctttttctagacgtttaattaatttcctctgtaattacaattaattatttaaaatttggtcaatatataacaacacatgtatatatattctaatttcacaatatatacctcgaagaattaaccaacggcggtttgtcaattttattttgatttttttattgtctctctcttctaaataactccctccgtcaaaaaaaacaaacctcattatttgtctttttttttacggagggggtattaattattgtatcggcaagtgttccacatttaattaattagcaccaaaactagatataaccaatactcctatacgtatacgttatatatgtatactacactcaaataccaacatcaacattatttagtaaacccactactatttatcaccaggccaacctgtcatgcattgtctccctgctctccctaacttcttagtcaatgcaatacttttaccctatcataccgtacaaaaacactgtgtagtgtgtacgatgcatatatgcttgagattttgaaactgatcctcctacctagataaatcctaagtacctctcgtttgttttttaatgtatgacatcattaatttttttatcaacgtttgatcattcgtcttattctcaatttttgtgcaaatataaaaatatttaaatcatgcttatcagaacatttgatgataaattaagtcacaataaaataaataataattacataattttttaataagacgaatggtgaaacaacgtatctaaaaaatcaactgtgtcatagattaaaaaatggatggagtttatatagagagagtatcagaatatacgcgcacactactctgatcaatgcattcaaaattaaacaagggattgcatggacgcctcctttacctatttaagcccctttggtttgtttctctcttgtcgcttccttttgtcaagtttgtagttaatatatcacataaatacattaaggaatgagataattaagttcaggtgaattctaatctaggcaactttcaattagctgcaaattcaattctcattcagctctgggcaggatcctctccttaacatatcacgccattgtacacccaaattattgcactgattagcagcttcaatgcatatagtggtccaaaagaactaactgatatgagacatacacaacaagacacacagcaatttagacaagcactttacgtacacccacttgtttacaagagacatacacatgaagacatataagtgaagctggataaacactttataaccacacatggcatgcttaatgactacaagagacacacacaaagagacacacatgtggaaaggagataggcttacactttgtccatttattcttccctttttcatggatctgtgttttacttcttggactcatcttgttagccaatagcagtttattgcattagccagcagctttatccatgggcaaatagaatgttagaaagaaaggcgataatataggcgtcgttttacatatttatgcaagctaacgacttgactcttagcagccttttgtggcagggcaatagaatgttcatgatcacatgcgatcgatcaagtacactgacacttacaagctagaccaattccactttaattaattcatgaccttaaaaataattttaaattaagaactaaacttaccgtacactatatagctggaatattagcagccataatgttacaagaagtgtacgtggacgatttggagggcatgaatccaagtattccttgcagcggccggcgtgccctgcagtttaattattcccatttattgtgacagtagtgatatttaatttataagtacctctcctccatcttttaaatttatttcatgtataccggcactatattaattgattatatttgaaactaattttctagtagttccaaagtaagccacagaactgaaatatgtgaacttagtttttttctttaatcatcgcaatcacacgcgccttatgttgcatgatggttcaagaacctaatacgtaccctctctgcagattgcttgttctctaatggtacgcttgatctgatgttactacggagatatatcagctacaattatctggatcatatattatacaagatatttttactaaaaaaagttttttcacgcaatgggcatctgtgtataatttttttttaaaaaaaaacatgcatcagggagtatacagtgttatggtacattcttctcccttcctttttctctttatttacttcagagttcagatttttcatcaaccatgcgtgcaagctctggccgtacgtgcccttcaatttggatttaatttatagctagcagaaacttcaatctgcctatacaaatacagtatagtactaacttagcagatcctagttcttctaatcatgtgctgcatgcttgctagctgcagtctacacaagactatatttcagatcgaaagttccatacttatatatattcatctaaacatactttttttaaggaagttaaatgcattctatacggtggtatgtctagctagccagctactaagtgaaacagtactatatggaagcttagatatagatatgggtcatatacatataaaaaaaaataaactgtgcacacatgagtgaccacgctaaataatctagattcacataaatagcattctgatcttgcatgatccctctcctacgatcgattacacccctaaaaagcttcaaacttttgcctgctgcaggccgtgtcttcttccagatgcagccttccagtacatacagtacatgctacgtacacactcagattaactgcatctgcatcgtatctaataaggggtgtcactagctagcatgcaaatgtagatacaatacttgaacataaatgccatggcaatatgtgctgcagctagctactatagcaatatatgatttgaatttgggtgtggctctatacttatttctctgcaaaaagctggggtatccatatatgtgtgtgtgcatgcaggccgttgggtacacgtatatatactgctatactgtgggtgcagtgtaactactacatgccgtccttcatctgttttcaaacaggagtaattttattttttttccaaacaaaaattttcaaataggactagctagatgattgtttacattgtatgaagtcattttcaaaatcttaaatcactagcttatacaaaattaaactatcaagatatatttcagatgcgacaaatgatatttatattataaataatattttattcatttatttatattattaaaatagactacctccgttcacaaatatcatggatccaggctatatatgcaccgggacatattctggatgaaggtagtgttattaaacatatatactaaaataacacgatagaagttgagttgatatccgaaacaacgtgcagtaataatagaaggggattgctaggcttatgctcactggaattcctcacaattttacttacgcaatattcaacctcaatcttgactgatatatgcaggaagagaggagaggaaggaagacggcgactcaccggacatggtgacagcgatacccaaccctaataaagaatctatgcattaagatcttgagaggttggaggggaggggaggtatagaggagcggtgaggacggctttagagggataccgtggtggcgcaaaaagtgacagtggcatcggagccggccactaggatggatggtggggcagagtcaacagtggggggggggggaatatactgtgtggttaggtagcaatgcagatccggcagcacgagccaccagacatgaaggaggtggtactgggcctcgccggtgcaacgattgcaaagtagagggatatgcacagggagagtgagacatagtcgatcggggatctagctagctagcagcggtggaatggaccaggaagggcgagggcgaagggagaggattagtttttgcccgaatcactacgccaaatcggcccatctgtgacggcctattagtgacagaccaaagtgcctcgtcagagataacctcatctgtgacgggttacaataaatcacgtcatagatagggctcaagaaaataacccgtcacaggtaagtactcatctgtgacggatctatataaggaactcgacacacaacatctttaacgtgtctacatatagatccgtcactgatgacctcttacctgtgacgggttttaagtttgtaacccgtcacaggtgagatacctcacctcaaacgtgttggatttttttacccgtcactgatgacttaaaaaaaagaaacccctaccacccacccagggggcccaccacccacccaccttccggccttatctcctcttctctcttccttctccccaccactctctcctcttcctcaactctctccctcacttcctcccgacctcccgcctccacctctctcttattcctcctgacctcccacgtcccgccgccagccgccttcacctcccgaccgccgcctgcctccacctcccacgcctcgccggcccctcggccatcggacgccggatccggccgccaacgcctcccccatcgactgccagactcctcccctgcctcccccaccggatccagcctccacgaggtcggggaatgtggatccgtgtcccgcccgcctcccggccgccagcgcctcccacaccgactgccagactcctcccccgcctcccctaccggatccggcctccacgagatcaagggacgtggatccgcgtcccagccaccagacgcggccgcctcttgaccgtcggacgccggatctggcctccgggaagccggatccggccgccagtgcctctcccaccggatctcgcctccacaaggttgggggacgtggatccgcgtcccagccgccggacgcgggcgcctcccgaccatcggacgccggctctgcttccccttcactccggcggccggatgcgcctcccaccagagggcgctgccgcctccacctcccgatcatccctcgccatggccgccatcctctcgttttgcattgatattatattgttgtatgtggattgagaaattcttgccatcccctttctttgaatgtgtgctatatgacatctatgaatgtgtgctatatgagatctatcggtttgaatttcttgtgtgagcaaagcaattgtgtcaacgagcaccaccatggcagcgtgcgccattttttttgttgctaggtctttcacaccagtgacgggttgcacgctatgtctttcaatttttttttgttgggttaaagacatcactgacgggtcacaaactaataggtcgtttgagataatagtcacctgtgacgggttttatatatggtccgtcacaggtgttggtcaccactaacggaccttcacccatcaaaggtgaggacagtcatcagtgaccacttatctctgaccagggctaaatccgtcagaggtgacagtttgagcccgtcacaggtagccttgtccggtgtagtgaatcttgatgcgatctgagccatccaaaagtaactaaaatttgtggttatttatttaactaggaaggtagcccgtgcacatgcacgggcaccttgtttaatgctgatttagtttttcgaatgtttaatttttttagatatactgattttattagtcttgctaaaatgtttaaatgtttctatttagaattaataatttttggttcaattttcatttcctttcatctcttttttttgggagaattccattctatgaaacatccttgaaatgctttgatccctgtaattcgggatgaaaatatgtgggttgatcctataacccggcatggggtaaaggtatccattctaaattatctctctccaattaagtaagaaaattttaaataaaggtcatagtttttttagcaaattaccactaaactggagtgtcatataaaaatacacgcttctagaatgttctatgctaaatgtcaggaattcatgatgtaccgtatcaagtttaaatggacatttttcttattcctatatggaattagcttatatattgctaaggcgacgtcatggttatttcaatgttaagattccttagtgcaaccaacgtgctctgtacgatcaatatgatattcaactggttacgcgacttcatatatcacatatataatttagatgctatgatcatcttaagattatttatttatctcttaaaaagatcatttattgataaaagatcaatataggaatgtatgggtaaatagctcttatatacatgctgagggaaaaatataattaagtagatagaaagtcattagatgtctaatggaatataagtaatgggtctaccagttttatgaaaaattaaggtgggatattttgatttttagtgagaaattttagaattttcttttatttagtggaggcctcaatatggatgtgggtctagaatgtaaatttttgttagcaaaatatagtccatatgggtattaaattattgatttcacataaataatatggtaattcaaacagatcataaggggcatagggatagctggctggacctaatatatggaggttaaattgtggtcttttctttgcccataaagataattttaattttaattgttatagagatggaataaatagagaaaagtaatgccgcaggaatagggatggagggagggttgggatgtttcttttctttaaaaaaatatttatttaatgatatgaaataatgtgttgatgtttaagtcaaaaccgatggccggatgttttttttttctcagatttattaggactttctgtaatttaagcgagattagtagcagcttactaaagcatttacgtactttaatgtcctaattgtttgggattttttttaaaaaaaatctaataacaacgtaaaataatgtgtccatcgatttaagtgaaaacgaatagttgaatgtttctataatttaaaagtgccacacaactgttagagagatttatagtatgtttagtggacatatgatgtatttttgtgggtcttttttttttccataaagataattttaattttaattgtgattacgatgaaaaaaaaagaaagcaatacttgtgtgctgcacggaggcgcggcgttgagaggttttggtttttaagatacatctaacattctaaaataatcggtccactgatttaaataaaaataaaaatggatggtcagttttctctattttattaaaataccatgtggtggcttgggagtatttttagggtgtcacatgacggcttaggagcgtttataaaaagtttaataaacttttaatatgttatagatagatatgaagataaaattagggtgcgtaaaaaacaattaggatatgattatttgattttaattattacaaacttgacaaatgaatctatttgactttttaaaacaattggcaccttatataaattgtcaaaatttttgtggcgttaggatttgaaatattttgaatttgtccattgatgaaagaatatgaattttaattgtaaattcaaattttatctttgagctacgtaggatatataatttattgacagcgtcctgtatataggagatataatttgctagtcccgtaggagtaactaatctggcttgcctttgcttagagatagatttggtatcttatatggaagaagcatcaaactaatctacataagatggatgcatcgtgcgggaatgcacatgtgggccctcgctttctatacacacagatacacgatacattgagtggggctgcaaatgtgggtccctatatatatcttgttgtgccatgtggcagcttgagatcgttttgaggatgtcacatgtcagcttgagagtgtttataggaaatttaatggacttttagtatataatagatagatagaagatagatagatagatttgttggaactgaaaaaactagacaaaaaaaattgcagaaaggaaataatgtgaggcaatcaataattaagtaatcatgcgtataccgtggtatgcgggcggccagtacagtactactgcatgcatggcacgtacatgtccattaactaatatcgctatcacgtactagctatacgtacgtaatacgtacactacgcagcataagaggatggcagagagaggacagcgatagcatacatatgcatgcaaatcgaccggccggccatcagatctgatgagaccggctgatgagagcagaaagtttaaattgcattggtcggaaaatgtattattgcatatgcatgcatgcatggaccgttaaaattaaagtttggtagatttgtagtactaagtttctaaaaaaaaagatagatatatgtactactactaccttaattataatgtgagacgacgacgctatagcttaatgcatgaggtgtgactataggagtagttgtgatcagtgtaagttaaggctgtcgatttgcaggcagcaggccggccaggggcgcccctgttttgttggtaagttaattaagccgctccctgtgccttttggatacatgtagtaatacgtcatagtgtaatttgtacctgatctgatgcatcgatcagtaacaaagttaacatgctgcatacatgcaggacatatgaaaagtgagaaaaatataccgagcctacttgtagaaaaaaataatttatacaagcggctaatgaaattcattttcaaattaagacaggtgtaggtcgcttggtggaaatggagcaatttccacatatattgccgaacctgttgctgtatctctcaaagaaaatagtcgtagtagttaattcagagcatgcacaagctagcctggtcgatcagtgtgtgaatgaactctgaacttgaatatattaattaattatcccctccacgtacgcgtatgtatacatacgctgtacggtggtggtgtagactatacgcgtacgtatacttgagaatacacaatggactagtactactctagcagcgcagctagctagagcgaggtcaactggcggatcaatgtgttccacatgtaacgagacgacgatacgatgcgaaaggtatgtaggaaatccgtactcctagctatacccctaggtgtctgcatgctagaacgaagtcgatcagtacgcgataacgaacatgcgaaagataacctctgttttaaaatataacaaccgaaaataatgtacgacatgtaataatagttcaaacaaatctggatatatgaaatgtctcattttatttctaggttgttactccctccgtttcacaatataagtcattctaatatttttcacatttatattaactagaaaggtagcccgcgtattcgcgcgggcatgtatcataggttgtgttcaaacactataacgacgtaatataaattggagaacatttccataatatatttaccataaaatagacgatagattttaatatactactaatgtgataagaatgtccctcgaatttaaataaaaattcctttgtcctggtcatatataaactggttgtttctcatcattacttactatcattgttttaagagttaggtgcacttttaataaatgaaactatattagtaccactaaaataaatgatacattattgttacattataaaaattcatcacttattttcacatctatgtataaatagtctaaatataacatatctaccgaataatacgataacatctttaaaaataaacatgaatacctctctaacggatgaagtcaaatgtatctgccaaccaaggctttcatatgtaatgccttgaaacatataggttccgcatcgatgtagccatgccctaaaaaaacatcatagagtactattttaacacttagtttactattggtacactcacaaatgattatattgataagtctatcactttagttacattgtctatggtgaccttaactcaacaatgtgcatgcccatacaatatttacgatagcatagcaagtactgcactttgcattaaaggacaaaaagggacagaaagaagaaggaggtgattgaaacaatttttttttaaagtttcgagtcgatttgtggtagagaatagacaatgtgtatatgaagttagtaataagtgcttctcaaattttaatgcaatacaaacagtattatgtttttcaaatgagtggggttaatcattcggcactacttagaaaaaaaagctatagctaaagagacgtaccaccatgaaaatctacaaaacaccatatcattatttatattttgataaagattcatcctttagtgctagattttttttaacatatattgtttataactaaatgagactcatttactaattgtaataatgtacttattttcacaaacttatttacactatctaattcgctagagtgcacttattgctgagtttcagtggtgtatgacattcatccatcaattatacccgctatattagaatttctatcaattaaaaaatataatataagtagttttatgcatgttttattggattattcattttttccaatactatttggcaaagaacatacataattctcgtgatgaattacgggttgtattgtagcaaaataactgtctaaaatcttatttatttattttttcatatctatccatcttgtatgcttctcactcctcaaatagcaatcaaaaaggtttgaaaaactttcagatacttttagaatctcaatctcacccaaaataaacctaaaaaggtctacttaaaaaccaaagctaaattatattttttttattatcactggctaaaatttaatttaatttttctcatctatctattatttgtgcttctcacacctcaagtaagaaaatttttgaaaacttccaaatactttgagaatctcaatctctcctaaaattaaataaacctaaacagatgtacttaaaaaacaatgataggttttgtttttttaatttttacacatgtagattaaaattaacgttgtatatttttgtcaagtgatatttgacactgtaaaatatgatatgaaattatttgaaacattattatcgtattaactattacatgttagcgtcatttttcatgatatatttatcactataataagtttatattaagtttaattgtgcatatatgtgtagtattatttttaataaaatcgtagattaaaggctgttgacaacaaatcagtgccgacactgatgatttttccttattagtatatatttccgattttactatgtacctatgcatgttttcttgttcttttttggctttattttttttttatagtatatgatgtaggtatttaagttttgttttttttccgggagggagacgatcgtatgacgtaagcgcattatgttttttccgggatagagattagcatcatggtatttttaagagctctaatccattgtttaaaataacgggtccactaatttgagtgaaaactgaaggttggatgcttttctttttttattctgaatttctaggatttctgtaattttattaaagcgccacgtgacaatgtagaagcatttgcagtacgtttaatagacttttaagtatataatagatttctaggatttctctaatttatttgagagccacgtagcagagtaaaagagtttgtacaaagtttaatgtaattttagtatataatagatagatttagaagatggtttaaagaacattgattggatatttattatagatcttaatttaactaaatatatttatacatgtgaagtaatatattttatctttatattgtagaaaatcatattttaaaaacggttgatttttatggatgtatgttgtttgtgacttttttatgtacaagtgtatggtttttttttcttccagcgaaggttaagaaagcttgatcattttattttcaatcatgtacgtttgtatgttacggaaagaacatcagtaacgtttgtatcgtacaatctcatacatacggacagtagcagctagcgtttgtatgttataaacatgtggaagttattatttttttaataatagatctaatctaatggtgtaaaataacgggtccaccaatttaagtgaaaatcaacggtaagattagatagtgccatgtggcgacttaggagtgtttgtaggagtgccacgtggcggctttaaagcgtttgtatgaagtttaatggacttttagtacataataatagatgttaatgaatttggatagatatatatgtctagattcattaacataaatatgaatgtgggaaatactagaatgacttacattgtgaaatggaggaagtatatatattattggacagagggagtatattttagaacggattgcattcatacgcacatatatatacttcctccgtccaaaaaaaaagtaactcaacctaagaatggagattcattgtattaccaaggatcacatctacttctaaattgagttctctttttactactcgatcgatgctccttgttgtgggggattcctatttcgcgcgcgctggctacggaagtagcgcgctgccacgcccccctcaacaccttgcgctgttagcaccgtaattagcggtaatgatgatagttagtgctaattatggtaattagcaatattttcctttttttggaaggtttttttactaatagattgatacgaaatctatacgtgaagtcaaattttgaaaaatttcaactcgaaatttgaaactttcaacccaagtttgaaaactttcgattcggattgaaaaactttcaagtcaagatttgaattttcaaatctttatttaaaagttttcaaattaaaatttaaaaactttgaactcaaaaaattgaaaacacatgctttgaagatttaaaaaatagtcagaaaaaacgcgaaaagaaaacgctagaaataggagaaaatcgaaaaagaaaaaataaaatcgcaaaaagaaaaaaaaagaaagaaaaagcttggcgcgcgcgctgtgctggatcgatcgtaccacgcctgcatgcacagagaggagggagagggagagagagagaggcgtgcagtgcagctaagctagcaaattcctcgtgttttgtgatagatagtactccctccgttcttaaaaaaagataaaccctgggtttacgtgtctaactttgactgtttgtcttatataaaatttttttataattcgtattttcattgttgttagatgataaaacataattaatattttatgcgtgacttgtctttttaatttttttataattttttcaaataagacggacggtcaaacgttggacggggaaactaggatttgtctttttttttttgatggagggagtatgctggagtagatgctggtgctgctgctgttggtatttcgggatgaacgacgacgtacgcgcggtcgccggcccggccggccagcctccagccggcgtacgcacggcgtagcatgcaggtaggtagctgcagtgccatgcattgtgcgcgcgcggccatgtggtgggtgtacgatacgaccgacgtcggcggggcaggcggggggtgtggagccctcgatcggcgtgacgacttgacgctacatgtgttggaaggatccatcaactgccaaaccaacatctcagttatttgctccccgtgtctcagaatacagtaaggcagaattagattagacaccatctaataatattatgaatttcagtaacgctatatctagattcgtaataattaatgtactagatgatatctaatttgatcctatgtttattatattttaaaacggaaagagagaaggagtagctagctagctagggttaattacctgatgtaataaggttatcaccagtgatagaaaattaaggaaatgcatggagtggaaactgactgaaaggtttaatacaaatgaatctcgctagagacgctagtgttagacattactgtaataccctgtatattaaaagatatttagtatttttaagtttgggttgacttgttaaaataaagatgttaacagaaataaataaaagaaaaaatatctttagaagtgggccaacatgagaaggcccataaacccagcccattagttctcccctaaaacctagatagaggggaaccgaatcccacttcccctcatagtgccgccacccctctccctggccggcgcctccttcctcccctcctcctgtgttcgcatctctcccatctacagcaaattgctctccctagatctccaccttcatagcttggatcaagaagcgaagtagaaaaacggaacgaggaggaggagaggagtagaaggaggggttagaccggagtctcccctattgtctcctcacaagttctctaaaaaaaccgtaggtgaggcttatccccttgttgtattagttattctagtatggctttagtgcattaattcgtggttagtgaaggctagagaaggagtttgggtagttgcggttcggtttgttgcagttctgcatgtgggcagatttgcagtgcttcagtttttcgatatttcggggctctaaatgttattttctgcaaaagtgtataactaggaagttgtagataatgtttggatatatcttctgactaaagggcacgattttatcttaagtggtttaggagatataatttttttagtatgattgttgtttttttgtcataatctggatagtagtagactgaactgtttttgaatgggttaaacagtataatcagccaggccgcctatagaaaacattgtagaggtttttcttagcttaccttattggtaaagtacaccctgattgggcgagtagaactccagttaaggttgttttagtgtagacagtctgaaattctggacagattctaaagcctgcattcaagcgcaaattagaccatttaaatggcagaataaaaatatgttttctacatgaaagttgtaggtatttttttgtagattttcaaaatgtatacattttcagtcatagccttttcatatttcaagatataaaggtttgaagcaacagtcttgtgtatagtccaagcgacgttccttgttattgagttttgataggatggggcagtaggtttacctttttcattgttttatacgcatgtttgaatgtgtttgctaatgttttgtttgtgattaggtggtggtccatcagatcgtacatgataccaatccttcgttggaggtaagtgcatgacgaactaattgtgtgattcatcgattgtttactctatctatttatttctgatatatttcaacgtgataagtaactgcttatgttcatattattgttcacgccatttagatttcaagttgatcttttgtgtacgatgttattcttgttttaatattctggattctggttctgcttaaataagtcaagttctctgcttgccatggatgtgtttcaatttggttctttaattctggtttcaattattcaagtaccatgcgtagtcataggagtgcaatttggttctttattcaagttcctgtgggtaagcactgatcacgcttacttggctttgccggcaaatgctaggatgtattcactattgtccgggatggaaactactatttcaattcatacctgcccgggatgggaactactatcttctttgatttggtgtttgaaaatgcgtttcctatcaaagaaagaaagccttctgttcatgctttattgccaatgttgtgtatatgtgttttctagttccatattgtacttgctgagtatttttatactcactcttgtattttatttggttttaggtacgcattgagaccgacatgcacgagcgggaagtagcacccttatatacacattacttgcacactatcaaactatattgcttaggtccataatgacacttaaattatatcctggtttggtcttgtaataatcttttagatttctaatagtttcttccccatggattataaggatggatcgtattgtgggaatgatattgttattagtttaacttataattgcctgtcgtggatgtccgtatttatatgggagactctgccaaaatttctaatatttttgggagttagtggttttgagtgtattttagtgtggcactccaggtacgtggctacctggggcattacaattactccctccgattatgcaaaagttattgatattttggtctggaaagaagataggccatgtttggataatgggtttgggatatgatttcccacccctcaaagggtaaatttcaatcctagccatccattcttctcattccatttcatcctatccctccattcatttccatttcccagtcccacctctcctaacccattatacaaacaaacccgtaatgttatattcgttgcaaaacaaaaactaatgcgatggctccctctgatcgagttggcacagtggatagatgtcaatgtatccacaagcaaacagttgagacatctagggcccatcaatcgattgaagctgcagctatactatagctagctagcatgcatgcatgcatggccatggatcgatgatcatcatccatcaagcatgatatctcaaacacacctcgagccgtcttttccctccacatttattgtacttgcgtcccccaaacatggccactgtgctacacatggacaacggtctactctctctctctctctagattcctcattttcgcaaacattcccctctcttcctccctcctctgcgatcccaacctacccatatttagacaccacaagagaagaagaaagaaagaattgaagctgtgtctagctaggttagcttagcttaggttgtttgcggagatcaatcgatggcggacggcggcggcggcggcctgtgcgagctcttctccgacgaccaccgcgacatccgccacgtcgcggacgccgacctgttccgcatcctcgagacgtgggaggagtgcatcaatggcggcgccggcggcggaggcggtggggtttctttagctggtgtggctgatcagggagccgctgcggccagcaccggcgccggcggtggtgcaaggacgacgacgacgacgaccgccgcgaacggtcggcggcgggagggccgcgacgaggagaaaggcggcggcggtggcggtggtcctccggcacagaagaagcaaaaggggtcgtcgtcgtcgtcgtcgtctccgccggcgttggcggcggcggtgggggacggcgatggtgcggcgaagatgtcgcacatcacggtggagcgcaaccggaggaagcagatgaacgagcacctcgccgtcctgcgctcgctcatgccatgcttctacgtcaagagggtaattaatccattcattctaattactagcttagcttagctcgcactaagcatagtttagtgtcactgtgtgtgttgcactactagctaatgaagctagaatggctcatgggattttgatactatgtatctatagctgtagcatctagagtaacttttttttccctgatcgtgtacgtgctgctgcaacagttgcatgattgtgtcccatgtacatggtacaggaccagcaatcaaccgttgatgctgctggtgctgcatgcttgaactgccctagcttagctagctaccaccagcctaccaataattagtagtacaactactcttgcatcattagagaatctatctagtacacacagctaccaatccatacgagagagagagagagatgaagacacagtggcttgcatcaattatctcagagaatgtatagtacagtgaatcattggttgaacaaattaatggagattaatcacttgaatagatcagtgcaattaatttaaatctgatttgtgtgtattattaattgtgggtgcagggagatcaggcgtcaatcataggaggggtggtggattacatcaaggagcttcagcaagtgcttcgctcgctggaggccaagaagaatcggaaggcctatgccgaccaggtgctcagcccgcggacgtcgcc

SEQ ID NO: 60625 - DNA, 1068 bp, Oryza sativa
catcggtgacgggctccaaagaaggcccgattgagatggcctgaatgcccgtcaccgatgactcttatcggtgtcgggcttctatttttgctcgttagagattagtgtgcgctcgttagagatgacttttttttggcccgattgagatatactttgcacactatatatactccagcagtccgttgtctgtagttatcccactgttcactattttggtgggaggttgaagggggcgaatttatgtaatttttttgcaaacaaaaataggaaaatcataaaagtaagtaaaagggtactactaatttcctattaatttagtagtacttatgttatgagatgttaactaatattttgttcattgttcagcgatggatcgaagttagatgtacacgactggcttgaggcgtcagtacaaagagtatagagatggcgtattaagttttatgaaagccgcagtggaggataggataagaagaaacgataagtacatgtgttgtccatgtagcgattgcaggaatgagatttggttggacgatgaaaaggaagtacacacacacttgatacgccggggattcatgaagagatacacatgctgggtgaagcatggagagcaagatctgggtactgatggtgtagctgcggacggaagtggtgcagacaatcatgaagaaggagatgaagaagagcatgacatgtttgtcccatctccattgggcggtgaaatggttgatgtggaccctgatatgctgcaagacatgttacgtgacgttgatgacgtagctatgaacgagacagattcaatgaagttcagcaggttggtcagtgactcggagactcctctatacgcaggatgcaagccaaagcacaccaaattatcagcaacattagacctaatgaagttgaaggctagtagtggatggtcagacaagagtttcacagaacttttgggaatactgaaggacatgcttcctcaggagaacacattgcccgagacgacatatgaagcaaaacagggtttgtgtcccctagggttagagggtcggagaattcacgggtgtccaaacgatt

SEQ ID NO: 60626 - DNA, 4032 bp, Oryza sativa
gccccactcgtgctccgcttggaccaccgccgccgcggcctcacgctgtcgtcctcaagatgctgccggccggcgcaacgacggcccgcctctccacgatggacgccggtgcccacctctcccccatcccctccacctcgccgcgcgccgccgttcgcgccgagcgctggcctgcccccgcgcgccgctgcccatcgcatcccctcgccggcgctcgcctctccgccatggcgtgccggcgtgcacggtgctgcctgctgctggccgatgaagagagagaaagagagatggaggaagagagaaagagtgtatgacatgtgggtcccactatttttaaaaaataaaatgctcactagactgccacgtcagcaagtctatcccaaaaccacctaaaacagtgctcaggggggtaatttccccggtttcaatagttgagggtgtagaatgtctggtttttgagttcgggggtgtaattcggtcaacctcgatagttcaggggtgtaattcgtacttttttctttttataataggttgaaatcgaacacagctgacaacggatgaaaaattctaatgataatatacatttttcatgcataatcatgtcaatgataatgtttgtattttaacgagcgacttgtttttctataaacaattttttttcttgcgcgattttctcaaaccatttttaaaaaatggcgcatttctttctaacagttttttcctagcatgttctttttgtttttttactgacgacgaaaaccatgtttttctcccttttttgcttttcttttcacatgtgtttttttgcatgttttttctgacaattattttctcgtgcgttttttgcttctttttttcgaatgttcttttttgtttttttccaatacatgagaatatacgacgaaataaaaaccgtgtaatagatgacaaaaaaatcgatggatcctatccggctcaagcgtccatcaatttagcgtttattcgacggatttttcagagcgatttgtttttcaatagatgatgtttttttcttgcacggtttttttaaaccatttttttagaaatggagcgtttttccctcgcgcggtttttcttttaaaaaaaatcgatggatcctatccggctcaagcgtccatcaatttagcgtttttttctgacagatttttcagagcgatttgttttttaatagacgatgttttttcttgcacggttttttcaaaccattttttagaaatggcgtgttttttctgacagttttttcctcgcgtttttttatttttttatggaagatggaaaacctttttagcgtgtttttttgcgcttttttctaacttttctcatacgtttctttgaaccgtttttattgtcgtgcattttctctttttaaatagttagattagattagacatagcgaagagatatatactgattagaaatcggaatttggttcgcccttttcatttctttctcgcgcgcattatttattttatacgaaccagctttttattttttacgaaccattttttcttcttagagaattggacgaacttttttagatgttttttgggattttttttcatctttatagcaatcagaccattttttcctttttaaaggaatcagatctagcatttttttcaccactttttttttttgccttttataggaaacggatctacggttttttttgccacttaggagaaacggacttttgttgttgttgttgtttttctttctttttctttattttcttttattgtgcggtttttctttttctttttatgcacctttctgcctttattcttccccttttattattttttaataaaaaacgaccttaatatcttatttcaaacttatagggattgaaatgtaaatataaaaattacatggactcaaatgcaaaagtatagatccaaaaattaaaatcatataaaaatagaatgctctcgaccggtaggtttcgtttttgcaaacagatcttcaatctggcataacaattttatttttcgtttttaaggttgatttgatctagagtcggacttttttttccctttcttatagcaaatcggtaggagtcggacttttttttaaattttttttcgctatattttttgacggacagggaattggtagagtcggactttttttttaatttttggatcggactcttttttcgtccggttttttcccttggttttttttcgccagttttttttcgctcctttttttttggatcagacgtttttttttctccaggttttttttggatcggactctttttttcgtccggttttttaactcggtttttttcgcctggtttttttgacggacgatggaagcacctcttatttctcttattttgtagtagagaattgcactttgagacacctttttaaccagtcttgcatcttggactggggataaactaagcttttcaccttggaccaggtatttttcccaaaatgtttcaatttaggcttcttcttcctctagctccccctctctttctcttctctctactaacggtaatcacatgagaatcccgacctccccacccctgcaactatgggcatcagaagtagaagtcatgcttgagcacgttgccggcactgtacacgcttgagctctatctgcattgctgccgatatcgtgatggggatgttggaccagcttagcacgagcaagggctggtgaagatggaggtaaagccggatagctcgtccaatgatcttgattttggcacatgtctcagcgcgcctgatctcggtctggtggaaaatttgcggaaataattcgaatggaaataggagaggaatcaagcgaaggtaacatcaagggggagacaacaaaagaataattttattggccccttgctctctgctgcctttatcatcaccaagagccactaccttgccttacttcgcttcctctaattgaccactgagtggtgagtagatgagtgtgcctcactcaccaagacctgctgctgctaagtgccattgccaacatgaagcctgccacagatggaggagtttggtgattggagtttgggagaggacagggtgaaggagatgaagagagagggtggtctagactgcaacaaaaaggaaatattaactagcccaaactgaaaacataggtaaaggggtagttcaaagtgaaagcttggtaataaaaggtggtccaatatgcaatttactctaatttttataatagacataaagatatataaacatatcaataaatatatgattttgttgaagtattttttttagattaatctatacatatgagctctgtatttttaagataaatattttagaaattatttataatgaaagatttcaaagtttaacattaagcttatccagaacgataagggttattgtaaaatcaaaggtgttttttactattattctgtgatgaacaattgggcattggagattattggttttgttatttggaatttattcacgaagtggttttggagatgattggatttacaggtaaatttacaggatactgctgtgattttatgtggaccggtcagactgggctctggtagccggtcagaccggcgtgtaatgcgcggtcagaccggtgcagcccgcggtctgaccggccgacactgtgtcggtttcggtttcgggttgtttatttggatatccgagtttattccatgattatgacttctagatggatactatacgtatgtaatactattgtttgctgctaatgagtcaagttggagatagcttggtttcggaatatggtttctttgtttgttccatgtgtaggtgactcgatgtctcgggagagtatttgcggtgatggaccgggagtcggcttggggataagacgacgtccgtggtggtcagagatcatgcgggatacttaggctagagttgatgcacgtggttgatggagattccatatggcatacgatggaggaattgtgtgcgtatgggatgcggagtcgaatttggaaggagtccaaatttggtacgtttggttatgtaaagtttcttt

SEQ ID NO: 60627 - DNA, 12325 bp, Oryza sativa
aagccatctgcctcatccccgttgtcctcatcgttgatggctgcattatcactgtcgtgtctttgtcattgttgcccgcgctcgccctccccggtctaattaagctcggaaactgtgacttttttagtgattgtgagtgtgacttagcaaattgtttttggttgattttgattcctaaatatgtttgaatggtgaatctttctcttaatgattgtgatttagtgaacttttgatggatatagtgatgtgaatccgctctgcagtgcttgctcagctcggtttgattccagtcgagccgagcgtttttttttttggactcgttcgcccctaaaggtgctagttcttggctaaaactggcaagtatatattattatatatatcgattctacaggcagcaccgatgaccgaagtgatcagtgccgcctgctgggtaccggttggaaaatttgacacctatgactggttcccaatcggcacaaaagacttttttgcactagtgttttgattctttagttttattcaaataaataattaggatttgtgcatctgcagaggtcggaaatgtaagtttttccattatctgaaaaaaccttctctctctctgcacacgctatgcgcgttttaattttacattctaaattgcattttttttctttgttgaattattagaacgtgggaatactcatcagcatggttgatcaatgacatactagtatattttttcattaagtaacataaacctgttgcaggtaagtggtataataataagtacttcctccgtttcacaatgtaagtccttctagcattttccatattcatattaatgttaatgaatctagatgaatatatatgaatgtggaaaatgatagaatgacttacattatgaaacggagggagtaaatatgaggtagaaaatgacttgtagccagaagatttgactgcacgtgctttacacaattacacattatatagattctataatgctagaaattaatatcaaagatgataagagaagaaaggagaaatgagagaatatatatatatatatcaatgatcacaaagctaaaaataatatagaggcggtgtgcaaaattgctagatgagatgatatgatgtgtataaccttatgacagaagagaaacaacgtgcactatagataaattaatactgaaagactaaaaataattaagatgtgtggttttttaatagaaaagagaattagtattaactactgctatcaagtgcaacagttgattgaaactgatcgaggtgctaaatgttttggccatatgcatgaatccgtattgttagaaagaaggatataagattagctcggtaacttctaataattgagacagctgtatgcagagttcatttatcataatatatataaatgtaatagatactactgtttcttttcaggttcactacgtttcacgtatagtttcgtagatcattttttaattattgtttgtgacgctctgaattctaattactgtggacctgaacataatgcatgcatggtagcagatcggctagactaatctaatgttagtttcaaaaatccaatgcgactggacacctaaaaacttccaacgcaaaatgctttaggcctcatttcgatgggccacaaatcgtgtccaggccagaattttgttatttctggtccatgggcaggaaacatggccatcgaatatatgggctgtcatttaagtatttttctagcccatacacttggatgggctagagttgtggcccatccgtataggcccaattaggctgtgttgatcactgcgtggccctggtgtttaggcccattgaaagagatgcaccagagtcccgatagcatgaaaagttaaggtacacgtcagcgttataaaaaaattgccagaaaagatgatacaactttgtattgaaaattttgaaatccttgaaaaacatacttttgcttcacaactggactctatccagatcatgttttgtcatccatttgagctgatgatttacacgtcaagcatgtcaagtatagtacaggacatgaactctttttagtgctagtgatcccacatttacaggtgcaaaaagatgaaaaacaaaacgaaaaatcagaacgcatcaactggatacaccatacccaaagatgtacttaaaaaaaacttgccccccaatgagataatataaggatcggactaaatattgatacaacaaaacactcttccttttgatatcatataaacagctcgattccatctcctctaggcctggtaatatatatcttgtacagatatgccgtcgagatcaacgatgaactcggtcttcagcaacttatgcctatggtgccgatggtgaaggcgacgatggtggtttgaggtctggatactgcattgcaaattcacaaatgtaggtttgatgacaatggcattgattgcagcttatgttcatatggcaatggagcttgagaagctgtagctagcttacattcgggtaaggcgaaagaggtctcggagctgcaggtggcgccgcctctggggcggcttctgctactggtgctgagttaactgcaggtgcagattcggtcgctgcgctctcggattccgactcatttttagtcgcctcagccggtgccagtggcgaaggggaggatggtggtttgagatccggatactgcatagaatttgcaaattcagagtgatgaacactatgtcaaggaatgatttatcaggtgaaagagatgaatggcaatgagtatatatcaggtgtggacttacatttgtatatggtgaaagaggtgtcggctctgcaggagctgcctctgtactggtctcttctaccggtgctgccggtggtgcagcggtagctgtggcggcagctggagcagcttctgctgttgctggagcagcttctgtgattgctggttggctcttggtaccagtagaaggcagcagagcctgaccgatttcctgcagattgcaagagggtattaccattttacagaacaaaaccttgtaacgagtatttactatgtgaagaatgtgagttttctgagttcagaaaaaagggacagcagagtctggcaatgcaaactgcaaatcccatcaggaaaaccaggtaaatatattgaatgttacatccattttgcaccttatccatcttgctaatagtaccaatcacacaatactgtgaacagttggcaacagaggtcatgaggtccacataaatctgaagttctaactatgttttgattggtttgacaaaaatgcaaattcaaagaacttgatgtttagtacatttttggtcttgatgtttctacttacaagacttattagcggtgtacctgctaggaatgctactaaactaaatacaataggttcatgcatgcctaaactctccaggaatgaacttgatcctattaagaaatattagtcagtgagaaacaagaaactgaatattcagtaagatagatggctacctttatttcatcaacaagctcctttggagcaacctttttgttgaagaaatcatcgatctgtttaagggttctctttcggtcctgtaagcagcacaacagtaagagcttgtcatcgaaaaggaacgttgttcatatctctgaagttcattcagaagagtaggcacctcagcatatatgagtttgcttgcaactagctggacaatggcagctgaccccaaaaactgaagcacagtctctatctacagcatagatattacatgatcggtaagaacacagaagcaactccacaaaacataaaaaaaaaaaacttccaagctgatcaacctctgtgtaggcaagtattcccaaaccagtagctgcagcaagcccaagtgtgacaggcaaaccatctgtgccatcctggtatttttgcacgtcataatcagaattcgacaacatatatacaaattcgaatcgacaagagagttgcatcgagaccttagaatacaaagaaattaaatcaaacatagttgacacatcctcaaaaggtcatattgataatgataactcaccccgattagatcgctcaagctgaatcccttcttgggagctgtccagggaagactactgctctgcagttgaacactagccaatggtgacatttttgttgagcgaatgtaaatgtcagctcacagcgagaaaccgagaacaaagctgtgcaaagagttaaataccagccatcctcggcgtccctctgcaccatccttcactgcaaaagcagctttgtaaccattcgctgttacaagctcagcaaccagctcggagttcccatcaaacctggtttgcataatatccaagctaaataaatgttcaggaggagaaaataaacaaattgaatcatgtacacttgatggtataattatttgaagtctgacagttgttcacagatttcttgtgatattgttcaatcttcttcttcagaaagaaaaaaatgtagccaactctgaacattgctattgtgttccatttgcagcaaaaataaaagaaaatttttgtttctttttccctgaaatgaactcggaccatacagaattgatgaacaagagagattattaagaatataaccacattgcaattagcagcaaagatttgaggtgcccacttgtcaaggatgaccaatgtggtgttctcggggtccttgaacctcagcgacagcttcttgaggaatccgttcttgtcctccccgtcgtagggcacggcggccgccttcttcttggcctcgcggaggtcgggcgcgccgctctgccgggcgtcgccgggcggcctgatgtccaccagctgcgcgccgggctcctccaccagcgcccggtacgcggcggccgccgacaccacgccgtacggcttcgacgccccgcccagcacctgcgcgagcaccagcggcagcgccaccgcggcgacccccgccgccgccgccagcgggttctgcgccacgaagtcgagcaccccgccgaggccgaggtccgggagcgcgaactccccgcctccgcctccgcctccgccgccgccggagtccgtcgagagacgcagcgtctcctcgtaggacagcggcgcggcgagcgcggcgctggcgccgccattggcgaggccgagcgcggcgccgaggatgtcacgggctcttagccgccgcctccggccgccgggagcgcgcgcgcgggcgcgaggcggggcggtcagcggcgtgggcgcggcggaggagaggatggtggtggtggcggccatggcataacggtgcggccaccgacggcgagcggtgtcgcgaggagaaggtggcggcaaagcttgtggcgcgggaagccggtggtggggcggcggagatgaggaaggggggtgagctgggaggtggcagcgaatcggaggccgccacgtggacaaggagatcagacgtcgcaagcgaacggctgaaattctacggctttttttgttttcttctcttttccgcggtacaaactgtgtagtgtagtgtagtacgcgatggcaacggcgcggcgcgtacgtcgtcagtacggcggcgcgccggcgtgtagtacgtgtacttccgccgccggtggtgcgccgccgcccgccggcaatgcggccacgtacggcatttgctgggctgagccagtatttctaggcctcattcgggaggaataagttcactttaggtccctctatttgttggttagtctgataaaattacttacgtggcaattttatcagaaaaaataataaaaatcatgggacccatatatcagctacacaaaaaataattaaaaaaaagtgtggcccatgtgatctcacatgtcagcctccctcttatctctgtctccctttctcttccctttcatctgcgctcctaccatgccgtcactcacatccaccatcgatattgacttcgcccagcgtactgccaccttttgtctactgcgcctaccacgccgttgtccactacctctgtgtcatccccaatgcgcccgggttgtcgtatttccgtgccagccctttggtggctacgagctaggccctagcgaagctggttgtttctgttgccgtctggtgagagaggggaaagagagaggaggagagggggaggtgatgaagaagatgatatcagaacaacatatgggtcccatctactgactcaactagtcaaccgcggtcaatatatcacgttaaaaaccacacaaaagtttatttgtacaatatttagagatgggggatgttatatactccctcattccctaaatgtttgacaccgttggcttttttaaacatgtttgaccgtttattttattcaaaaacttttgtgatatgtgtaaaactatatgtatacataaaagtatatttaacaataaatcaaatgatagaaaaagaattaacaattacttaaatttttttgaataaaacgaacggtcaaacatttttaaaaaagttaacggcgtcaaacattttgggatggaggtaaagtagacttatttcatgctacggtgatttaatcttgagcgaggtaaagtagacttatttcaccaaattcaaatcgtttcgaaatttgcgactccgatgaaatattcgaaagcgaagccacgtggtttgaccggcgtcgcgaagcccagccacgccacgccacagtctttccagaagagctcacagctcacccagtctcgcagagtcgcagtgtcctcctctctacgtgccgacgcatgcacgccgccacgtcgcgcgccatggccacccctgctctccgacctgaacctacccgtttcgtcggcgagcacgcgcgccgcgctcttcttcttccccgctctcgcctcctccatcccatcgcgccacgcgagctcgatcgatcgaggtgtgtacacaaggtgttcgacaatggtgaagctggcgacggcgagggagtgccgggcgtacggcttgggcggcggggggcgggcggcgcgggggaggtgggagtacatcaacgccggggcgtacgtcttcgcggcggtgctcctagccggcggcttcgggtggcacctctccgcgtggtccgccaccaccaggtccggcctcgccgcggcggcgctcgggctcctcctcctcctcgcggtgaacgcgcacgacctcctggcgcacgccgccggcgtcgactacagcctcgcactcgccgccgggctcgacagccagttcgctctcgtcgaggtcgccgtccccgccgtccacttcgctggcaccgtgctcaccctcattgcgctcatcttcttcgagattcaggtttcgattaattactttacttcccctctgctttttatttttaagagtgttgctaatagtatagtgctttattcagtagtgatgataaacgttttctggttttcaaagggcaaagttgtggtgaaaacatctcaaaaaaataaatctgtagtgaaaacatttaaaaaacaaaatagtagtgacagagtgtactaactagaagcagcaatacaaatttctcctgtcccataaggtctgtattaattagtctctctgattttaattaagagtgctgctaactagctataacagtctagtgctttattacgtagtggtgacaacatttctaatttcataaggcaaagttgtagtgaaaacatttcaaaaatataatctatactaaaaatattaaaaaaacaaaatggcagtaacaaagtatactaactataagtactccctccgtttcacaatgtaacttattctagcattttccacattcatattgatgttaatgaatctacacatatatatttatttagattcattaatatcaatatgaatgtaagaaatgatagaatgacttacattgtgaaacggaggaagtagcgcacatatttctcctgtcacagcacgaactttggagaaaatgaactaagtcgtgaatcttatagacctgtttgtaaaagaggattttttttttaaagatttctccgcgtgttgatttgtttttctttttgataagtaaatgagtaccgactagtgagaccagatggatatgcaaattaattcctatttacttccgttaaaatgtcaggaactagccagctagctagcataaacgttccaaaattcagtatcgctggtacgattttgagtgtcagttaattccacttatcttaaattgaaaagtttactagtgtaaagtccagaacaataaagatcaattcagaaattcttgctaccatcatattttgtcaagagttcagtaacttagaacacagaagaccaatgatggcacaagtgtcacttaactagcacaactcaattttccattacagatggcaagagggtacaggcacagcctagagaagcacggcctgaacatgctcatcgccgggccggcgctgtggttactcggatccatacaaaacatctgccaggtatacgaacgcgccaacgggcatgtccagatcctccagaaatgtgtccaaacgccgctgctgctagggagcacgctgttcttgatcggcggcatcatcaaccgccacgacatccacagccaatcgacatcccgttcagagctactggtaatttgcacaaacctctgaatgtctgaaagttgcaatgagaacacgacatatgcatgaagccgatcagtgtggatatatatgctactgtacctactcttgagtaataattgtcactctgctctgggatgcaggggaggagctggggatggttctgcgtctccggcagcctgctgttcgtcgcggcggggctgctgaacctcctcaaggtgttcaagatgcagcagatggacgggcggggactggagaagctgcgcggcggcgcgcaggagcggctgaacagggagagggagggcaaggtgcccctcattcttgaggaaggccagaggaggaccccggctccggtgtcgggccaggtcccgccgcctccggctgggtcctacaaggaggccgtcgtcagcggcgcgccggctggctagctagctagcttagcagctgcactgcactgcacacagtgtaacgatgagaataagggaggtgacaaaacaaggtgccatgcattactgccattgccacactgtaatttcgtatttgcagctgtcacgtactgtagactgtctgaaacttagatgtgtgcctgtgaatttatggtcgatatattacatggtgtaataagctttttgctctcctgcatatatttgccaaataaaatcagcatcatcagcctatatatgcaatgaaggttttcactgtctgttgtgttcttgcaaaatggatggagtaagttgtgaaaaccaaaccagccgaacataacaattctggtcaggtctgtcacgtaaatttctgaatccatccacctgtcaaggttcaaattaatcaaatatttgtgtgttctcattggactagaggactacttaatttcattgcctgaattgcaaaattctgaatccaggttctgaccagaaactctgcaggtcttgtgtagaatctcagaatggttctaatgtagcctatcatttttccagaccattgctacggaaaaatcagaagaaggaactatgccatttctttgttataaaaaaaagttcatttttcttcccaacaatttatcagagcacttacccgtcgttttacaccccgaactcggttcaccttactccctaagatatttctctcttttttatgtatcagtcgtattttggactgaagtttgatagaatcaatagctgtatcataacataccttgatatttttaaaatgtttatcactgtttatataaattaaaatcactaagactgatttaaaaaatcaaggttttaaatttaaataaatagttacgaaaataatttggaactttcatagtgatgtcatccatggctttaacaattttcaacttaaaatacgatttatataaagagaaacaaaatattattaagtattaaagtgaacgtctttaatattattttggaaaggtaaaatgaccatcatctcctatttaattggtggtttattgtcggatcgactcaattaaaggtatgtagtatgtacaaaaataaaatctaatatgggctctatgtattaatacatgtcactatactattatatcctattatatcctataatagtagaaattatatcctataatagtactataatagtagaaataacgggatcttttaattattagtgctctatttttttctattatcattctttcgttttctccactatcgtgcaacaaaaaattccgttaataagtgataagaatcgactataagccattgccatacgcaacaacaatgttaatttctgttttatttcctttctctcgtcaccaaatttacttgatgaaaactcgttattgaacaccattttgctcaattgtcatctgcatactatttttgaaactgaccaatcaggcaatatctttgtgattgagatgaagggatatgctaagatgtccaggggaattgtccaaatgctaagattgaggcaaaaggttacatttgggatgtctttatctcatccaattaatccacggataccatgaaattaaatgcttggaattaacgccttctatatatttcagtgaacaaatcttcagatatagaactcccattttgccgaacattaattaccaaggtacaaaaccgaatcgcccctataaattaagagggatcagtcgcacctcgccgagccaacattcagatcatcaaccacaagttcagaaaataaatcagtcagtagctcatccggttgccattgccaatatagttcttgcgagtaatcagttcagtttaagccgctactagtacaaaacaatggcacgggcaggaagcgtctgcgtcgccgttctgctggccgtctgctgcgccgagacgatcctcgtcgccggcgcgacggagtggcacgtcggcgacgacaagggctggaccttcggcgtcgccggctgggagaacggcaaggccttcaaggtcggcgatgtgctcggtgagtagcaatatgtgtatcaacttttacagtacaaattaaaccacagtaataattaactaattacgttgtgatgatcgatgagaagtgttcaagtacagcccgatgatgcacaacgtgctgcaggtggaccatgccgggtacgacggctgcaaggtcggcgccggcgacaagaagtacgcctccggcaacgacaggatcaccctcgccgccggcaaggtcttcttcatctgcggcttccccgggcactgcgccaacggcatgaagatcgccgtggccaccaaatagatgttgtttgttgtgttgatccatttatcaatgcatgtgatcaaaataatgtgctccccgtttgtcttttatttagtttttgggataaaaaactaatatttatactcgtagagcatttgaattgtttgttcacgcacaaaaaaaattcagtttcatcgtcctgttatcgataataatttcacatcaacaattgatgcatttgtaattggttttgacgattgtctctagatatgtcaattggatcccaatttttcattgggctttctcctattagagaacagggatggttagaattgatttcccacatgggatcgatgggaggaatcctgttcctgtcgggttttgcagggaggggagagattccttgtgagacccgaatatatatgggtctaaatttaaagtttttgtgctcgtgacatttgattatgtactacaatgttatgtttttatcatatgaattaatggcatctattatatacttaaaaatctatatctataactaatataaatattcatatttttccggtcgtcacatctaattttcggcctttttcgttcgtacacaatctgatttggttagcaatagggatagaaaaaaatgcaaaaaaaaaaggaaaaaaaatatcgacggccggcgacgccaccaccgccgaccaccgccgccggagggagaagagaggcggcggctcccagcggcggcggcgaccgcgggcggatccggcagcagcggctctacccgcggacgccgtagacgccgtcgtcgccgtcgacgctgccgtagggacggccgtcgccgagggagcacggaccccgatgatgtcgccgccgctcccgccgtcgcccgcgccgtgccggtgagacgggagggagaggggagagggagcggtgggaagcggcaccggtggggagaggcggagggggagaggcggcgtctggggtgggggaggcggccggctcggctaggggggagggtgccgccggaggggagcgggaaaggcggcgtcgggggcgggggaggcggccggctcggctgtgggggaggggaagcggccccggagggagagggggagggggagaggct

SEQ ID NO: 60628 - DNA, 7296 bp, Oryza sativa
  unsure (1)..(7296): unsure at all n locations
ttcccctccacctcctccccttcctcatcccctcccctctcctccacctcctcctctcccctttcctcccatcctccccttcccattcggcagccggcggggccatgctcggcggcgggccggtggccggcggggccacatgcggcggccgtggcgggcggtggcaacggcgttgttttctctcttttttttaattcatgattcatatgtataattttgtgatttattggatggatttgagatgacctgtgatgaatttgatttgtgtataattttttaggatgtatttgatttgtgtgtatatgtgactttaagatttgtgatgtggatttgggatgttactttatttgtgatgtagatttgggatgttattttgatttggggatatgcatccggcatcccacttgatttgggagaaaataaaaaaaagaaaaggggaccatctaggactgccgctattctctctttactccgatttgggagaaaattaaaaaaaagaaaataaaataaaaaaagagaaaaggggaccatctaggactgccgctattctctctttactccgatttgggagaaaataaaaaaaaagaaaaggggaccatctgggactgccgctattctctttttactctttgggagaatactacttaaaaaaataagaggtgcttccatcgttcgtaaaaaaaccgggcgaaaaaaaccggatgaaaaaaaaaccaatctgtccgataaaaaaagggtgaaaagaaaaacaaactgtccgatcaaaaaaccgggcgaaaaaagaaaaaaaaaacaaattcgatcaaaaagaccggacgaaaaaaaccgggcgaaaaaaagaaaaaccaaatctgtccgatccaaaaaaaaaaaggcgaaaaaagggaaaggaaaaacaaatacgactacgtcaatgcagtaaaaaaagagcgaaaaaataaaaagaaatctaaccgggcgaaaaaaaaagaaaaaccaaatctgtccgatccaaaaaacgggcgaaaaaaaggaaaaaaaacgaatccgactacgtcaacgcagtaaaaaagggcgaaaaaaataaaaaaatatgtccgattccaaagaaaaataaattatatgggatgcttatatctctatctctactacttaaaaaagagatgtttccttctttcgtgtgaaaaaaatcaggcgaaaaaaatcacccaaaaaaagcgaaaaaaacgggagaaaaaaagttgggaaaaaaccgggcgaaaataaaatccgattctgtgtaaagaaaagggcgaaaaaaacaaaaaaaccaatctgtcctattaaaaaaaggaatcgggaaaaaaaatccgatccaaaaagaccggacgaaaataaccgggtgaaaaaaagaaaaaccaaatctgtccgatcaaaaaaaaggcgaaaaaagggaaaggaaaaatgaatccgactacgtcaattctgtaaaaaaagagcgaaaaaataaaaaaaaatctaaccaggcgaaaagaagaaaaaccaaatctgtccgataaaaaaaaggggcgaaaaaaaggaaaaaaacgaatccgactgcgtcaacgcagtaaagaagggcgaaaaaaataaaaaaaatctgtccgattccaaagaaaaatgaattacatgggacgcttatatctctatctctactacttaaaaaataagagatgtttccttcgtccgtgtgaaaaaaatcaggcgaaaaaaatcgcccaagaaaaagcgaaaaaaagggcaaaaaaaaagtcgggaaaaaaaccggacgaaaaaagaatccgattctgtgtaaagaaaagggcgaaaaaaaataaaaaaccaatctgtccaattaaaaaaaaggaaacgggaaaaaaatcaggcgaaaaaaatcaagtaaaaagaaaaccaggcaaaaaaacaaatccgatgtaaagaaaagggcgaaaaaaataaaaaaccaatctgtccgattaaaaaaaagaatcaggaaaaaactatgcaaaaaaaatcaagtgaaaagaagaccgggaaaaaaaacaaatccgattccttatacgcggtaaaaaaggcaaaataattttaaaaaaagaattatgtccaattcaaacgtggtaaaaaaatcgaatctattatatgtgaaacggtactatatatctctatcttctccatctctctctcttctctatatactacttaaaaattgaaaatgtttccgtcatccgtaataacaaaaaaaaagggtgaaaataacattaaaacaaaaaaaaagtctgattcaatttactttcgtcatctgtaaaaatcttatcttatcttaaatggtccaagccgcttggcgctcgtcaccgtggcacgcctagccggaccgccgatgccgtggcacggcttttcgccgcccttgggtgcctccctctcctcagccaacaaagcaggagccgctcggcggtcgtcaccgcacgcgcgcactagctcaccggggccgtcttcaccgtcgttccgctcgctcatcgctggagagaaatgggatcaggagagagggatttgggagctagggttttgcccctctcttccggttggcacttcaaccgacgcggggacgatcggagccatccattagatcggatggctcagatttgcccagcgttgggccgctgccgctgctaattacgctgcgcccaatgggccacggaagtgcatcggaccgtcctcatatatgtgggccgcgctcagctgctcggcttgcgggccgtcaaattgactcagctcgctgaagatgagccagcccaagtttgggtcggcttgggaagatctgggccgaaagcaaatttgatcaaacaatgtggctcagattttttaaattaatagaaaaaatgcccgcgcgttgcaacgggtgaagtctattttaatcttattagtgttatatggttctagttaagatgaaattcattggggattcgcttgaatatatatatatatatatataaaatcatgcgctgcagttaggagtctgattgtctcaagttagcatgtgagttttttttaaacaagtttattagataattccttctgtattactaaaagtgaacgatcttaaaaattgactcaaatacggatatgtatttccaaaagcaaacttacttaaaaaccgattcaaatacagataacgtaccaaagtactgaaaaaacatcttcaatttttatattttagattaaagtcgtcgaataaacttctaagtaggctcgaaaaataaatccaaaactaaatcctaaaccctatgctaattcatcaaaatagactcggttcaaactatttgttgatatatcacttgatttttaccgatctaaggttttcatggtgccactatcaaatggtgtttttcccgttgcaacgcacgggcactattgctagtaaaaaaaaaagaaaaggggatcatctgggactgccgctattctctctttactcccggttggttggtgttaccaaccgggactaaagacaatcgggacaaaagattcatctttaatcccggttatttgaaatgggactaaagatagcgatctttagtcccggattcgtagtcccggttaaaaaaccgggactaagaggggttatgaaccaggagtaaaaaacacttctccaccagtaaaaaaccggggggtcatgacggcgccggatgggagtcgatagatggatgtgtgttgatcgattgatcttccagcatcgaacggcacccggcgggccacacttttggtgtgccatgctgccgccggccggcggcgcgcacgttggcgtgcccttccgccgaggctctgtacttgttttctcttgtgtgtgttcttcatatgtgtgtagatggatctgcttcttctccgttgtggttctccatctctgcccgtgcatgcatgtgctgcaaaatactataagaagaaacaatgtaattagcgctcttacctcgggcaaccatcgagctcggctttcttcccatgatggctgatggtcagatgcacctcctcctgccagacgctgntgccgagcgtgggccgcgtgcaccgcttctgctccggcgaagtcacgtcaacaaggcttgtgccatagcgatgactgagtacctgctcgcgtccgggttctacgcagccgccgccgatggatggatcgatgtgagttgaatgattgtcgatgcccccttctggctgcctctcggtggctttatataggccgcggggccgccgcccgcgatctcaccgtcggttcacctccgatgccctccgggccgaaggatcacacagataaccgtttgttgcatcatcctggcgatggataaacctgcgtaagggagtacctatacatctttcgaaagatttttataatcgtataacacagatttttaatctttgtattaaaatccgatagatataataaaaagcaaaaagcaattaagaaacaccataatgaacattaaattaccatatcctcaagaaaaagaccaaatccaatacaaaatttaaaatttacaggtgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaagcgatacgtatatacgcgtccaccctgcccgcttgccggagtatacgtcacacatacagccagcccatgtaaccatagcccatcagcccatgtgtgtgtattacgtagcgaccgattgagttgctgatggtttgccgccggccagctacccacgtccatgcatgtatatatatatatatatatataggcgtgtgaaataatcagcctcttgtcctctttgctagtttgctctcatgcatgcatacgtacatatatatagccaagcatgtacatatggttgaacacacacatatacgtatataggacatatagatggacatataccagtacgtgcatggctcatgcatgaatcaatgtttaattaactggcttagcacattggcatcgctagctaaaccggttcctgaaaatggccattaaaacatgcaatatatatgtagttatattttataaatatgtacaaaataccgtcaaacataataatgaaaaaaaaaatcatatgctaagcattagaatttagtgcttgttttaccaatgctgcaggaagagagcaccctcgcttttcttgcacctgtagcaagagcacaagaagcagcaagtgttaccacgctctgccttccccgaatctcttgtgccgcaattctcaacgacgcggccatctaatatgtgggtcatcttgggttgtaccatgggcgatgacacatgcgtagtccgatccgcagtgaagtggagatgtcaaactcaattggtaagctcagcggtattctgaattcgcatgtgattgcgcccaatggcgcatcccaaagtggcaccctgtctttcatgcagtgctcggcatcttctgcaatgagcacggtggtatcagcttctctctcccttccccttgcttgctgctactgactctcgatggcctggttaagagagtgggggagcaaaaaattggaagtctccgaccccaagatttcggagggatggcgctggtgactggtgagggggatcggtatcagcgggtgcatccggtgggtggaggttggggctagattgatgcacagacagggaggcgcagacctgtattgttgtttgttggctgctgccctgctgtgacggtgcaaagaggaggagggagcgggcagagtgagtggtgcatagcaaaggtgctgccgctctaccatttgtataaaaaaagttacaacaaaataaatgataattatataatttttaataagacaaatgattgatgagtaacatatgagaagatgagaagtgattcaactggctaatacaatataagtcattctagcatttcccatattcatattgatgacattaacatcaatatgaatataggaaatgttagaatgacttatattgtgaaacggatggagtacatgttttctcttacatgaatgttttttttcttttgaaacggataatggcaaaagacttgccagatatattagaataaataaagtagaggttacaaaagattacagtctctaatgtagcaggggcctaaattacgaaattacagagattgtgagccccccctaaacaggtctctacctcaagagagtctagagctaataagatggcctatattttcttttatagtaaaggccacttgcaactcattttgtgaaacatgttggaaatttttgcggtttcgctctagccagacattccaccaagtagttagcacgactcctaggatttgttttctcatagcagttggtgttatagaacttagggaatcccactaatctgctgtgctttcatgagtcatatgttgaggaaagaaggaactataacccatctagcttgagacatggtgccaaaccctgcttgtgaaaagacactctttttctaggtgatttgaatgttcaaaagcacttctacatgggctgcatatccaatcacatggccaatgtctcttgagaaggttttcagctgttagtgttctttggtgcaggatcagccatccgaaaaagacggtgttttggttcagaatgcgccgtccaaagagttgataaatttgcatatgttatttccccttgaaattgcatttgatatgcactatttgccgagtattctccatttgcagtccttccaggagatgtcgtttgttctttgtttatctagaacgacatcttgtattttgctccctagctgaaccagttcctcaatctctaaaatagatgtaatcaggttaagcatggcaatccaatagttgtctttcaattccatccggagattatttccctttcttttggcaagcttcaaaatagagggtgcaatgtgttgaggtgctcttccatcgagccaatggtctgtccaaaaactgattttgttcccatttcctatcgagattgtgggatagtattttgatgaaaatgtcggcgagcaaaagccggttcaatttttgctggtttaaaatctaaatacgtgggacccgctgcaatgtgagcaaaaatatattgctactatcctgctttgggacggtgtccgtctcgatcatgtatccctaattgtccattgctcgtcccgcttcacgcggatggacaagacgaattgaaatcgaacacagtaacagctgacaacggacagaattttgattgtacggaatcatctttaatttttataagaaaaaa

SEQ ID NO: 60629 - DNA, 1032 bp, Oryza sativa
taagagcccacgcttcatggggacagagcggaccttaggggcatcaagggcccatatgggtgatgtccataaaacaaaggacatccataaggacacttcagggcccgtccattaaggttgccatgccggtgcttcaggcacctacatggcctctagcatttagatgataacggcggcagagccgccattgtgttatcaaatagtgctaaggggatgtaccatctcaagcctttggacggtaacggcggcagagccgccatcatgttaccgggcgttgctgagaggatgtatcaactctagcaattgaacgataatagcggcagagccgccatcatgttatcgtgtattgctgagaggatatcgggggatggtactttaggtaccatgttcttatgcttatttcaactatagcagaagaatgatttgcatataaagatcaagatgatcagtagaaactgatttctcacatgtttacctttttagctcgatagagtctcgtgctgataacgtgttgagaaaccagtctattctattgatcagcacacaagcaaaccaaacacagagttgtggaacacagaaagtatgaacgagtggaagctttatttcttctggatttaagtacatgctacaagaggagaagcaggagaccggagatccgttgttctcgccttggaccttctgggccctatttataggcggaggagggtggaggcttacgtcgtatgccttggaccttctggcttgcgtcgtaagctggcttctcttataagcttgcttcctctgtaagctggcttgcgccataagctgccttcctctgtaagctgacttctggtgtaagctttcttctacagtaagcttcccacttataatttaattcgtccataataagatatgtttcataacactgaatacccttgtgtgtattctttgccatgatttatcctttgtatcgcctttccatcaagctcaaagtgatgcaaagacacagcaatggaaaagcatgagccagaaaagtctaatccattagacgag

SEQ ID NO: 60630 - DNA, 13478 bp, Oryza sativa
gtataatatttctgtaaatattaaaaaataaaaatttaaaactgaaaaaaaatcctttgcctccttgccacgaaaatgcaactaactacagcaccgtatggtagtactccgtagtacgatggttgagcacttccttcctccatcccacagagctggtcgttctgctgttcaaaatttgttccgtaaaatttgtcatcctagcatcgatcttgaccagcgaactgggcatcaagtcaattccatttgaatttggctaatgattactctttctctgtacaacagtgccactacttaccatgtgatagataatagtattagtagtcattaattaattacgtacagtaaatttgttttgcaatctaaattgacaaatgcaactattaaatgaaggtaatatgatcatttttatttgatgttaatttgttggatcaaccttaaaacgacgggctttctgggacaaaaggagtaatactttcgatgttattagccgtttgcatttaccattttctccctatggtgataaataagattctgtcaaacttttaaaatttagatatcaattttatattaacaataagtttactagtattatgatggtattttcaatataaatatacacatgctatttattttttaaaactaaataaaactagtgattgttaaaattttaaaagttcaactcattttttttaggaacgggcatgacctctgccatttcatttatagaagaagataaaaacagtagatcacctcatttaatagaagaaactcatctgaacgtattaaatactccttttgtaaaaaaaacaaaaaaaaaacaacctcgtactccctctataaaaaaacaaggttgtcatttttgggacggatgaaatatttagtagtacgacggtaggaagtaacattctttttatggaaagttcagtgttgtagggaatgaaacgctggcaaaaattgcacactgctctggacaaccagatattcataatcataaatccatttattaacacacaacgactcaaaacaacgacatcgatcgaactcgcacacccagttacactcacatccatgctgaaaattaactatccacaagatcgagcccgcatgctcaccggcaacagttcaaatataccctctactcgatctacttcacaccggattaattaattgcacgtaattaatcgtgatcgatcatggcttggcctctggctcggccgggaagtggaactcggggacgccggggaactccggcttgggcggcaggtcgacctccgggaacggcggaaggtgagcctccgggaagaacggaggcagctccaccaccttgggcagcggcggcagctcgtgctccggcaccggcagctccgggaagacggcggccgggtggttcggctcctcctgatcttcctcctcggccggagccgtcgtcgacgacggctcctcctcctccagcctcctcgccgccgcgccgctcgcggcggcgcacgccagcagcgccgcgagcaggagggagatggcgatcttggaagccatgtcgttatttgcacgcactgatcagtactgttcactgatcagtttgcctctatttctgtcctgagatgttttgcaatgtgaattgacaaatgcgtggtgtaattaatttataggccgcggaaagcgcaaacacacgcgcgttgatggagtagtggttgatctgcaagtgttcttacttaaattcttagtagtggttggtttctgtgtgtttttgtctatgatttggttgagaaagaagctagtcgggttggcgagagcgccgcgcagatcctgtgtacaagggacaggtacgagaacgtatgcaatgctttgttggtcaccgccacaccggttaattagcaggaaacaagaacgtctaagcagggaagtagagtgccaacaaccggtggtcgagcagcattgttcgttctatcactgttaaataaaaaaatttccactctaggcagggtcgcaaggccgatgatagccgatcggttttcacggttttcgatgttttgatgtggcttgaaattatttttgggttggaatattcaatattacatattgatctatcttgtcaatttttttgaaaatttttcgtaaccatctagttgacatgcaataaacgggtggacgtccactcgagctattagaatacatctctgtggtcgaacaacattgttcgttctatcactattaaataaaaaaaattctctgggggcggagctccaaaccccaccgtgcgcgcggcatcatgctagatactagtaacaggcagggttcacagagcagatgacagccgatcggttttcgtggtttttccatgtttcaacgtggctcgaaattaatactccctctatccagaaatataggggactttgtttcattagtttgtccataaatacagtggatttctctttttcaagacaaccaaggaatgtcagccatccaaaatcaaccggtttctgtcaggattaaaaagataaagaaaacgtactagcactactactccacactgttcttggcagaaactaaaaataatttcagaaaacgtactggtactactaatttgtttattgtgcctaggatatcttttcagagaatgtactacttactcttccttaaaattttgttattttaggcataataccttatattccgggacggagagagtatttggttggacttttcaatgttttatgataaatttaagggaaaattggaaccatgccattataattttgcaaaatttaatgttttatgataaattttgatcaaatttaaatgtcaagcattaaatttgatcaaaattcggtcaggatttatcgaaagtgtccttatcaattttgaggcatagcgatctgtaaggtaattttgattttttcctttttcattttttttccctcgtcatactcccgtcggccgtcgtacacgtaccaatgtacgatacatatcgtatgaatcttggtatacgtacgtccgagccgtacgatttgtgtccgaccgagtcatgcaaccaatcactgaacttgtttactaccatgtgggcccagacaaacagcatatatgcttatacatacactagtcggacgtataggtcggacgtatagcaatttcgatatcgtacggagtattctacatgcaccaccacgtgtggcaccattctacgggggtggctaattggcgtgcacacgctggcaccccctcccccgcgtgattttttttcactttctttttttatgctttcattttgcttttttttttatttttttaaatctttgttttcaaatgtttgagttaaaagttttaaaatcttgatttgaaagtttttaaatcttaacttaaaaattttcaaatttagacttaaaagttttcaatctcgagttaaaatttctcaaatatgagttaaaagtttttaaatctgtgttaaaagtttttaaaatttaacttcaaagtttaaatcttaaagtcaaaattttataaaactaatttgaaagttttcaatcggttagtaaaaataatcttccagaaaaaaatattatcttaactattgtcgttatataaaactaatttagttagttaggctaaactactcccgaggtggtgcgcgccgggtagctaaatgggtgccacctatttactcaccaatcttaaagcatggacaaactgtaaagtaattttgaattttatttctcatcgtattcccgtcgtatttctgtggtacacgtacgatgcgtattgacggtattgtattctgccgcatccagagcctcgttccctcccctccagtccaggcctccactacacatcctcgaactcccctcttcgccgtcgctcccctcagcgtcgccgccgtcctctgcccgtgtgccgccgccgccttcatcctcatccgccttcacgccgccgccgccgccgtccgtgttcccacaccgctccggtattcctcctcgcctctgagcgtcgtctgcccaatctctggagtcgacaagattggtggtggcaaccgctccgtctcaccgccgtcggccgtcctccgccaccctcccgctgcctctcgtcggtccaccactacgtctaggcgatttccgcctcgatcttgctcgcccgtaaggtgttcgatgaaatgccgccgtcggggctttttcctcgtcgagcccttgccgagggagccggagcgctgggcaggtcactccctcttgtcggcggtggttcatggacgagactggtacatggcggcggcggggggtctgaggcggaaggcgaggagttcccgtacgccgacgtgccgcggcctgggaggaagtgggagcggaagccgtacgtgacgccgatgaaggtcctcatccggcgggccaaggaggagcggcgcgcgcggcgggagaacccgtgccgcgtgctggagcgcccgccggagaacggcctcctcgtgccgggcctcgtcggcgtcgcgcaccaggtgcacggcgcgtgggagagcctcctccgcgggctcaccaggctcgtcgagggcggcgccgtcgccgtgaggcggtgcaggttctgcccggaggtgcacgtcggcggcgtcgggcacgagatccggacgtgcgagggccccggcagcgcggcgaggaacgcgctgcacgtgtggcggccaggcacggcgcgggacgtcgtcggcttcccctactgctaccacctgttcgaccgcgtcggcaagcccagggtgtcgcacaaggagaagtacgacgtcccgaggctcccggcgatcctcgagctctgcatccaggccggcgtcgacgtcgaacgctacccggccaagcggcgcacacgcccggtatactccatcgaagggagaatcgtggactttgagccagacgacgacgaagatgacagcgccgacgacacaggcccatcgctgccttctcttgccgccgatgaagccggcaagatggaggaggagatgacggtgtgcgagctgggtgcacggacgctgcagtcgtggctggacatgcgcgccggcgcggcgaggctgatgggcaagtacggcgtggtgacgtgcggctactgcccggaggtgcaggtcgggccgaaggggcacaaggtgcggatgtgcaaggccagcaagcaccagcagcgggacgggcagcacgcgtggcaggaggccaccgtcgacgacctggtccggcccaactacgtctggcacgtccccgccaccggccatggtggcgacggcggcgccccgccgctcgccaacgagctgaagagatactacggcaaggcccccgccgtggtggagctctgcgtgcgcgccggcgcgcccgtgcccgcgcagtacaggagcatgatgcggctcgacgtcgtgccacccgcccgcgacgagcacgacctcgtcgcctagagcacgccgcccgtggcgcgccgcacggggttcgacacgagatgggatcatgggaatggctcctcgcctggcaatggctcctaccacttactacatatatacatctatatacattgtgaatgttgcaatagttaaaatccacaaatgtgggttccatctatatggattactttagctatatacattggtgttgcccttgcaacctgaggagatcatattcactgcaacagcagaaaaggacgcattcttcttgcgaattgcaataagatgagaggggatggaaggaagaaacttgtgggctgttgtacttgtgcccacatttctccaagtcaattattcgagttactgcggagtggagaaacattctgaatgatgcatatcgttgttgctgctgcttcagaattggacaaacataaatgaagaagtttatggcaactttgattgagaatgaagagattcgatcagatgaggttttcttgttctaccacagtggatcttgacatcgacctgaaagtcatggcaattttgattgaggaggagcaaatttgatcagatgagttcctttctctccctcttttgttaccacggattaacatttaaaactacgacattgctttctcaagtaccataaaatcacacttattcccaagtgcatttccagcagcccgagcacagtgaaccctggaatggtgaccaccagttgctcctttgcttcctttggaggagacactcgcgggcgctgctagcacgacggagatggccatcttgttggaaggcatatataatccagctgaagagatttcgagctcgagttttggacgtgtgagaaaagggagatgagcagtgcaacttgtatacgccacagaatacgacgtccttgatctgcaagtgttcttaattggtggtttctatactttatatggtttttgcctatgatttcagctatagcaccgttggtttctgtggtttttgtccatgattttccgcgagaacaccgtgcgtatccagtgcactatgttcagaaagtaagcgacagagcctgtgcagaagggacaagtatgagaacgtatatgcactcctatgagaacgtattcaaggagtgcatattggcgcaacaatctccgccgccgcagatgctttgctgaggagttatttttgttgcaactcctagtttctagtagcttggctaataacctgtaattgtacactaatacaaggcagggatcatcattgctttgctattctcttcgccaaaatcgtacggatacgcactctcaatgtttcatttctacaccgttaagcattcagtttattcaagtaacactagtacgacaacctagcagtaaccttcactataaaagcttcaactatctaaaagaccccaaacaataatttagaatatatgattttctgaggtaattccacgaaataaacaaacaagagtgataaacaaacaagagtgataggtttcatcagaaatgtggtgctttcccttaaatcatcttccttgtgcataagcagaccccatctgataaattatgtgatgtattgaatctgccaaacgattacacattgttccctaccaaaattggcacagcttccttttgcaggtatctttccatacataacattctgttcaattctgaacagcagttagatactagatcctggatatcaaatcaggatatttttcaatcaattgagatgaaaaatgtttaaacctggtcaaaaacgagggaacatcatcacactatttcaatccctgaagctatacacagcttggaatcagctcccccactgatgacgctatcccctttccaccagtccgcacataaaacctataatcaccaaaatttaggacctcgccttttgttcaaacatgtaaaaataaataccacaaaaggaataccttgtctttgtgtgactccacagaagccagtggccactgcaacagaacagaaccattaatggtctatggcattttgataaaataacttgaagagaaaagagtaatcaggaaggaaatatattattagaatcttactgctgtccttagatcccacaacattactttcccatcaaatgaagatgataccaaatgaaaccacgaacttggatgccatttgcaagcactgatccagcttttatgggaggaaaactgaaaaattggagctagagttcctgtttgaggataaagagtattagctaatttgaattccaaaagataattagagcatggttttgcttccacatttaccaggtttacgagggtcccataccctcaagacagggtcagagccaccagcagcgattagtgaagagctctcaccaccacaatccaagcaattcaaggccttcccagatacctatggaaaatatttacagacatcggatgaattaatttgtgaaacagagcaagagagtagcaaaagctttgactctccttggcaacagcacttttttggacagtgtgcagtagttaaaacatagctagtgcctttctaattcaaagtgccagattccacgaagcaaatttcagaggaactcaggacaagaaatgtgcagatgccaattgatgacttaatgagcacaaaaaaaaaatcccttgctgctattatgctggcagaacattatcatcacgctgtccatgcattttaatacttttatttttaaatgtgtagatattttttgcataccatattccatgtctctttccctgtttggacatcccactgccgaacagaatggtcccaagatgctgaatatattgtttgtcgctcaggccaggtaacagcagaaacgcactgcgtatgtcccagaaatgttgaagtggcagaaccctgaagtgcaacattccaaactgagatcagcagggttgtatcatgagttcatgacaataaatagtataaaacttcacaataaaagaattgccagaattaaatctcccccaaattttagcaggtgcatattaaaaattatcaaagcactggaaattcaaaatcaatacccagcacattataaagccaaataactggagccaattaaccaagagatgaacatattttagtacttcacatgatggcaccatgcacataagaccaaagaatttggactggaaagtaaaatgacctcaaacagagattcttcaggtccagatgaatcagaatttgtccttctcttcttcactgagacagtgtcaccatcttcttccgacccttcgactgaccatagcttaattgagttatcccaggaaccagaacatatctagttacgaaaaaaaatacgttaaaagggccttagaataaaatactaacatatagcactgatttggaagaccagaaggataattaccatgtttgtggaagggtctactgcaacactctgaacagatgatgtgtggccacggagaattttgtaagccccaatttgctttggaacactgactgatgtatcaaacttgagatccaggagtggagaataaatgttaagattggatgaagaatattactcatgaagcatgtcttggagggaaaggcaaaatagagtatcttactatctttaccttgaataagcgcaatgacctatcctttgatgcagtgactacatgcagcctgtcttcagtttcacctggaataacattattggaattagtagatatttaatatactgatgttatatactgtttggggaaaacaattagtataagggcatgagtgagcaaatatgttgtgtgcaagataacctttattaatgaagcgagcagaagtgattccgtcactatgtccttccaaaatatgtgtacattcagatgcatctctccatattctgggcaagaaaaagcaaatcagaaggttgagattgaagacatacaacagttggagttggtgttacagtcattttgtctaaaggggtagaattaaaaataataatagcatagacatgggagatgaataccttgcaagaccatcatagcaacctgttaatacgaaactgccaaaagacgaatagtttagtgatactggaaaccaagcgaaagaaaaatatgagaaaaggttaagaaagaacagtacatttgaattatcagcctatgatctattgtatacatatgtaaatgtattagttgcataatagtaatggtgataagtatggaaccacaaggaagacaattttgcgaagatctttagttgggctagcggtaaaattatgtggtagaataagagcagtatgagattaggatccaaatttagatgtagtattgagctcatacatggacttgttttgaatgcatccttcattttgtcttcttaagataggtaaactgtgcactagtcgagataggtgaactgtgcactagtcgattttagcttagccctgggatgggcaaatctttggctccacagtccattttagttgagttaagaaattttccgcagaatttgaaaatattgatcagcaaggtggactagatctaaaatcatttgaccacaagagcaatgttgctgataaaccttcttgtaataagtgaagacaatagtgacaaaatcagcaatccaggtatagttttgaattatctaaaagattaataacctgttatcatgatgctagacaaacatttgtgtcctgctatttgctcgaagcatgtcctatggaaaaatagaccacctaagtccacgtaaaacagaaaccatacctcgggttcgatccatcaactgcgctaacccagtcatcatgcgggcatggatcctcctgcttcctcggtgccacagcttttacatattcaagctcaagcaccctctcctgcaaaaacgctcacacgataaccccgcacaatgtcacagaaaggtccacaccacagcacagcggaattctcccccaaaaaacgaacatcgggtcaaaaattcataccactgagatgcccttggcgaggaggaactcctggagcgggagccgcacgagctcgccgtcgacgaggaagtcgaagggctgcgcctggtgatccggggaggctgcccaaaccggaggaagcgagtcagagagatccgaggtccatccgaggggacgcggggggctagggttctggaaaggggaggtgctcaccggcgaggaggaggctgttgacgatctcagagaggcccatgcgggtgaggtcggcggggacggcgatggaggtgggcggcgcgcgcagcggcgcggggagcttcgtcaggaagcgcacccgcacctggcgcgaggggtcggaggcgccgccggagtccatggcggcggcggcggcgtcggccggcggagaggaggcggaggaggcggcggcggcgggaaggggagggaggggttttgagagggtttcgaatggggaatttatttggttagggttttggaggatgtagggcccagtagcagtgacatcacgttcgaggcaggcggccagaaggggagaagaagatgtccattttgcagaaaacccctccaactatgtgtatgttcaaattggtaccaaaataaatcttaccaaaatttagcaatatcaaaattttggtaaattgacaatattgttaaaattttggtaggattttcttaataatgtcgtcaaaattctgtacacattgtcaatattggtaacaaactaaatgtagccatataattattaattttaccaaataatggtatagttgaaaatgtcatcaatttgaataggccctatattctgacagtgtttatgtgtatgaaccacctcaactgttaattcaaatattcaatcgcattactccatttttcataatttgcactatagaagtacccatatatctcatgattggaaatttagggataccaattgatacaaggttaatttgcaaaattcaatcgtcgtttattggaaatttagggataccaattgatacaaggttaatttgcaaaattcaatcgtcgtttattttgcaaattctaaatgccttcaacggcaactttagataaagatttaacctattataatctctagaacaaagtcaaatttatagagaggggcacttttacactggaaaaagtccacttccttcaaccatgggttgaatttcatttacgtcccttaaccgtaaaattgaatatgaaacatcccaacatcataatcaatgtaaatcgagtctctcgattatattaagggtacttttggctgacgtgaagactacatgtcttattaacttgatctctgtcctacatgacgcctactagcgtttacatgatgctagaataaaaaacaccgatggaacccacacgttagtggtaatttagctacttttttggaacaagtatgtggggatttggttaaaatttttggaacaaatatgtgaggccacatgtcaatgggtgtccggtgaaaaaaatgcaatggatccacgtgtcatcacccctctctctcctcttctcttcctcaatattctatctccccaatcttctcattggtagccctagctgtcagccaagcaacgtgctcgtcgtcaatactggcggtgagggtggtcgcggcctttgtagtgtgtggacaacgattcccgcatggccttggtgtgcacatcctgagctccagatctagacgacgactgatgtattttgttggaagaggcagggagtgctcagtggcaacccagcgtcctcttcgacaatgtacaagtcaccaaccgaaggggtgattaggacccacctctagcatctccgtgccaagtttgcgaattgcgaccactggcaccgattgacgatgggaggagctcaacagggaagagagggcctttttatctttgtgattgacatgtgggtccaacaaattctattaatatttaaggtataattatcacttgcatgcagacaacatatggcgccaacgttgcctaaaaaccaggtcaatgtgtcactacgtcccatatcagccgaaaacgctgtcaatattgtcgagagatttgaattgcactggttttgaaagctatgatgctctgttccagagtttctggtcgaggtatgcgaatcaaactcgaccaatactgaagaacgcagaatggacctttttagcttttcccacgctacctattctagcccaagttagcccacagatatcatatatcatataggaaaaagtacgaattacctccctgaacaattgcggtcgtccaatttaccaccctaaacttcaataccagttattttttaccctaaactttgtaaaccggatgaattacccccctagatcgattcatagcgggtttggtcctacgtggacgcatacgtggcagtctagtcagccaaaacagataaaaaaatatgggacccacctgtcagcccaatccctcttcttctctccttctcttcaccccttcccctctctctctcactccatggcgcaccgaggcaggcgacaaaataggcagcggtggcggcgaaagaggccgcggcagcagcagcggcggtggcaacggaataggcagaataggcggcggtgagcccacttgtcgtgtcggcgcagcggccgaaccaaatcaagaacgtcgtgtcggcgcggcggcgcgggagcgggggcgggggcaggggggagcggcggcgagcgcatgctgccggccgcgccgcggttggcttcccgcctcgccggcgtgctgtcgcggtcgtcgtcagggcccaggccgaggcgacgtcgtcgtcgttcgatcgatcgatctgcagcggaggtggagccgacaaaggaggagacagccatgtcgtcgaccccgacgggcggcggcgcgggcggtcggcttgcgagggccggtgacgggcagcggcgcgggtggtcggcacgcaagagtcagcaacgggcggcgtcgaggtgctcggcgacgaaatcctccgcgagatactcctccccctccctttccccaccgcgctggtgagcgccacgcccgcgacgccggcttcctcttcgtcgtcctgggtcgcacgccgccagtcttcctctccgccgcctccgcctccggccttgttcctcccgacggcggctgagcctccgccgagtgggagctcgtggactgccgcgactatctcctcctgttccgcaaccacggcgacg

SEQ ID NO: 60631 - DNA, 2134 bp, Oryza sativa
aagtgcatcagtggcgcgtccaatcgcaacgcaccgtagtgcgtataaagtgcacagacagacgacgacgcatatgtgtatagtgggggtggccgatcgaaaagcgtgtgcgtgagcgtgcatggattcgttaattggtgggagtatgcccgttgcacgatcgcccaaatcaacgacctaactacctgtgtcgatcgtcagccgatcaggcctattccatgtcgtcctgacaaccttttttttactattgcagttgggcggcttttcatatcaacttaaacttaaaaagagtttttaccattcttgaaaagatatctagtaccatataccatgaggcaccaactatcatccgtttgtaagaggtagaatcaaaacgcttaaataatgctcgcattttttttagataatggaatataatatcccggtctttgctcaaaagagctacagcccattattacaatctagcactcaaaacaagtgtagtccaaaaataatagcaactagcgtatcaagataaaaataaccaacaaaacatatggagaacatattattgaagtctatttgtgagtctttatccataattggcaaaaagctgtataaccatcgactcaagctttctgcatgcaacttttaaaagctcaattatggaacttttaaatgcaacttcatcagacctttgtaactgtgcccaaaaccgaaacccgtatgtcgccctgaaaattgcctgcatatatgaaacagatggtgatttatcaaaaaccatgtcattactgcacaaccacagagcccaacatctcgcaaaagctcccagcaatataagtttacttttcttcttatccacccttaacagccacccatgaaaaataggagaaacgctagtagtaatatataagtcaaaagaaaactgaactgctctccatatgaattttgcataatggcaatcaataaaaagatagttaattgtctcatttttcatacataaacaatatcttaagcagctattccagttttgtcttgctaaattatctttcattaacaccatccctttaagcaagtaccacataaagattttaatcttaagcagcatcttaagcttccaaattatcttattcctctcaatatatccattattaatcaaagctagatacattgaccttacacataaccgactattctgattataattccatgagacacaatcagaaaattgattcaactggatatgtataatagacgcacataaatcatgacaaaatacaagattctgaccaactaaagctctcctgaaagatacattaagtggaacagaacccatgacggtagcaattgaagaattcttccttcttacgggagcatataaataaggatacttatctttaaaggccagaattacttaaccatttatcttcccaaaatcttgtttgttgcccattattcactatccaagaacccatattcaagaaagtattattagctttcataagacctaaccagaaatgggaaataatgcgcgtatgcagtaccgactagccgagactaacgacgactcctcgcaggttcacagtctccctctcctaatcgcgctagcccaaacaactcccacgcgcggtttgcaccatgtcgggcccgtgccacactgccctgcggcccctgcccaagctcttgtaccgatcgagtagctagccatagttgcaatcgagctttgaagaagtttgatgacaaaggatcaaaaatatttgaggtaagtttttgggtggtgacaagcccttgtctatattatacaaacctcatctcagttccaatagggatcagttatctattccattatctgaaaaaatagggatcaacaccaggagtttatcggtgtacaaaatcgtcagcaaacttatgtgtttatgtgtgtaagagaggtcactagttaatatatgttattatttggataagagggatcacctaagattacaaacttatgtgtatgatagagaattagagataaccggtatgcacttactcatcgttagttaatgatagtcgttcatatgcgtaaaagagaccatcaacttaacaaatttcacctacaacaaaacactccattatacatttatactcctatgtgtatacataatacaaactg

SEQ ID NO: 60632 - DNA, 681 bp, Oryza sativa
ttttttctgccaggtgtggggcccgggcccaagttgctccacacctggctccgcccctgactacaaggaatttatttggtgatcttttttatggtgaatgtgattaatacttttggaagatttttttttttgcacccgttgcaagtttgtgaaaatcctgtcaaaaatctatcagtgtttcgttaaatttaataaaatatacaaatcttgttagaaaagtatgggcaagtgttaaagcttgtatatgtgtttttataaccgagttgacaccgtcaaagctgtgttcggaagggcaatattccaacaaagtacgtggttatagtgagattaattaattattagcctaaaaatgatagtcagattagttacctattagcctaaaaacttgaaaatagattaatataattttttcaacctgctttcacatagaggtcttttcaaaaatacactgttttacagtttgaatagcgtgtgcgtaaataacgaggaaagcgagtgtggtaaagagggtaaaagaacacaggtaagtcatcttggcagagtaggggtaaaccggtgttgaaatacagtagaattcctattgtagaagagagatgtgctcgcatgtgcataggtatctacaggttagaatataattgcccccatgatgaatatggccctgtcactccggtggacagcaat

SEQ ID NO: 60633 - DNA, 3312 bp, Oryza sativa
ccttgcacttgttcctgaaatattattgacgtggctgatgaatgctgtgtgttattggagtctgatttgttgtggggcttcattaaaggattttcatgagtagagctgggagaatagccttggctgacgggatgatgagggtgaagtgtgcctcgtcgctgtgttgacagaatgagggagggagattttggaccttttggtattttatgctcgctttactcatatttagccaaagtccatatataggagaggcccacaaccaaaggtcctaaatttatgggaacatactaatgaaggaaataaagcaacaaaataaagaaatagctaattaggaaacatttctctaaaacttgtaggcgtattgtggtggctggcagtagagccagcaattttaccctgtggggtccattatcattgcttgatattttagtggggccatttatgcaaaattcagtggatttacatggaaaaattagtacccataagggtgttagtgaaaaagctgtggggtcagctgatcccacagtttgtacatggctccgccactggctggtgcacttgtagccctgtgttggtgggctgtaggtgcgcctccacatgatatatcccctctctgaaagcagcttgtcctcatactgaattggggaagcacttgatgaagttgttttgagatccttgacgtattggcagctagagagttcagccaatggacaaagggctcgagaggatcacgggcatgacggggctttgagcaatttgatgagggtatctggcaaacttgttgacactccagtgggagtgagggaattgcagccttctctccatggaagggtttcagtacccacgtgaaagatatgtctaggactctcttgtgtacttcaatataattgggccttgaacttcctatatactacctctgtcctaaaatatacttcctccgtttcacaatgtaagtcattctagcatttcccacattcatattgatgttaatgaatctagatagatatatgtctagatctattaacataaatatgaatgtggaaaatgctagaatgacttacattgtagaacggatgatgtagtagattttgcccatgcaactacatgggcaaaatcccttatagtttggaattgaggcagtagtactttcttgctttattaatctttagctaagtctgtatataggagaggcccacaagcagaggaaatatatgaataaaatcaggaaatttttaatcaggacatttcctatacttggggccttacttataccatagaaagttgactatatttgaaaattgttccaaattattttttccagtcagaaatatagatcaaaagttcctgaaaaaactaggttaaactagactggaattaacctatgaagctttaaagaactttcttgaactacttgaacgaaaaccctcaatatgaaaccatagattaaagctagaactgagcaaacacaaggaacatcgagaaaaaaaaaaaacgtgttgcattaggcgactaattctcaatgttttttttctatacatatttgggggaaaaaatacttcaaatccaactcaagattctccaaatgtagtttaatttggatgttgtctagttgtactaaacaaaatcaggtgtggactttttttttaatgcataagtgggacttagcaaaaccaggttatggactaaccttggcataattgtggctgtagccacctctgaacaagctttgatcctatccgctttagctggtcattatatatgatttagaaggttaactgacatgcacttgagctttttctgttttatgactctgtacatgtttgtcatattatgatttgtcctttattaagttaccctgttgaagaacatttaagttcgggatggctctttttggacaggtttacagctgttttgaaatgatatttatctaaagttttaactatttagtcatcaggtccatttggtgctattgatatctccctttatctctggcaatctatctaaactgattacttgccgcttatctacttctttttaactttgtaggagttactacaaatgcacgtaccaaggatgtgatgtgaagaagcatattgagagatcctcacaagacccaaaggctgtgataactacatatgaaggcaagcacagccatgacgtgccagcagccaggaacagtagccattcttccgctaatgccaacgtatcgtcttccagcaatttacctcacaaggacagggggcaacggtcgtcgtgcagagatggtttgcggaatgcatcttcagtttcttccttacagttaaaagaagagagtggatagcatgaaattttggtagtgtttagctgggtaaattgttctgttcttcagtccaatctgggtgtgctgcttccaagcgccgctgagcagcgtgtattggctttgtaggttggttcttgcattggtttagttagggcttaggggctcgtttggtatgcgggaatatgctcatattcctctggaaatcgaaccgtttcatgtgaaactaaaattcatgccttccaaacagggccttagcaagaggaaacccagcatagcatccttccaatatctcgcacgttgtgcttccaatggctgtaaatgatataggtcctgcccgatagagaattatgggcgacagaggtttctttggcgcaactgtaaatgcttggcatgtaagtctcatctgatggctgctgactccacctccaagttcttgcggcttatttcatcatccttggcccgaagacggcttttaaaaccgtcaaaacgggcccgcacggttcgctccgtcgaacagtgagccgcaagaatctagatgaaagataggagcgggcgaaaagagcaaaaggttaattgcgaaacgtaaaaaaaagggaagaggaaaatgaagaaggaagaaaaggcatacccgaaccgccaaacttttaatggtggaacacccctcgtcgaactcattaagttcggtgaatatgctcggggtgccggtgggcaagacaagattgcttactccctccacaaagggaataaggtccgcccgggtctcgaagtcaccaggggcgaagtggggcgtcgcaagggaatactccgaggtagatgcttcggtggccgcacacttccccttcgtcttgaccagcggcgaaattgctggctcgcacgcagggctcccgaaaaccctcgccgcagccgacacgatccgatcgacggaggcggaagccccggtggcggcgctaccgcctgccccagcaaccccgagcggagcaaggggagcagtcgaaaagtccaaactacggcca

SEQ ID NO: 60634 - DNA, 23738 bp, Oryza sativa
ctgcagactatctgtcattatcttacggacaaaatttgtactatattcactctcttgaggagaactttgcaaccgctgaactcctccagatggttgaatacatggtttatgaagcagcatccttaagctgaaaagagataaacatgattgtcatagattttatccaaccaatacaatggtaaaaatagattaagaaaagagagaaagaatgaaatggaccaagacgaacagaggtaaagtaaatcacttaggactgatttgggtaaacccatggtttagaattatcaggttagcataagattatatatatatatatatatatatatatatatatatatatatatatatatatatatataaaatcaattttccaagtactaacctattgacattcagtgcgttgctacctccttcaggctgatcttcaatgtcaatatcatgttgtgctagagaaacagttgtcagttgagcatctgctggaacttgaacaacagctgtgtatccacaatgcttcacaaccaccacaccaagagtagcagtatcctgtaaactaataaaattacatcgacaataaacaggaaaatggataaaagtaaactgcaacagcccgtatcaaagaagaaagtcttacatgtactgttgcactctcgtcagcagtgatgcccttcaacagatttctcttagcaagttcatcagacagcattcctggagcttgacttccatctaacttgacatctaacttagaacttgcatccgctttgtcctttgtgactgttattttcatatctccaatttgttgcgtgtgcaaatctggatttgtggtgtcattcggtgtttcaagtgaactcttgtcagggaccatttgctgaatagctgcaacagctttaagaactgcaacatctacaaataaactatggagtaggaaagccttcctgtctcggatttgcctctcctcagctgttttgcaaggcattgcagccagtatggcaaattcttttgcccatggcctatggtcatgttttccatctcttccctgaccaccaccattgctaccccatgtttcatcttcagttggaaggggtggaaacaccgatggcaaatcagcaacagcaggagggaccacccaagtgtttgaccggaatccataaggaagatttccaaactgcaaggaaatgtcaataaaatgtgaactataaatctctcaaatgcaattgcaaagttgtgttaatacatgcaaacaaaatatatatataggtacattaaaacaagcacactattcagtttagtgaaacaaaatgcattagcttatttccaattccacgaattcaattgtttccgtggaaaatagggtatgtctcttcaaatgcattgaccaataaacctagaaaatgatctctaacctaaagtttagctttgaaattaataatttttaaatagtcacatattcaggcatgtctgaaaataatcaagaaatcaagcattagcaagacctcaccttattatgctcaacaaaagccttcataagagccttgtaagcctacaaaatcgcacacatatttccacatcaatgagataccattcattaataatcaaatcacaaaatctccaaggtcacacgtactccatcaaacgcccggctcgtctgctgcaacagcccaacaagggagtggctgatgagcgctcgcttccctgctggatagaatccagctttggaggccacgatggtcaccggcttcccactacaaacccttacctgcacaccaacacccaattgcagaacgcttggagaattatacaggtgcaaatgagtgtcatattgcatttttttatgacattggccatattgatggttacgtgcgtgctatgataaattaattaattgtagttttcatatatatgagttgcagtctaatctaatgaatatatagttaaattagcatgagattttgaaacaactattggcaaaccttatctagctactctaatgtaatgcaatcgaatcaattaaactaaaaagaaacatcacatttgtgctatttttcttcaagcaaactcacatcgatctggaagaagtcgtcctctgtcttgtcatcaacgaatgggcgcgtcgacctcctaatatctgaaaccaatcgcattttcacttaaacaaaagtggaagaaaaaaaataaatatcacccgaaccggctcaccatcttctgctgttccgaatgcgctcaaataaaaaaaaaagaaaacaaaaatgaatgagaagaacgaaactactagcactcacaatggaggggcggggagaggtgggagaaggagaagaactcgtagaactgtcccagcttcggcggcgggtacatcggctcctctcctccaccgcctccggcgccaacgccgccgccgccgccggcgggcgacccgggggtcttggcggcgtcgggcgaccccggcgggggcggtggcggtggcgcatcgggagacgacggcgatgcgggcttctgctcgggcgcactcttcctcggcccgaacgcggcggtgcaggcgacgatgtcgagcagccgccgcacgtgcgccacggcgagctcctccgtgtagccctctgccgcgcgccatgggagacgagacggtgagttttttatttttttgcgttttggtcctcgagaaatacgggatttgctcgttcagacttaccctcgacgatgctgacgtggcacggcttcagggaggcgacctccaccgtgtccttgagctgggccccacgaacctgcattggtggcagagagggagaaagtacaggctgtcagtgggcacgaatctcgaggcggatgtgagccgttgggatcctctgaccgacctcgtgggacagggagtagttggtgaggtggcatgtgtccacgtggacggccaggagcttccggacgtcgaggatcttgtccgttgatatgccctgaacaaagcaccacaaacacaaaatgagctaggcagcgagttggcacctaccactgcgaattataagtaccatatttaaattgataatttagccacacaaacaacccaatatgaaatttgagatttaaactcggaactttaaccccaaaaataacccagtcttgtttagttttcaactttttcttcaaactttcaacttttccatcacatcaaaactttcctacacacataaacttctaacttttttcttcaaattttcaattttagcgtggaactaaacacagccctaatctaaaattcactaggagatttgaactcaaaaccttgggaattgggacgctactgaggttactataatcagtaggctacatgccattgcacaaaatggtactatgtacttaagctaacacaaccattgctaacttgctcaaaaataattaggatgtgtaaattgcccatgaacttttttgtgtaatgttcgtatagaaaataaaaattctcatcatgtacatttcaacgagtggggtcattctttgccagctttgttaagttgccgcttatgctcggtcgctcgccattgctaattagcacaagaaaaacacgttttctgtgcaattgaaaaaaataaatatagaagtttctaagagaaaagtggtaggcactttcgctttaaacaaagtttttttttctttttttttaaaaaaaacaagatgaaagtgttgcaagtgaaagctagagaagaatttacttaattttgtcgtttaacatgcaagcacaattaaggccatcgaatagaaggaacagtacatattcagttacagtggtcactggtcagaatactgggtggtccatattaattaattaattacgcgaaaatatccatgcgagaagacggagataatacgcgccccggcgctcaccttgagcgtcagctgcgtgtagtccggcgtctcaacggtgacgtccagcacggtgggcagaactgcagcagcatcatatcaatatttccacgcaaaaaccactcacatgttaatactgaaacaatatgaactttcaaatattgaaagaggcaagctagcttaattaattaatccttgcatctgaaaataacttttgtcttgaaaacgaattaaattaaaccaatcatccgagctgatgaattcgatgaaaattcagatgggaagtgaagaagattcagttagccatcagttaagctgcacctttctcttccttcttcttcttgtctcccttggccttgtgcggcttggccttccctgccttgggcgccatggctggcgtccctcaagctaattagctaagctaagctaatgaattgaaacctctcgataatctcgttcttgtcagaaaccaatcaagcgagacgggattaagcggcagctctacgttggccttagcattgcagaactgcaggtcgcttagcttagcgcttaggcaggagatagcgagcgagggaggcagtggagagggaagctagagggtgagaggcgataagaggataagggatatatagctgcttctagctagctagcaaagctgagagttgcagcttctactaactctgaacctcaagcactgttttctctgcagaacggaataggacaaagggtgaaccggtgaagtgtttggtgaattattttagtctaaattaatactacctctgcttttttaatagatgacgtcgttaattttctgccacacgtttgaccatccgtcttattcaaaaatacgtaattataatttattttgttgtgagttattttatccctcaaaatactttaaacatgatttatatcttatacttctgcataatctattatattattaaaacagccttaaatgaaggcaccactttgccgccgtgggggctagaaattcccacattaatcggagaaaaagaaaaggagagtccaaatagaaatacaatttaaaaatagctgaattcggaattaaaaataagtaatattgaaagaaaactccatataggaacccaatatgagattaatcgaaattcagaataaaaataaaataaaatctgaaaatagaaaaaaattaagagtctaagtaggaatacaatttaaaaataattgaaattcgaaatttaaaataaggaatattgagagaagagtccatataaaaacccaaagcgagattaattaatattcagaataaaaataaaaataaaatccaaaattagcaaaacgaaaagaagagttcaagtaggaatacaatttgaaaataactgaaattcataattaaaaataagcaatattgaaagaagaattcatataagaacctaatacgagattaattaaaattcaaaataaaaataaaataatatcaaaaattagaaaaattaaaagagagttaaagtaggaatacaattttgaaacaactaaaattcaaaaataaaaaataaaaatattaaaagaacactatacagtattaattaaaatttgaaaaaaaaataaattctgaaattagaaaaagaaaaaatattttagttaggaatacaatttataaataactaaaattggtgagaaaaaataaagactattgaaagagaagaccatctaaaataaatgacgaggtaaattaagtaacaagcctataaaggagtagagtggtgacggttgatacgacgtataaaaactgttaataaaacaccaaatagaatcctaatgacgattaaaaggagggacgacaggcaggccatgaagcaaacaggcaagacggttgccgggacttctagaaagtaaaaaaaaacccgttgataatcatattcggtttttaaaatctcaatgacagtaaaaaggagaagcagcgggcggggtgtataagagtatagttgcagagctgttaactgttggcgggacttcttaaaaataaaaaataaattccaacgatagttatgttcgatttttagaatcccaatgaaaacaaagagtaggcggcggatgggtcgtaggggagtatagtggtatcgtttgacgggacttctaaaaattataaaaaataaaacccaacaagaaaataaactctaaaaactacaaagtccaatttctaaaggttcggaacttcttaaaaggtaaaaaaacaatgataattatgttcgattttaatatctcaatgacactaaagaagggagccagcgggcgagccataaaggagtacaatggcaaagccgctgacagtttggcgagacttctaaaaagtaaaaaaatgaacctgaacaataattatgttcgatttttaaaatcccaaacaataaagagaaaaagacagtggacggaccgtagaggaatattatggcagcgtttgacgggacttttacaaattataaaaacgaaacccaacgagacaataaactctaaaaactataagatccaattgtttaagatttaaaggataattaatagaaataatggtagattgagcgagcaaataaagaaggatatggcagaagtaaggggtagcagctggtgtgacttttaaaaactatataattagaaatacggagatgataaggtttggtctttcaaagtcttaagacaacaagatagctatttaataaattttaagcaaaatcatactgaaaatatatgattttgcttgggtgttagccgctcaattacgcggggcacctagctagttttcttttaataagacaaatggttaaatatgtgttcaaaaatcaacggctttatctattaaaaaacagagatagtatgatatatagtggaatttacaaagaatttaatttcgtggggtagtatatttacatgtgggccctagaataatataatcaaacggtgtgccatatgctgatatgtaattaatattagactggttttgttgtatatttttgtatggagaacaactttataagtggaacacgataagcagctaaaaaggtgtttagcatatatattttcaatagaaatttagtggggttgtagatttgccatcgatgtgcctagtgtgtgtgagtgtttcatgtaaacacaatactataggaaaattttaaacaaaagaagcagtactaaaatactatagggttacagcgatgttttgttttgggatttgaattcttggtagatatagtcaaggctactattgcatatagcagtgttggttaatgggtgctgtaaaaaaattgacattgcaaataagcatttcctggagagcaagtaattgaggtgagaattgtgtgtgaaactcgggcgctttctaaatagatgttgaaaacttgcacgcaaaaggagaaacgtgattggcatataatcagtttagtaagaaatgatcaataaatttatttggatttttcaaaacaacttctatataaaaattagaagaaaaaaacacacactgtttagcagctttaaaatcgtgctaatgaaaatcgagaaagtagccaagccgaatcctggtttagaacatggcgtaattaattagtggttcgtgtgctgctgatggaggtagctaaaccgaggctggaaagggaaagagagaacaaataatcaagggaggatggagaggcgagtcgagttgagtttgtagtttgtagggttgcgccgcgcgcgtacgtgtggtgagagcaacggggggatggagaggaaggggatgaggtggattttcttggaaggacacgattggggcgaaccaatggccagcagaggcctcatcctcgtctctccctatcggggatttcggccccccaaaatctgcagcgtcgcgccgccatgtcacccccttgcgcccccaccccacccaaaatcccctcgtcgtcccgtcgcgcgcggccgcttcccctgcccccacaaagggtatgcgtatggccttggccatacacatctcggcctcctcctatcccgtccttggtcgcgctcgcactcgcactcgcgtcgcgtccatccatttctcaccgcgggcgcgtgtgcggcagcgcccgcagttctccgcacggacggtggctggtggccgacgtttttcaccgcgccggccgccggggcccggggccaggctgagcggtcggtgaggcgtaggtgtaccgttcaaaaagtctacctatgccggccttggagcgttgtgctggacatggacatggacatggccatgaaaactctgcccttctctgcagctttaatcgagcagagcagaaaaaacgaggcaatgcgtggaattctgtgaggagaggcagagaaaacggagcatctctctcggcctctagactttctttttgggcctgaaaccacgacggccctttgttccctcgaaaggcccatcacgcgtcttccttacgtgggccgttgccttatccagcccagaaggccggcagccgaaattgcgttcttctacgtgggaggaaaaagtacacgaaaaggtccctcaacttatcatcaagatacaaaatcatccctcaacagcaaaaacatatatgcggcatccttacttaacaatcggtcacaataaattcttcagtggttttgattccggttttatcctacctgacagctaagtcagcgtgggatccacgtagactccacctatcaggatgctacgtcatctctctcccttcctcctcctctctctctctctcctctcctctcctgtcctctcctcttctcttctcctctcctcttctgtgggcaagccggccggcggctggggaggaggccgccggggcgaggcgggagaggagggcggcggcggcagccttcgcagtgggggaagctgccgccggcggacgcgtcgaggtattgctgcagcggaggaggacgacgaggaggagatggggctcgtgaggtcgagctcggtctccgcgacggcagtggaggaaaaagcggcggccgtgacggcgaaggcgtggtggggttggcacttcccgagcccgctcaaggcgttccggcaccggagatcatcggcgagcatgccggagtgaggggggattacaggagatttttccttttccctttttttggcttcgcgtgctaatcttatgattaagttagaccaaactccaaagcctgtgatttgggcgtaatgtgtgcatatactcctaccagtggtgttgttcattgttctcttcgtgcttttgctcctttttagagtgcttgcaaacgttgtagcctgtgtacatcaaattgggaattttaaggtcgctgatttgatctgcaccaggagtttcttttttctctttttcgacactgacggaatgtagattgtgcgttgtttttctttcagattggagtgccggtggtggccatcgtcctgtccggcagcgcggcggcgcccgacagcggcgtcgacggatcgtaccgtcggacgacggaggcgagcggcgaaaaggctacaacgttcactggcaagcggcgagcgggtgggcagcaacggcagcgcagctacgccgcacttggcaagcctcacgttcaccgacttgcccttcgccaccacatagatgttgcagtagtccgacgcgcccttcatcaggctgcacggcatggcggcggcaacgaggatgcgggcggcggcgttgcctccgccggcgcgacgccggccgccggacctcctcctctgccctccccccctcccccggcggcctcctccccacagcgccgcccgtcgtcggcctcagaaaagtgagagagaggaggggaaagagagagaggtgatgacatggcttactaacatgtggggcccacacgggtcctacgctgactcagccgccatgtaggacaaaaccagggtcaaaactcaaaaccaccgaagcaaacggttttgtaagctgagggatttcatatatccggttttgtagttggaggacgattttgtaactcgatgacaagttaagagaccttcggtgtactttttcctacgtgggatgctgctggtggacggacacaagacgagacgctgcccatccgaattatgcttatgaaacaaactgataagtcaacttgacctccctcatgtcttgctcgtattgaaccatctacctcaattgtaaaatcggacttaatgtttacgccataatttggctcacggttgatttcatttgagcaggccagattatttagaatagttggtgcaatcgttgggtggtgtgcttaagaattggttagcttgatatgtgcaggaatttgtgatgcacctgaaggtgtacgagttgctggggagctgcagcgtttggatcggcgtggtgatgcatgtgctgctacgaccgggagttcctgctgtgcattgtgtacatgctggattgatttgatcatatatatgcattcagagatttggtgatgaagctttgatgattgcatgccgaataagatatagtagtattccatattttactagttggtttgtttagattgagtagtatacgatgcaccatcctgtcaggcgaggaagccatccgtgaagtaggaggccagccgtcaccttacttggctgtacccacattgcccacatcattgtatctgcacccgacttcaatgggggacctctttcaaggacgagcgtgtggcgacatgtgctacagcggtgggtgtcgtcgccacaggcgatggtgataccctgtggctctctccccgcctctctgggaggaaccagatgcgtcaccagaggtcaacgagatcacgctctcgatggaggtgttccttctatgtgtcaggcccatcactgcccacttctacccgtcgaccgcgtcctctggcgcagtgacggacccctccagtagaggcgacgccagagcaacacatggaggtgccgctgtttggggctcgagagaggagtaggctgaaaagtaggtcccactgtattttttaaaaaattttactcttatcacttagatatggatcccacttctatttttaacctctttaatgaatgggttaccttgttagaacaggggaccaagtcaacctatcacataagcataaatcgtttcccaaaccacagaaagaagtcgatttgtaccggtttttgaaattgagggagacattatacctagttttatgcttgagggatgcgattcgactagagcaagacatgagggaggaaaaataaacttattctgcctacgaatcatctgtctttcacattgggccaattatcagcactgacaaaagaggcttatactagcatgtttgcatagttatatttttcatagacaatgccgaaagagagatgatttttttttcttttttagattacacggtagacgcacacgcacgcacacaacactatagatgcaacactacactcacacatccttgaatgcgtctctgatacccgttcctgatcttaacaaatttatgttgaaagcccatttatatgtgcgtagtacttgtggaaactagaatttgaactgatgtgtaaattcatacacccacaactctaccatcagtccatcacaccactagtgtttctcctaaatcaggatatgatgaactatatataggtgtttagagcttttgtggagcttaattatggtctaattgaatggaccatattatatatgcatgttatttgtctttaaaagaagattatattgtatgtcagaatagagtttaagtgatacaaaagctatatacaagatggaatcaaggggcaggtaaaggttcgtgctttaaggtcaaactcgtggtggtggtgcagcggggaaagaaaagcggtgatgttgtcccctcctcatgaccacactagtgtctcctcctccatcatagggcactcgtagtgcgtttcacccatatataagacctcggagtgccacataggctccatgggttcaaaatctgggttcttcacagtgcaattggctataggagtgattttaattttatatttcacccctaatacttcatgtttcagttcttatgctttttctaatttacatagaagtaccaaattacgtattgcacaccctaaaatccagaaaagaatataaaatccactcaccaccttctctctctcccttatcccctccctccctctcagttcccacaatgcacggcacgacgaacagcggtgacacccgctcctctccgtcaccgccggccacgaccctcttctcctccaacccagatcaatgaccctccacccttagtgcaccgatgagctcgacggcgtggactcggtgtgggagagagggatggcgggagctccgtggcgcagatctagcggtgggatgagctcccctctctgtcggaccgcgtcactgctgcctctcccctctctctcaggcaatgactcatgtcctcaccatcggatggggtggatctagcgagcgtcacctccatctctcttctcgatccgaagttgtcggatgctggctgtcaatctggcgctgcaggagaacggccaggggcaagggtgtggtgctgttgggcaatgagcagattgggctgatcagctccaggtcgtccccacccacccaccctctcccctctctcacacacacctcacacgcttttggccacgaggccatcgatagctttcctcgatgaaactgttttttttttttgacgaggccatcggtactgataacaatccggcccaggtggggttggccgagacccaataacttaaggttgctcggaccccaacagttctttggcataagcccgatctccctaaaagactagtccaataggggaagagtggcttgctaagcaaggtgagattatttagaggctcacacggtcgccgcccgactttagcgtctttgccagcgggtaatagtggaggatgtcctcatcagataccaacagaggatgcgaggactccacaaaaacatggtccccatcccttttcttctccacacatgcaatctgtctatgtggacaaacaatgccactgtgaaatgaccttacattcttacccaacattgagcttggcgtcaaagcaatgttttgttgtgtttcgctccttccaaatttcgcggtggctactaatatctattgaattgatatgttctaagggctgggcgtgaaatccacatgtaggtaggctgatttgtagtaacaaataacgaggagagtatatatgcactgttgaacggaaaatcatgcgtgcgttgaacttgggagtcatatataaggaccacaatgcccctgcaaatggacgaagttccgtttgtctcctaccttttggaccccagcaagagcactgtgcacagcatcgcacacacaaagctggccatatcggtgcatcggccattgggcctaacagtgtcacatggccgtcaacaaacgccaagcgacccaccgctaaaaacacaacacacggccgttttcagtcggccggcttgtcagccaggatgtgtacaagcaaaaggtcctgcatatgtggatattagtgaatttcagccatgcataacttaagcctaccctaatggattatattcatgctacgacattgtcaggtgtataggaattgctagatatatcttagatgataaaattactaagaatctcagtcacattaaaacctagcactagattgagggaagaaggggaggaactcaccaacaataatgacatgaaagtccgctagaaaaaaaacctagagtttagattttggggcgaggggtgacactgggtaacgactacaccagcatgaggatggtggaggccgtaggactaagaggagatcgttataatctctttttcactcttgtcaagtatttttactttcctttttctagaataaacaaaccttagagaaataactaaataattctctcgagttttcctttcatttgctcaatttcgtatttacgatttctcctatttagcttctttttttttttaccatttcagagttttcccttggtctaaatttgttatcataggataggtcaaatcttatcctagataggattattttgggatgcatgtagtagttttttttttttgataattttctttaaaaaaacaaaagcagtgccccaaagagagtgaaaactaaccaagatgttacaggatttccatataagcacttagttttatactgcatacattagctaagcacaatttaatacaatatttaagcagttaataagttttccatagtcaaaattgtgttagccattttttagcaaataaggctagagttgattccttttctggttttttggttgggagaaagctgtaattttatctcgcaacttgtatgcgaggacgctttgattgagtaatacatttctttcttccaaataaaaatgcagcaaattaaaacccaggcacccagcctagaaaaaaggcactgtcgacgctcaccagttgatgcgatggtgactgtgcaaagtgcaaagcacaccatgcaatataatgcaacatcacaagaacgcaggatgatattggctctgctggtccctgcttgatcttctttgacgtctcgtccattaacacgataaaccgctcgctcacacagaagattccacctgctgcacagtcgcccccacctcaattcctccgatccgtgaacccccaattccaagaaagaacaaagcaaaaagtctttttctattttacaaggtaaaatatctttgctctttcatgttaagggttaaaaaaagaaaagtgaattacactttgtgttagaggagatagcgctccagttttgagcagcaaaagagctggagctcgagtgagcttagggaggatgggtggggattccctggagttcactccaactccacccgatagatatttgatcaaatctcagtcgtctctgtataacaacggttgggatgaactaactaattcccactagtttttttttcttcatcctaatatttgtaacaaatcaatgaatactatatatctatatatctaaagaatatacaaactaattttacttgcataacctagaaatttcatggttcatccacaatataaaaatcatattgggcttgtggctctaatgttttagcaatatgtttgtgtgtatattgtttatgcatgtttgcacgtactaaatgtttaacatagttctatacatgaccatagcttcttgtttggagaagaagagagcgtgcaaactttgttaatgttgttggcagaaacatactcattaggaacataaaaagaagaaaaggtaagtaattttcattcaagcatatgtgattgagggagttaattaatataagttaatacgtggcttcatcttagccataggaaacaattgatgtcatggatttggtcaaatccacctggtgaagttatagctaactctaagggatttggaccccatggaaacctcccctttctcgttttatttgttgccaaagagccaacttttttttaaaactaattttttttgttgccaaagagccaacttttttttgaaactattttttttatattttcaataagcatgagtaaaaacccctagacgggttacaagaaaagaaaaataaccaccagttggctgaatacacaaagcacacgccacaactcgctaacaactaaaaacactaacagagcccaacataaagtgtcgattccagacttgaccacgagcagcttaggaggttctgactttacaatcgtgtcatcgttgccaagcttgccgccaagcgacatagcaactctgacttcaagatgcaacatcgatatctagcacgctgccaatgatcaagaggcctcgacatcccacaatggactgccagaatggtcaagcgaccttgataccaaagagccaactagagcttgagcttagcctgctctgctttgctcagactttgtttggtctgagaggagagcaggaagagacctaaaagatatggataacaggttgaaatagaaacacttttgttaacttagctggttgaaagtgaaaagtgttgttaaacactagtccaagttaaaacattagtaaaaaaaagttgtccaatatgcaattcaccatattcatatatgttatgagttgtttagagtaaatcttttttttttcttgtcatgcatatgctcacacaccactacatataaacatctgagagtatgtcttttaataaattgaaagccaatacgcacatgcctaatatttgtagacatcttcttctatttaaggaaaataagccttaatggatagtcaaaccgttgtactcttgtgcttctcctattcatttcggagtaaattaaatgagcatagggaaacatcgcacttgtggaggtaaataattatatacacacgggtattgcttttcaatagaaatttgaagagtgcatgaaagattactagtgcgtgtagtggtgcatccgcacgtgtctctcctatgtaagccaaaaaaaaagtgaatgcaacttttttatttttcaataaaggcaatcgtgttatgtcacattgatcattttaaaaaatgtctattgattagtacattatattataaagagaaggtttgccattttagccaacaaagcttcattaccatgttgatcaagaaagagtaaatttcatataatgtatcacgtaactatagatttaacattaaatttatcacaaaactacaaatttaaggtggaatatcataaaactacaaatttatagtaacaaagttatcacaaaactaccgattgccaatttaatcataaaacttgaacatttataactcaaatataacattagtgctaagaatttaaacttcaaaatctatagttttgtgataaatatattactaaatccatagttttgcgatacttagccttaaaccggtagttttgtgataagtttatgttaatctgtagtttgtgatacattaccttaaatatgtagtttcgtgataatttagctcaaatatatgtagttatgtgaaatttactcttagaaaaagagagaaagatttacactatccgatcagggtgagtctaaattataataacgatatagattttctcaatatagttacataaaaaataattatatttaaatttgctttcaaaaattgttgctctaggaaaacggcgtggagaaatcagctagtgaacttaaatagtactccctccgttttttaatagatgacgccgttaactttttctcacatgtttgaccattcgtcttattcaaaaattttatgaaaatgtataagatataaatcacacttaaagtactatgagtgataaaacaactcataacaaaataaattataattacataaattttttgaataagaccaatggtcaaacatgtgagaaaaaatcaacggcgtcatctattaaaaaacggagggagtattagtacgtatgtacaatgtataacaactcagtcatcttacacctgactgaatttaaattctacaatctacatggcagaagtccatattttgcccatgtatatacgttcaaaacataataccagctggagtgcatgtagagatcttttaatttggtccatgccatgctgataaagcatgtttcttctacctttgctcacgatcccaatggctttaattatgtaccacgatgagaaagcattagatgcaatgaaacgcaagaaaaaagaagatgataaaaaagcagcaaatgaagggcccctgcctctacgccaaatctggtggtagatcaaccgcatgactgtcatgttaattaagcaagaaattccctttgcatttcatctcggtagaacacctgcctagctttcaaataaaaggaaggagattaccttactaacagcatgggagaaattttgatttttatttttaccattctgacacacctgagttgaaaattgcgaaatggagcagccattatatatgagcatgcaagatctgaataaaagcttcactgctttcactggagaccaaaactggctctctttcacaagacattctccattttctttcttctcttcactcacactcacactcacaagagagtaagtgagctagcgagtcacaggtttgctccaaagctgagccaccccatcccatcctctggactcatctgcttggctctcctcacaccacccttggattcttgcacttgggagcaagctatagctttgctttgccttcctctcttcaaccctcactctcagcattgttaagctcaggatttggccacctttctcctatagggatcacacaaacaccggtagaaaaaagctcttcttggagctctctgcttggcctctctctctttagtttagccgcaaacaatttcctctcattttttctttgatggccgcgttgcatgggcatggcttcgcggtcaccgtgctactggtggtgttgttggtgcaatgtgacgcggcggaggcgacgacgtgcgccggtgcggtgccggcgaggccacggccggagacggtgtccatcgccgagttcggcggcgtgggcgacggccggacggtgaacacgtgggcgttccacaaggcagtgtaccgcatccagcaccagcgccgccgcggcggcaccacgctgctcgtgccggccggaacgtggctcaccggcagcttcaacctcaccagccacatgaccctcttcctcgccaggggcgccgtcctcaaggccacacaggtctcactctcacctcgccaccgccatggccatgtttttcttttcctctcttcttcttggtggtgagtggtgtcgttgacatcgacgcaggagacgaggagctggccgctggcggagccgctgccgtcgtacggaagggggagggagctgccgggggcgaggtacaccagcttcatccacggcgacggcctccgcgacatcgtgattacaggtgaagaattgaagctcagcttagctcagctccggtatttctagttgttgcatggtggtagcttctctgctgctcactttctcccctgttgttttggtatactgtgttcttgtgatggtcttgattgtcaattcttaagtctcaaccaactaactttggtctcctggtcagagaatattcaaagagacatgcatacatcctgcaaaaaagaattctgcacacaccgaggaaaaaaagattatatgatagcatgggagtgagtgactaaaggaagactactttgttgcttacacgcatcagacataatagggtaataaataaaaggaaccgaaaagataatagacctagttaacgcaactttagataaatagtagtaagggatttgtccatcatggttaaaatatgtactcttccatggtggtttgtcagaggtttgttattttaaggtttaggccattactgagagatttagaatacaaacataccttggtgggtagcacggtggacgacctgttgtcggtaaagttgaatcttgctcctgttccatatctagtggatgtacatgcatgccaagaacaggaaatggaacagtgaactgatttgattctgtaccactctggtacagtttacatcacttctactattaagttggtgactggtttaagccagcattatatgctcaagcagacaacaagcagtcaggcttactctcaccaggcaactgaactaactgtgctcttatttcgtctgtagcaattttctctgactgttcctgcaaaagaactcattaaaattgatgcaagtaattaacatgtcagattttttttatattaaaaaaaaaggtgacaagggaatcatcgatggacaaggtgatgtatggtggaacatgtggaggcaaaggacacttcagcataccaggcccaaccttctggaattcatgcattccagtggcattcacatctccaacattgttctcaagaattcacccttctggaacatccatcctgtttattgcgagtaagcacacgcttgaaagttgaaatgttcatctccttcctgcaaaaatttgtcactgcttaatatttctttcagagcaatgttggaaggccgaaaaatagttgatatgtgaaaatttcaatacaatccattatggaatagttaccagaaataagaaatcttgtgacacagctacaaaattcttgagaatgttcagtttcaaatgcccatttatgctgaaatactgatccaattcattttctacacccagcaatgtggtcataaccaacatgatgatcatcgcaccacatgactcgcccaacaccgatggagttgatccaggtatgcaaattcatcttaagcttctggcacacaaacaaaccacatataaattgattaatttttctttgctacatgcctgaccatccaagagtacatggaacatgctaataatactgaatcctcccacagattctagcaccaacgtatgcatcgaggactcctacatctcaaccggcgacgatctcgtggccatcaagagcggctgggacgagtacggcatcgcctacgggcggccgagctcgggcatcaccatcaggcgcgtcaggggctcgtcccccttcagcggcatcgccatcggcagcgaggcatcgggaggcgtcagcaacgtgctggtggaggactgcagcatcttcaacagcggctacggcatccacatcaagaccaacattgggaggggcggcatcatcaggaacatcaccgttgacaacgtccgcatgaacagcgtccgcaacgggctgcgcatcgccggcgatgtcggtgaccacccagatgagcacttcagccagctcgcgctgcccaccgtggatgctgtcagcatcaagaacgtgtggggtgtcaatgtgcagcagcccgggtcgatcgaggggatcaggaactcgccgttcacgaggatatgcctcgccaacgtgaagctgtttgggtggaggaataatgcagcttggaagtgcagggacgtccatggcgcggcgctgggtgtgcagccggggccgtgtgcagagctcacgaccagcctttcttcagggttctgcagctattagtgtgatccagttgtataatgttttttgattagaaaggttgtgcttgctttttttttaggtttgactgctccctaattgtggttgggattgatcaatatgttaggcttgtgctaatcagttaaggagttttaggtgtctttttgttagagaaaggtttggcttctaagttgtcagtctgagtgcaaatatgttctaatctgaataataaatcccagcttgtgtgagattaatactccgtcagacttgtgatcaaatgagagttgaatgtgcacatttttactcctaatttatctgttggctgttccacaaacaattctagggtcatcagaggcggctcaatggatgaggaaggaggctctctgcaagaggcgattagattttttttttttgagaccaagaggcgattagattgggtctactcaatcagaacaaaggatataatccaacagctaacctacaaagataagtcagtgtgcgtatcaaaaattggaaatggataggatatggtacaagcactgatcgaaaattcctgtttcgtttgtcaggtacttctatatgattgtgatactgacataatatgtgctactaacattctcatttggacaatttctactctgataactgtactatactttaggaaatgtgttctgaaaactgtggcagcaaatcttccagttcatgatcctaataatgatagttcaatcaaagacactaacaacatctaaaatcaagatgtaaatggaaacaaaaacactctggacaggataaaacaaagaaaaaagggctgcgcttcaaaagtaatactcccgggataatgtaatccctaatcttactgctctaaattaaacccccttttccactgacgatgattaacaaaagctaatccccagatacttgttaaacctgctattagtccttgctacttatgcatcatatatataatatccagaaattttagtactctagcagatagtatgattcagcgttcgtacccatagggttagctcgcgatcagatctcgcaggcgcagcgccagcctagatcggatctcggcatccatctcgatccccctaatctctcgtcttcatcctcctcggcaagctcgtcaccggccggatcgagcccgaaacggcgcccggatccagccgatccgccgcctccggggaaccctccatcgacggcggcggtgggtggggacggcggcggggatgggtgggtgggtcccgctcgtcggaacgggacgaactgctcactagtgggccccaaaaatgcccagatgggaggagaggtcaaacgggctgttattgggccgggtccgtctggccacctcgatctgatccgatccgtttaattacggtttcttttctctcttatttctataaagctaatgcccactaaacacctaaatcttaacatgcaagcatagtatttattagcactcctaaaacctacaaacaagtatgccacatcaacctattaagcacacaaagcttaacatgcaagcctacagtaattatatctacactttattttattttattctaaaattaaacatacacatgctaaatcatcattctcaaattattttcataatatttcaatccaaatcatttcatcatttctctaatattctaatatgtatcccgcagcaaagcacgggttatcgtctagttattattactaggagtatcttagactaaacattagcttgattaagctctcaactactccataataataacattacgacgtgatgatcctttttgtttgaaactttacaacacgtacgatcttggtttggtcagtctggaatggccggtggttcccttgtcaaacccaaattgcgcacgcaatgacgtatatatatcaggaatcaaatcaaatgctcttccgaggcttaaaagattcatcgaatttttaaaagataaaaaatgtcggggggaaaagagtgaccttaccattggttaatcaagcatggcacgcatttttctactcttgtgttctccgtcaggttcgctgatcgatgtgtgtgtctgatgtaccaaattgttagtggtatactagttttttttaggggatttttttttttttgaggggaagttagtggtatagttgcaatcaaatgctgttagccggaaggataaacaatatgtgggtggatcgttgactcaaatcatcgtacatctagctgtgtgcacgctcttgtgcagagatggctcactgataaaaaaaattatgaggatttgttgtacgacaaacatatacatatggagtactccatgaagaacaacctaactgtacacaacagaatagtattaaccaaacacattcttcactttggccttgtttgaatcctctgtgctattaaatatctctacggaatcttactatttagaagtattaaacgtacattactgacaaaatccattccataacccctaggctattttgcgagacgaatctattgaggtatgttaatccatggttaatggatgatcactgtaacccactggtagagaaggagtttttactcccggttcgtaaccccctatagtcccggttttccaaccgggactatgaatccgagactaaagatcgctatctttagttccgggtgaaaaaaccgggagtaaaaatccattttttttcccggttggtgttaccaaccgggactaaagatactaacaccaaccgggactaaagaggctagatccggttgctactttattctatttttttctttattgtttttaatatattgattcactctatcccatcccaaaatcccaaatcaatcatccccgaatagtctctaaattctcaaatcaatatctctaaatacatcacaaaatcttaaaaaaattacatcacaacttctacaaaattcatgacaaatacatcacatattcacatcacacacaaatcaaatacatcacacacaaatcatttcagatccgaatcacagaa

SEQ ID NO: 60635 - DNA, 8917 bp, Oryza sativa
gcggcggaaggcggcggcgacggggatgtcgtcgcgggcgaaggacgtggtcgaggcgggagtggctccttaaccagtcgacgccggcggggcggaggagccactcggcggcggagggcgccttcccgcgcctcccacccccaccaccgccaccgccgccgccgccgccgccggaaaagtaccccctcgcgcgcaggtggaacaaatcccccggcggcgaggcccacccattggcgcccctctccaggtccacctgcctcagcgatgcgcccgacaccgcctcctccctccacccctgctgctgctgctcctccgcctgctccctcctggggctcatcgccgccggcgaggggagagccaataaaagaaaaaccaaaaaagaaaaaaaaaggaagggatttttggttgggggaggagagcaggtgggttcggtgtttttgcgcgaatggagggaggagttgggggtcgctgcttcttcttccagctctacctataaaacagtgggaaagaaaaggaaaaaggaatttttgatgcgtgattcgtagaggaaccaaaataaaggtctcgcctttgctttgaagcacctctccccctccctaatttgcacttctcttgttgattatcttgatgtttctatttttttttctcgaaacacgggacaaacgcggatgctagaatacatacgtgtacagtcatctacagattgatggatcatcgtgaggttttttcttccttccgaaacatgagacaagcatggatcgcgaatgctaagagggtgtttgggtgaaagtttagtccctctcacccagacaccccctaatatatatacgtgtacactcatttgtagattgatcgatcatcgtgaggttttttcttccttcccaaacatgagacaagcatggatgctagtatacatacgtgtacactcgtatctagatttatcatcgcaatgttttattttcgaatgcggttactcgaatatttatgtagttatgtacatactcatctccataaatataatatgagcaaaaagaaaaaaaaactcttgtctttgcatttaagcatctctcgtcctccctaatttgcccttctttcgttgaatatcatgactttttttcgaaacacaagataaaagcggatgctaatatatatacttgtacacttttctatagattgctgactatgattttttttctcaaaacacgggacaaacgtggatgctagtatacatatgtgtacagtacactcatgtagatttatcaccacgatgtttctttttcttctcagaacatgcggacgcggatgctcatatatatacgtgtacacatctctataaacataacatacgcaaaggaaaaagcccttacctttgcgtttaagcatctctcgtccttcctaaattgcacttatcatgatgtttttttcgaaacacgggacaaacacagatgtccaatgtgatatttttttccctaaacacacgacaaacgtggacgctagtataccaatgtgtaacccaccctcccctcccccactcccagtatacacatgtgtacacatctctataaaacgtaacacgcgtaaaaaaaagctctcacctctacgtttaagcatttctcctcctctctaatttgcgcttccgtgttgattaccatgatggttttttttcaaaacatgggatagacaaggatgctggtatatatacgcgtacacttatcttcataaacttaacaagtagattctattcatttgatcacctccaaaaaaaaaatggactattgacgaagtaccttggtgtgttagcattgtttttcttcaactagtaattaccaattataatgcgtgatacacgttgcactatccatgaaatttatcataatttttagataatccgtatgtaacaatttatgatgatcacaaacacggttaacgttttcgactaacaaagaccaaaaaaccccatgaaatatagaggtttcgatgcagtacaaaagcagattctatgaaattcggaatggttttcaataattcaaatttaagacagtaaaatcagccaaaatttgattaaaatttagtgaaatttaacaaaaaaaaactgtcatgtcgctatggtcgatcggaatccggcactcaatcagaagggtaaaccataatccgtgagcgtataagaaaaccggcgaggagtcgtaggaagaaacaacagacgagtaagcgatagatagttggatctcgaatttgcgttgctgccttcgtgggaacgaacggtcgccacgccttcgcctgcgtacgtgcttgtcctgtccggcgacggcgacggcggcggcggtggcgaggatccacgtacgctgacatgtggggacacacggcggcgccgtacgccggcgcgtggactcgcgacacgtgtacatgcgacggaacagttgaggggttggatctgaatcatctgatctgatcacgagatgcgatcgtgcgatgcgccaccgacaagattcgggggggtcgtagtgcctcttatcgcatcgaccgtccagtctccatccgacggtccgaaagtaggacacgtcgaacaatgcatatacatactgtacatgattacgcctacgtgtgtcagcaacagtatttttctttataattacacaatgcaacttagacactcccaacgtatgggcactcacccctatgaacacacgcacacaaaccctacccagagcatcttcgaagactgcctaccactgaaagcacaatgccgataaatccgcgaagattgcctaccactgaaagcacaacgccgataaatcctgaaaaattcgctcccatatagagtcgaacctaagatctaaggtgctactgagtttcttgtaaccattaggctataggccctttcgcgtgtcagcaacagtattatggctgaaggagccgcaagcactcaccaattgtacatgcatggccgtttgcttggcaaatacagaatcacatgatacatcaatttttcaacttgcacgagataaaaagtgactgcttaattgggcatgcaaattttcaacgcaactatgcacatcatttgtactgttgtacaatacttgcgcaatggactgacaactgatggaagtatatataatcgaaactggaagtactccttcctccatttcagaatgtaagactttctagcattatctatattcatgtagatgttaatgaatctaaacacatgtatatgcttagattcattaatattcatatgaatataagcaatgctagaaagtcttactttaagaaacggatggagtacttaagagtgcttagcaatctttaccttttcattcctgttttattaaaaaccgaccaaaaaggtaaaacccgataactttcgataaacgtcatataaaaaccgactaatatcgatcggttttcatatattgagatctaatcggtttagtgaaccctcatactatgtatagctactaataataaggtagcagttggcagttgtgagtcgtctctgctacttcttcagttagcgtcaagatgtgaggccagatcaagatggcagtttaaagcatccacagctagctaagctccatggtcgacggagtaaggctacagtacacaaacatgtggatatcggtttataataatcttgcgacgaaattagtagtatatcgagactcgtgtctgttgaatctatccattatcaaacaccagtggccggcgtgttgtgtccatgtgcaacaacagtataaattatacctcctggcactgacaatctcctcttaaactttcccattctttgacaaaatattgaaatgagagctgaccgatttatgaagaagaagcagggcctgtttggcagctcaagctccagcttcatcctttctggagctgaagctcagccaaacagttttagctccaccaaaactgagagtagagctgggtgaagttctctcacaaaataaactagagttgtggagttgggtttaggcagctctataactccactccagacccaactcctagagctaatttagaagttggagctgtaccaaacaggcccgcaatctactcctatctctgttcttgccttgatccatcctctttaaccaactttgtgaatactgaacaattcagtctgaaagttacaatacccttgaatactactccctccatcccaaaaaagacaaaccatgggtttccgtgtccaacttttgaccgtccgttttatttgaaaaaattatgaaaaaaattaaaaagacaagtcacgcataaagtattaatcatgttttatcatctaacaacaatgaaaatactaatttaaaaaaaagttcatataagacgaacagtcaaatgttggacacggaaacccaggatttgtcttcttttttttggatggagggagtactttgaacgaaatgcatgcctctgaatattattattaaagtaaatttcagaaaatcctatattttatggtcataatgcatgaagtattaagcataaatttgatcataaaacatggagtagtattaagcataacttagaaatgcctagctaacaagttgcagttggttaggctgccaaatgattggccaatcgagccaatgcaactgcaagcagcggccagaattatgcgatcgatcggcgagcacatgcacacccacttgcagtgcagctagcaaaacattggacagcgcatttatgcatgcacaccggccggcgcggttggattcaaactcaaacatggcaaaaacatctttgaataatccacggagaaacaaatgttcagtcagtctttgcattggaatgctagccatcggcagccagttgcctctttctttctatcagctacaactactcttttttatcttaaaatataataatttacaacattctaataataaaatactataacttcttctcctcgtaatcgggattgcctacacatttgtcgggtgatttttaacaagaaatcacccatattttttttacacttagatttatatccaacggactacaaaataaaataactaatacaaatttacttattcaatatttttatcaaaattatagtgcacttacatatcatatcaactaaatttacatatgtaattttagttatataggactgtaattttatattttaaatacttacatgtcatatctactgaatttacaaatgtaattttagttatataggactgtaattttatattttaaagaaaataacaaatacatatttacttacactttatttttataaaaattacagtgcacttacatgtcatatcaactgaatttacaaatgtaattttagttatataggactgtaattctatattttaaagaaaataacaaatacatatttacttacactttatttttatcaaaattacagtgcacttgcatatcatatcaactgaatttacaaatgtaattttagttatatatgtctgtaattttagttacatataagttacagtgtaattacactataattatattgtaattacatctgtcaaatttctaaaaaaaaattatcggcaaatataaaaaaattgaatagaacaggtttctagagatggtagatttgttgggcatggccgcatggtggtgtaatctagaaggtcgtcccgtccggcgatcgtctccactcctcatgcccaaagggacgagcacagtgcgaacaagatcatcccgaccggctgaccacgcatgcagcctccaccatcgtgcggtcagcaaatccgtgaaatcaccgggaaaaaatcacacgacagatttctagcgaaatcgaaagtgaaatgtacaataccccatgagaatcatgcatgttctaaaatataacttctcctcccgctagtaatatttaactattcaaactcttcacatactttctcatctcaaccaatcataacattatcataaaattttaccatttcttaaaaacattatcataacaatttaccatatttttagaaaactaaaagggaaataataccccatgagaattgggggttcaaaattacagaacaaaatcagttctatcgccccccccccctcctgatacaatattatttcgtctgagatttttttaatttggtaatatttgttcaaatttgtttgaattttgtttaaaaaaaatcaaataactgtggaccaaaataatcaaaatttcagccatattgttacccctgatacaaatggctaaaataattaaataaagatcgaaccttgaaaatcatgctagggtcagcattcgaatccaggtgggctcgacgaacaccctcgcaccacgctagagctatgctcagttgtcaacaatttactatttaattttacttattttcttaatactcttatctaattttaaaatctctttggacggaagagattagctagctttcttctttctcctgctgctgctgatgcatatactgtcatatactgtatgagcttgttttattcgctaatgcgtttgcttaagccaatcgttagacagagagacagcagccaagtggacagaaaaacagcagcagcagcacacgcatgcgtgatcacctggctgtattctctcctctctcctctgcgctggtcgcagttgttgccagcagggagttcagatgattgttttgatctgaataattcagatttcaggctggtcttaaacattttggagatgggaagtttacaggaaatctttgctgctgctctcttctggatgatttgtccacttgtcagaagtgaagcaacatctagcttgaagcataagcgcaggaaaacaaatctgaaagacctaattagctgtaattgtaaggcataataacttcgaaaaggtaaatcgtaaagagacagtaagcaatggcttaacagatacccattctatggatgtcatcttcagtttattcccaaggaacaaagtatgtgcatctcatattcttatgccattatgtgctcatctttactttctttttcaagtatatggccccatctttccgttcaagaaaaatctgaaaatgtttatggcctcgtctgctgaaacaggagttgaacaagagtggccgaaaaccgaggcagtgaggaagcacatgggcttgtacgaatgtacaaccagactatgtttcatttaggcctgattgctaagcccatttatttaaattggattatttctgggccttctggtggagcacatgggcttgtacaattgtccaacacaagtttagactagattagtaggatgcctttattcatccttcttttttttttctgtaactgtcgctcgaataaagtcatttatcaactttgctggaagagtggaagattagcagtaatcagtgtagtggagtaagttctttctgtgttgtctcgtgatctgatataacatgctgaccacttgtaaacattgtaagtttgttacacactggcacaactcaggatcgatcattacaaggcagtacttttttttaaaataataataataataatctttgagcaacacaagccactgaaatcaggacaaccaagtgttgagactataggtaaacttctggttctattgtcaagccaacctcattaattagctgcctaacttttcatctttcctaatcttggtcatagtcaaacatgcacggaaattttttttttcttatcttaatcgtaatagtcaagcatgcacggacagcctcgtaaagaagattacacaagtgcaggtataaatttaacttgaaggatcatgttgatccattcaggcagtagcagcagctaaccaaccaaacaatgctgattcactgaagagtcaaggagatgggcaatttttcctctgttaggagcaactgatcaggacgagctaaactgatatctcatcacaagctacatgcatcaaaatccacttccttatcaatcgccacaatttcatgcataatcttgtaactacttcagggctcttcaattctttcagagatcagtaccaattgattaccaaatgatagtatgagccgcaaaagtggttgggaaaacactgcacttttgcgtctctgcattgcctgaagtttagcaaagctgttgaggcatgcgtatgcattgatcaacagaaagatcacaatgctggctagtgttatgattttcacaagtcaaacagaagaagttttgtgttcagctactctgaatttgagttttgttttttctgcatctactgttgttaagatctctgaaactcacgaatggtcgagattttcagggccgatttgtctcattagccgacgaaataaagtactactcccaaatgctttgatgatcccaaatgctgtccgattcaattgaaaagcctgatgaagtagtggggggagtttccatgttcttttctgtcataccagtgacctgctaccgaagtacatgcttgtgacatttcttggactatctgtacaccgatatactatccccagtctgtttgatcattctgcattacacagatatcccatcatgtgaaaaagaactatcttaatttacaccgctagtgatttctcttgggtgtaatcatatattcatatttgagagtaagaatgtctgaattcagaatttgaaatgtcgaaaagatgaaattttgagggagaaatgggttgaaatataggtgtgtgagggctctcccttttgagttgatcagaggtgtttcagtgtttgtcactaccggtatcttattttaaatcgctaatcgtttctcttggggacaacatatttatcactgcattcgagagtaagaacgcttgaattcagaattcgaaacctccaaaagatgagattttgagggagaaatggctctaaaatgtgagcatctgaggctttcactttctcttgagttgatcagaggtgtttgtcagtaccggtggtttggatggcaaaacacggccaggaccagggctacgtccatatcgcatca

SEQ ID NO: 60636 - DNA, 1094 bp, Oryza sativa
cgggcttggcgttgctcatccgtctcgttatcgcccataaagacgccgaaatagagaggggtgtagttgtcttataggctttcatcgaaatcgtcgagatccgggtcgttgttgcgaaaaccgaactcattgtactccacgatctcggtcggacgcgagtcgacggcgggagagctccagtagccatccagctggtccgtcgaaactgagccgagtggctggaggataacgccgacttccctggagctaggcgagatcggtgttgaagccgacttccgcctaggcctacgggatggggacgctgtggtggtgaagacggctgccaaatcgtcggggagcttcattaggatcggtgggtaagccccatcatctcgatctgatgacgttggagaagatgcaatctctcccgagtggtttgaagccgactcgattgagatggacttggagtagatttcagccgcgtttggaactccaaacgggactgagatccggctctctcccgactggtccgattccgagtcgaggagagagatcttgccgaagttattggtgacgaagtcgaggctgccgaaccgaaacgcctgcccgggtgggaagacgaggtcgtcgatgccggagacggaacccattgcactgatcggcgaaaagcttgacacaacccctacctggcgcgccaactgtcgaaacaagatttcggcaatactaaaagggggtggctatcaagctggaaaagtggatgggtttggagacaaaggatttatacaggttcaggccttcttattcaagaagtaataccctactcctgtccggggatgaatccgccgagtgtattattggatgtataatctccaagaaagttgatgtcccaggaacgactcggacccctccttatataggggaaggagtccgtattacaagggataactcatatccttatcagaatacgagagtacagataaaatacaatcgtaaccgactaagcctcagggtatttccttgacgtacaagttaagaaacaaacccgagatacaaataaagatattctatctatattcggtatcctatatccagtctaaatataatcgctgtgtaga

SEQ ID NO: 60637 - DNA, 4782 bp, Oryza sativa
attgaattgtcttttgactcgagtcatgctgtagttgctttaaagtgtcaaatctgttgttgcatcacttggagccaacaaaatatgtgttgcttgccctgccttgctctgattgcattatctgcctgagccatgtgtttttatgtatatgtttttctacttctaggaggttgctatcttgatagctgtgtctagttaacacagtaattgatgccttggtagcttaaattgctacttgtcatgttgctcgtcactcctcaaaagcaccatccagaatgctgctagttataacttgaatttttgaagcattgtacttttagattgggttgggggtttctcttcagtttcaactgtatatttaagctgctcaactaactgatcagtaggttacctgcatagctcaccattgcacctgtcatgcttatgtcttgaactatatttgcacaaaaataacacaattctcatgtttgcggcattggccagtttagcagcgggcctttcattatgcttgttgcatgaataaaatttagttgtactactatgtttgaagctggaatttgattgtgccatttagcaaaatttgattaaatgtcaacagaaactttttttcatttgttaaatatctagcctgcctttctctgttctctcaatgtgcatggctgctggaagtccagaaccaccatgtatgtacatggaagtgatgttgtctagccagccagtttgtttgaaccgggtcagagacctttttttttttaatttgtatgcttctgagcatccctgagtgaatcctttcaaaggaaagagaaaatcagtacatgaatactgactactgatctgttttaacaactactcctaattgctttggaactggagttggattctattgtatttcttgaccagattttgcctacatagaatagagttgtattatgtcaacgactcaaatgcctataatatccaataatcaatctacaccgttatactctggactcataacaatctaatggtgtaaatatttactttttccttcaattaatgtggtaatataatatatagagtgcacatgatgccttctttttgagctatttttataatctactccctccgtttcaggatgtaagatgttttcatttcgtcctaagtcaagcttctttaattgtgaccaaacatttaggaaaatgtggcaacatttataacaccaaattaatttcattatatccgccattgaacatatttttataatatatttgtttggtattggaaatgatgatacatttttctatgaacttggttaaacttgaaggagtttgacttgtaacaaaactagttgttacagtattgtggattgttatcctattctgtatagttccagctgttaaattgatgcctgtagggaggttgcaaccatatggttgacatcattacatgtcatggcacctaatccttaagagttgacatttctctgtctgcttgcatatctgctcgttaacaatgccatgatagtatttctgaaaacaacttcaattagtattagttttgtattttactactctcggcagtgaacaactgtttggattatatgctactgctttctatttatgatgttcatatatgagctactagggcactactgcatagtggtactctttgagttacagtttgtgttttttttccaccgtgataagttatcttaaatattgtgttcttgtaatttgattttggtgttagttatgtacattgtttcatatagttcagaaatttgagggttaatcataagcacataatagttcttgaccagagctttttgatatgtcaagtatttatagcctcaatctataacattagcaactgaaagttaaggcacaatctgaagtttaattcttggcgtaattgatacactaaacagtaagccaaccctttaatcaggagtgtcaactccagacaagagaggccccttttgggggctctgaacttcagtaagctagttacttcatcagatgcaaaacaatctttccatgagaattttgacaatgatggttgtactagattttaatagtggcataatcttttgcctctgaattttctcatatcttatgtgatatggcaacttggcaaagcatggacggaggtctgaaagataatttgttgcaaagcatagttataatgttaacatgccactttctaattagttttgctttatgcaaatgtgataacagtgttaacatattcacatcataagattttgcctattcaaattaatttgttttgtgcgcccgaagatccacattaccaagggactggatttaacagaaacttttatgttctgactattgattgcaccacctattgttaaaataaataaataaataaataaaaagacagcataaaagttcaactttaccctgtgagtttgtgacagggattttttttttagaaaaaaaaatatgttgggactaacatatttgctcttatgacgaatatattagtgatcttgagctgtcctactgcacttttctattttatcagcttgctggagactaatctcccccttttgtagttcacaaagtgcgacctaagagcgcattaattttttatctccaagaaaaacctttttgatgatgactggataatttctctccaggttaagcttgatccttctaggcccttgagcaaaaggaagcactgggttgttgccgagattcttcgtagagctaaggtgtattctccatcagctgctgcagcagcagtttctgctcaacctggtgccacagttcaacaggcagaagctgctagcaaatcataaacatagactcctcttctgcaataaatggacactttttcgggattttcttttatgttgtgtaactgtagtatcatctttgtggctcccttcaaatgcactcgtgtttttgaaccatgtgaatggtggttatcaactcactgagggtgcatcttcaaatacttcgaaattcatggatgcaacagaccatatccatatgtagaacggaatcttctattatgaattgtattcatccatataaatgtgtacatcgcaggcacgcatgaagcgcttattagtctttcatcatctacacatttatgcatacatgaataaggttatctaaaggtcattcgtcatcgcctactcacttatttatgcatacattagtgaggtgatctgaactcatggaacgagcgatgggcggtgggtgactaagttttgtaaaagggcggcgagggcgactagttttgtaaaattttcaaatagaaaattatttatgtaaatattttaataaataaaagagttaattttaccaccttttattaccgatgtttcgctttggaccaccttaggactaatgttttcactttggaccgggtatttttacctttatttcactttggaccacccttactcttttatcgatctacatccaatttttaatatgtcgaagaaatagtcttacatatagctgtggcagttcattgacgagtaggagatgatgtaatcgagatcgttcatatgcttgagaagagagtcgggtggtccaaagtgaaacaaaggcaggtttacccactccaaagtgaaaatattgcttaaagggtggtccaaagtgaaacatcagtaataaaaagtggcccgaagtgaaatttattcttaaaataaaaaaaatcaaaacgagcctgctcggttcaactcttttaaccttaaggaactaagtttggctctactcgcaagttagcctgttaaactcgtataaacgtaattatatcacccttatactttcaacttttaccattttattatagcaaatttgttatatgcacacaagttttcacgtgtatatatcgtgttcacataaaactctagaaaaaaatgcacatgtattttcaatactattacatcaacgtgtaaactttattattaaattcatcatatatacagagagaaattctaaatatttatattcttaaaaacatcagattttttaggctaaaatataatgagtttgagttacacataggtgtaaccctattagaaattatatgcgtaaacttttcgagaatcgtaagtgacatttagtagtttgtgtgcagggagtatacatgcgaagtttgtgttatatgtttccactaaacggagccttggtgtagcacgagtaggcctatgccattctttcacggaaaaagtccactttgactacattaaatatatatatatatatatatatatatatatatatatcgaatttgatttatatccctcaaccgtcaaacaaggtataatgactccctcagctattaaaacttgtacaaaattactcctaaggtaatagtgagagttgtattgctgacatgacgtccatgtgttgcattgacatgttataataaaaaaaaaaaacattaaaaccatgggactcataggtcaacaattgtatttttcttcctctttttccctcccactctcttgtggtcagggcgacgattggcgccttggcgggaccaagggcagtgcaccaatgcccggcagaagaggccggaagtggtggtgacctcgtaaacgagaaggaatgcagcggggccggttagccccttggagcaccaggaaggatgggtaggtagcggggaggctggagaggatgacgacagggaagggagtggtggcgccatgcgcgatgcctgacgaaagaggaaccggaggcagcaagcgaccttgtcgaggagtgatcctccctagcaggtggtcgtgagaccccccccccttgtgagttcggccggggg

SEQ ID NO: 60638 - DNA, 1676 bp, Oryza sativa
gcgggtgagggccgagggttttgcgaggttttttggggaatggaagatggagaatgaaggagtggagaggaagtgtcttgaagtagggaaacggaggcggtgctgcgagggggatgggctgggcttggctgggttctcgtgggccttgacttcgctgcaaccgaaagaaggaaaaagtccacaaggactccctcgaatataggatgaatctgattcgtatcccttacccataataccagatatcttgaccctcttagctattaaaactgatgcaatatgaatcctttggtggttttgaaggtggttttcgttgatgtagcatctaagtatcgcattgacttagtcttcgtcatctacgtggcattaaaaaaataaaacataatgtgtggggcccatgggtcagacgacggcgtgaaaccaacgggaccaaggcggcacctagcgaaagaagagcataaggcggcagctacctcgtcagcgggggaagtgctggccacgcacggccggaatcatctaggcgtcgttggtcttgccttggccacggtggggaggcgagagaggacgacggtagggaggactaaccgatggtggttggggaaacgaggatgatagcaaggaggccaaggcaaggggtgagaagggtatgcaacagcaaggaatgctatgatttcccagcggcgtttgcggtgttatcttctccaaagcccatggccgcggctgcggcgtgctcaacaaagagccacttgggcatcgactggagaaggaacaacggaagttgtacccaagggggacaaagggctccgagcgtcatcgtcgtccgtgatttggctcccagggtgctcgacattgcgaatggcaatggcattcgccgagcttgatatctcccccagcaccaaacccttcctcctagcaccaatgcagatttggcaggcgagcgagcgatcccgtccttcctgctagtcctggggcctcgcggaccgcagacaagctcaccaccacctccaatttctcttccacagggcactagtgcggtgccaacactcctctacctatcgtcgtcctctccagcctccctgctgcctactcgtccttcttgctcctcccaagggctctccaactactgtagcgtccctttctaccgatgaggtctgtcggtgaaatgggcccaggggtacacacagtaaagggaaatatctttcccatctagtcgcgtggccacgcggcctcgtttccccccgcccctcgggtagcgaggtggctagggggcctcggggtgcggtggccagggggcctcggggtgccacgccacacccctcgggctttcggggcgtgctaccccggggccctcgcccggccaccacatggtggggagaggaggcgaggcgaaagacgatgctccgcgcctttaatgcgcggcgccccaaccgtcccgcaccgcattcaatgcggcgtggggggacgtgcggcgccgctcgattgacccatgtcaatcgagcatgaccggcttgtgactggtcacaggcgacgggacggggggcagtgcccccatgttctgctctgtgtcaggcggagtgggggcatgtgtgccctgtcccgtcggcacgctgctaggggcgccccacgcgcgtgatgaaccgccgaagtcttcatgcaattaatagggaatgacagggatg

SEQ ID NO: 60639 - DNA, 2227 bp, Oryza sativa
aatgcattatcgctttatttaaattcccgcgttatcactgttttatttagccatgcctatttacctttgttatgaccttattattattgttattgatattaataccttgttcaccctagaataaacaaaaccctaactagtggacattatattcatggttccactagtataaatttaggtagatgcttcgctgattaattaggcaacattaggtggttttataactttagacttcgggaattctcatatcatttggacaccatggaatggttggcttatgttggaattggacacacacctccccctcttttcaaaacccccaaaatggtttaggctgggctcgaggtgcgtggttgggttttgttagtcgtacctcgggtactataaggattaagcttgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgcgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgcgtagctctaggatcgtctttataaaatggctttgggcaactaagtaacttttaaatgctgttcactgcaaaacttaacccctatattattaccccttgtacccccccttgcattaattatgcatctgccggtgtggcttgctgagtactgtggttgtactcattcttgctcaatctttcccctcttcagtaagagaagctttgaagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattgatacactagcgttcgggaaaaggcaattttcccggtcgcgacaccagggtcctgcttcaactgtggcgagcttggccacttcgctgacaaatgcccgaagcccaggcgtgccgggccaaggtttatccaggctcgtgtcaaccacgcatctgcggaggaggcacaaacagcaccggaggtcgtactgggtacgttccctgttaactcaatccctgcaacagtactttttgattctggtgcaacgcattctttcatttcaaagaaatttgtggggaggtatgggttaaggaaagaagagcttagcacaccaatgagggttcataccccgggaaatagttcaacctcagtcagttttagcccctcagtgctaatagaaatccaaagatcaccatttctagccaacctcattcttctcgaatccaaagacctagatgtcattcttgggatggattggctgaccaagtttaagggagtcatcgattgtgcgagtcgcacagtcaccttgaccaacgagaagggagaaacagtggtgtacaaatctctagtctcaccaaagaaaggggtctcgttgaatcagattgagacggaaatcccagtggataccgtagagaagaacttgagaaaattggaagatatacccatagtctgcgagtatccagaagtgttccccgaagacctcactaccatgccacccaagagagagattgaattccggattgacttggcaccgggaaccgctccaatctataagagaccatacagaatggcggccaacgaattagca

SEQ ID NO: 60640 - DNA, 1182 bp, Oryza sativa
aaaaaaaaaattgtattcccaagaaaagtcagatgtgttggggaacctccaaaaagtttggatggtgctaagagttgctcaggtaaccgctcaggaggaaataaggtgattatttcccagactcatcaagcagatcgagacctgctctcgaaaaaagagatactcatcactgcaactgaatatcccaacggagagatttcactggacagaaacataagtgaaaacaaaggatttttaaggtctaaaactgtaaagccagtaactcatcaaggaaaacgatgaatccagaggaaatttgcatcggctcagactacttttaaaatctgcaaggtgggtaaataacccaccgttcagacgagcgaaccatgttcttcctcatcgccggcgtccatcctcagatcaccaaaccaaaccaaaccaaacagctaaaaaaacgaaagagaacagcaaaacaaacacgaagaagcacatcgcagaccaaaccaaacgaacgccgcagatcgatctgtggtgttcgtgaaggctgacgagagtcgagaatgtggatgatagcggcggccgcaggtggaatgtggatggaaaccctagctggggtgttgcaaacttatagagcgacccttccggaaaagcccctagatgtagggtttattactgtacatgccatcctacataggcctccggcccagcccaacctcgccactctcggcccagttcgcttgcattttgcagtggaaaagttcagtttaggtccttaagtatcgagtttcagtcacatccctcaactatgaagcacattcaacctctagaacctacgttcctcggtagtttttgatgacggctgatgtggcgtgttgatccagttgtgtcctacgtggcgcctatcttgtacttacaattaggggaaaaaaatgaaaccccatgtcactgacattcccttcttcccgcgttgtgttcgctccttgaaacaacgagtcacatcctcatcgactgtgtgttcgttcgacaggtttggcaccatgtgctgtcttcacttggctggcctgacctcgctccttcccgcggttgcacgctttaggtttggtggccgacttctaggaattgcctgctgaagcatcttcgtaagggcttcgacttcctagtcctcttggtttcttggcaactatggaaggagcagaactcatt

SEQ ID NO: 60641 - DNA, 6285 bp, Oryza sativa
attgatccaatgatctactagcagttaagcttataataccaggattaatccaaggggtgtatcaatatttttgactaaaatgcacgtggctgtcaagtttatatacaattctactcatttttcaagttcttacactaaatcgcacgcatctacaccaagttcttgtaccgtgggtgcaatttactccattctctttgtcaccttggtagcctaattttgaattttaaattactaacattcccctttcaaacgcctgattaactgaaaatgaatgaatttctgtatattcaattgttttgaaatacttgaactgtggtaagtaaattgtagagatgcttatagttagaacagatggaataggtttgttgtactctcttcggtccaaaacaatgttagacctttcaaaattaatgaaatgcaactttcaccacctaattctttcacataaattaaaagttattacatcaatcaataaatatataatgttacgaaagcttttataacaaacacctgaccatgttgcggactaagctagttggtttccttatagttgaaattgcacatcggggtttaagtgattccaagagtacgggtgcttaaatttacagataattattctttaacaagactttgttaccctcaatatgtacgtgttggtccaatctaagaaagcgtgaggttaactcatgatatgtcgattaactattaactcgcgaggttctcaacatatgccagccaactcttcatttttttttcgttgtaggttatgataatctcgacatatactggtccaatgatctaatctcttaaatgtgctattagaaataagtgtgcacatgtgcattcatatgggtgagtacgcgtgtatgtatatgagcatatatgtttggactatgtttacagaaacttggctatattattttcatatgtccaaaccctatgctctaacctataaggcttataattatgatcaaaattaatctatgtgaatagtatggattctaaaataacatgaatgtgctcccatgcttttatactccttgataaaatttctatagaatatttcaatttatagatatatttatatatatacatacttttacatgatagagactattagattaaatctatcataatgtccaacattatctgacctttgtcctttctccctccaaaatcattagtactccttttgaaatgaaatgtcgaagaaggacatttaatgtataatctttttggggccatcattaaatgtttcgtaaaattatgaccttccataagaagatacttcctccgtttcacaatgtaagtcattctaacatttcctatatttatatggatgttaatgaatctagatggatatatatgtctagatttattaacatcaatatgaatgtgggaaatgctagaatgacttacattgtgaaacggagggagtattaaggtgttgtatctcttcaatcttgatgtcgtgccactgaattggctaaagctctcgggcaaatttgagcctaccttgttcttattcgagatggcaccgtactactctatccatcattcattactttattacttgatctctaggtacatatatatagcatactactactatatatttcacgattttttgattttttttttcaaactatatatctatagaaaatatttaaaatataaataatatgacagagtttttcataaaaaaaatactaatttaactttcacatttttaatactaatattatttttgtcatctatcaatgatttaagatattgacatctgataataatacattaaaaactttaccttttttagagcggaggtagttaatattctctctccacagttacaaaagagtgtcattgtaacataggttttggggtgtagctaaatttgttaattaaacaaaagctgattataattatgtagtaaaaaaaagttcgtttatatatatggactttaaaaggctaaaaatgacaaacttttctaaaagagaacatatataaggccctgtttctttcagcttgggattaagaaacagacaacttattgaagtagcttattataatctggaacccagcttattataatctgataagctcatttaggtgagctttttccagattattgggtgaaaaattacccacaataccaccccactccctctttagacttgcaaacccaataatctaggctctaataatctaggaaagaaacaactaaccgcttattctactacagattataacaatctagcttatagtaatctgactcaataatctagattataataatcccaagctgaaagaaacagggcctaaacctctagatagttccggccaaacgtgagatattcatggaacctaagtttttttaaactagtaacgataatatcatggccaaaccgaacaaatagggatatgctatgatggagtattttgtaacaattgtaatgggccaggctcatataaatagagataagctagaagggtgattaaagataaaacattggatgtcgtgtttactttcagcgtacggacacaccgtggtggtgggaggaggggatggaaggaggaccactccgtttttaacttagtagaggtatttttttattgggattatctatatatatatttattgacaatttttttatcaaaatttatcaaatgtaattatagtataattataatataaaactatagtataacttggatataactttgaaaaatcccaccatgtggagctatttctgcaaagcggaagtcatgggaccaaatcccctcacccgtgtgtgttacgattttctctttcccactagcatgaatcttagagtaaatctaatggttcaaaatatatgaaatttgcatacaagctacattataaatagagtaaatttcacaaagctatagatattttgaccaaactacgcaaaactacatatttgagatgttgtatcaaaaaactacagacttagcggtaaaattatcacaaaactatatatttaagaccaagtaccacaaaactatagattttatattataagttatcttaaaagtacatatttcatattgaagttatcacaaggatacaaattctagagtttaaatccctattgcaaactttatgttggagctataaatgttatagttttgggataaattagcactaaacctatagttttgtgataaaattgctgcttagttttttttacactccatcctaaatctatagttttgtgagaaattttagcttcaggtgatgaaaacgagtcaggcatgaagaggaagatcaggaaggggaacgggattcatcgcacacgtacccatcatggctgcttggttttctatgttatatagacttgtagtttgtttctatttcttgatatctattagtataagtttttttttctgcgggatctattagtacaagttagtagtactattctattagttagtgttctcggttcggtgagttgtttcttccgcgataaattgtcagcgctagttctccatttttttttctgtggatcaagaagaaaggaggctcagcaggaagcggattgtatcatgagagaagcatctgcaatgggtgaaagcctgatggagcaatgtcatgtggaggtgaaagcccacgggtcgtcaacttcttttctcagagaagaacaatgacaatgacagtatccgagaaataagcatcggctaactgcactaaatttgtagttttatgatagaagaccttaaatctgtagttttctaatattttggttgaagtactattttcgtgaaatttactctataattacatgcaagttacaatatgtttttagaaaatttgctgataaatatataacaaaaccgttttttattttcacatgcatttcctattcatataattacaaaacaagatagaaacataaacgggataaaagcttttgtaggcaaccaaacacgtccaattataccacccaaaacagcacggatctcatggcgttggaattactccatcgttgatcattgtcactgaagggagaccctagcttagctaggtaagggtaaggtagcggtagcgcctctatcaaaaggagcaaaagaaaacgaccgttcctccacgcatgagcatgaactgtgcgagtctgggtgaacagcagcaatgaggagtgaggaagaggattcatgtgtactggcgtggagagcgaccggtgatgggtgatggggtgagggggcggcgtggctggcacgtgcttggttgggttgggggcatccactctttctttctttgtttttcttttcttttctttctttttaaggaaaaggatagatctcttcacactctcatcacctgtactggaccatcttttgttaaaggcgaattcaagagagaagccaagagaaatggttggctataacaaaagtaccgggggctaagcccctggatctagagtgtattttttttcaaaaaaaaaacaaatactccttttatcccaaaatataaaaaataaccaccactaacacaaaaacaaaaagtaaatttaatcacctcatcaattggatcacctcgaaacatgtaaataattatgtgattggaagtttgatggtagatgatttaaaacaaagcaaatttaaatgagctagttagtactatatacatgactgcgtgccatatattataagacatggagaaaaataatagtgtctttatattttatattttagaatggaaagccagagtacttggacaaccaagaaaaataattggtgtcggacaattaaagttgtgttcggaaccccttgtttccatcatgtaaaatgaaatatacattggcgcataattaattaagtattatacattggcgcataattaattaagtattagtttaaaaaacctgaaaatagattactataatttttaaagtaatttttctatatattcttaaaaaaaacacgccctttagtggtttgagaaggatgtgcgtataaaacaagtgagtagaagttagaaagatgggggtaaagaatatggtatagatccttatcaaatccacgacttaagatgactacaactgagcatgtggttttttctttcgaataccagatatataaaggttcagcctattctaaactgatactgtaagtctaacatcggtgtgttaaacagaggagagaaagttcctcgtttttcacgcgcgtgcattttgaactgctaatcagtgttttttgaaaaaaaaaaatatagaatttttttgcaaaaaactatattagtcattttctagtttaaaatagttaatcacacgctaacgatatacctcattttgcgtgcattatctttttctcttctcctaaatgcaccttagtcccctcacccaaatgccctatggttgaaaacagtatggaaatttccggctatcatttctggtctgcacctaccgttttagtcggtatcggcaattatcagtgttggaaatagaaatggtaatatcttctggaaatgatagcggaagtgggatggaggttttttcaaccgtttttattggtaatcgtatttatccggtaatttccgtcaaaattctgagaaaattctgaaagttctccaacggctcagctagtccaacccatcggaagctcatgaatgttggaagcctggcggacttgtagcccattagaaaagggaagtggctaggggaaaacacggttaaccctagggcgtggcatgtgggctttgttgaactttggtctcttcaacttatcgatgttaaagtattattgaactttgtttatattattcgtcgaacatattatcatatcattaatcatcatataatggtattatgtggagtgtaatgatgtaagaataaagttataaagttatcttcatgtataattaaatatgtgattatgcctcactttgttgtttccaatatgaattttcttccaaccaacatcgctaggttctgtttcgacgtttccatttccaatatactgatatcgttatcgtttttttataccgtttcgattccgttttcggaaaaaaagaaatatagaaataaaaatggtagagggtttttccgaccattttcatcctaaacaccaacagcaccatctctctccaaattgtactagcatcgtgttattacttattccacgttattatggtaaaaaatttcacggcgcaaagcatctaggctagtccttaattcactacgtagactcgtggtaccgtttgtaaaaaaaaaaattgctccttggaaatcgagcgattttacaaaaaatgataaaaatcctagtatg

SEQ ID NO: 60642 - DNA, 1032 bp, Oryza sativa
catgaggaaagaataaggaatcatatacatgctactacttcacaaggaattctttgttagggaaggacagttttgacaaaattgatcaaattacaattgtacttcttcttttactgccaggcaagtaccaattccaattgtgcctgtaatgtctaaaaaaaaatgcaaaccttgctatcatgattaagaaggagaacagaaggcatttcagggtaaaggagccagtactacctttgttaacaaagaagatagatgcatgaatgaatgattaattaagctgcagaccacacatgggctacctcaatactgggggcacaaagatccccatcacccatatccacatgctttgcactgccctgcacagtaattaaacagttacaagctagatgcaacagctgttttacttagtagcactaagcacgaagcaaacacttccattaccaggtaccactagctctttctcagtagtaatctactgcataattgagtgctgacactctcaattctcagaaaaaagaatctctgggaccccaaaaatgtgggtccctgactccctgttacaagcttgcaagcaaaaacagaattatttatgtcggaatagggagattgttatcatagcacagtggactgaagcagcactttggcatgagaaatgcagcttttagattctttgctgtgttattttaaacgagctgacctgataaaccctctgattgcaattggaccgttgagcacatttcagcttaacacagccgcgccgcttgggcccacaagagtatcaccaggtgggccccatttgttcttggaattttcaggggatggcaatgaatgggccccaggacccacagaatgaaacagatgttagcaacaccagtgctccactagtactaataatttccagtctcccagttcacaaacaatgggatgaagatgcagcatagattttcagtcacatgtgctgaagaagataacataattaactaacaaggcatattaataatgtatgataagacttaagtagtatcatctact

SEQ ID NO: 60643 - DNA, 2290 bp, Oryza sativa
agtcgccacccttagctttatcgtcttcttagtctgtttgcgtgctagtttttgtgtttaggtttgttgcttgtgggttagtcggcggtcgatatcatgtgtgagtggtatgacagcctttattaggagttgtgtgcctctttttcagtgttttaatcaagattaagataatggcacttaatcttataagaaagattagtttccgagccgtctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgataacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacctgcacgagttcaaccgccttgcgcgctacgctcctgaggacgtgcgctccgataccgagaagcaggagaagtttttgtttgggctcgatgatgaattggccaaccagctaatctccggagtctatgaggactttgagaagcttgtggacaaggctatccgccaggaagagcaacgcaacaaaatgtaccgaaaaagaaaggcagctcagatcagttttcctcaagggaacaatcagaagcctcgcttcatgacgggacagctaggtgggccttccaccctgatcgtctgtcagcaccgtccctattacccgagtaacttcgacaacgactacaacggtggcagtcacaacaacagtaagcagcacaaccacaactcgactccacccccactaatggcaccagctcagtcaggtccgccagctgtgtcagctcagtcagaacaacccaagaagggggctgtaggaaagccaggaccctgcttcaactgtggcaagcacggccactttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagttccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaatt

SEQ ID NO: 60644 - DNA, 933 bp, Oryza sativa
aactatgtgtctaattttttctagaattttatgtgacatttgttaattgatgtgtatggaaaatttgtgtgcatagtatatattcctggtaagtcctatctacatttatcattgtcatcattcttgaggctcttgaaaccatccatttggccttgtttctttctccatgtcttatcttatgtttgcactgaactctcaaggtttaaggtcatacctacaacaaacccagtgaacatggagtgtggagagctaacaagccgggttggttgtggtcacatggactcgtcggctcaacgagtaaccgaaccataaatgcatgcaggagctaagctaggcccagccacccagaaattacgccggtcgaatgtggtcacatccacagctccagacctgaaccgccgatggaaaactctgaaaactgaagcgaatagatgaacatgctgaaaaatcccagcatcaggcatcagcttcgtgcctcgagcccgtcccgatcccgaccggagtactacgagctaccactacctcctccgttgactccggcggccatggccatggctgcaagcacgatggtacaagtgtgtactggtagtagaagtagtaccaatgtacgagcacagtacattcttggcaagtgagcagtacagtggtagtaatgatggctttgctgctgctgctgctgtgctgatgatgatgatgacaagatcatcgtggcctgtagcagcgtagcgtgtcgcagtttgaggagaggagaaaagaaatggtgaatttgtgatgaactgatgatgcatgcagagtaaaactagagcgaatttgcaatttggggtcagattgattgattgggtgatggtggtgatttggtattccatattcacagcggcaaatctcctacaacaagaagtggatcaaaactaatgaaaagaagaaaccaaagag

SEQ ID NO: 60645 - DNA, 807 bp, Oryza sativa
gtacgactaccaaaacccaaccacgcacctcgagcccagcctaaaccattttgggggttttaaaagaggggggggtgtgtgtccaattccaacataagccaaccattccatggtgtccaaatgatatgagaattcccgaagtctaaagttataaaaccacctaatgttgcctaattaatcagcgaagcatctacctaaatttatactagtggaaccatgaatataatgtccactagttagggttttgtttattctagggtgaacaaggtattaatatcaataacaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgctttcccaaacgccggcttcaacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaacccatttattgcgtcagccgagggagagggcgcgcggaccgggtccacgggagtggggcccacgcgtcagcctactcggtccacggtggac

SEQ ID NO: 60646 - DNA, 1754 bp, Oryza sativa
tatggcatgcaaccaatcaccagcttcaacaggattagtggtactagagaaaataggcggcctcacacgaagaaattctgctaacttgttctggggaggtgcatggttatttccctggttttgctgattctgaagttgctgcatcatcatgttcattaactgagtctgttgagcaagaacttgagcaagggttgggttcccttcattgttgttgttattgttgttgttgttgttggggccattcccgttgctgcgagtgttcaccatctggcatggacagggcacaagaagagaaaccgggggaaactacttaggacagataattactttaacttttattgatcttaactgagtttcattattacaaactgaagactctcacaccactaaactcaccaacttcctaacactcaaaagcaaacaaacacatgcacttacatcccaccactgatgtaaatcacatgcaagacccacacacacacaaccaaacttaaaacaagcaaactaacacaacgatctaagacaacggctagacatggcactctagttcttccgagcatcggaggtcgattgaaggctcgttcggctcgtcttcatcatcttgggtagctacccactcaatcttggaatggttgcgcttggattcttcttcttcatcatcacttatgatgataaccggaggatctgctaaggttggagcaacttctttctccaccacacgaacctttggcgccaattgatagcgagggacaaatagagctctcttccttgcggtaagacgaatcctggccttttgaggtggtgcttctcccttcaatgcggctagttccttctccaaacgatccaccttgtcttctaacttgcaaatcttaccacgattccaatcttcacgatcttgagctgctaacacagtctccgcgcggctttcatccatagcccacagcatctcaaccaaatgccttgtggtagcatcattctcaattccttcagtctcaaggtaactgccacggtcacttccctggggttggccgaggatggtagcgatactcagtgtcggccaactgatcactgtagcgatcacggagctctcctatggcgatccttgccacctcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaagtactcaggcttgtagcgcggcatctaaagacaagtgaaaggagggagttaagacatttatccaattaatagcacaagtttttggattaatttgaataaagattagaaattcaaagtaaaaaggtaagtaaataaagtaaaccaagctttgcgagataagttgaaacagttggaaaccaggttacaaattttgtacttttgaataactggtttcaaaagaaatgaaagaaacttataaaatcaacatgctaaatttattttattgcagcaagattaaataaaacaatattgtaaaacttttgctgataaaatgagccattagtacagtaatagatgtacggtactaataacactggaataaatttttgaatgagaaccattaaaagagattatgaagtgcatgtgccattagtttggttcaattaaaagagaaaggga

SEQ ID NO: 60647 - DNA, 4430 bp, Oryza sativa
tcccatatacacggagagcttgagatctcaccctgagcccccggccgaaccggcaaaggggggcccgtgcggtctcccggtgaggagcaccgtgctccgtcaaagtggactcctaaatgtgcgcacgtatccgttgccacgtcttgccatcccacaatccaggacacgacgagcacgacaccagctccgcgcgaactcagcgcgtgtcaagccttactgcacatgatccgaaaacaaagccaaattgtgtttgactaagcaaagtagaaagaaccgaaagcagggaaaactaaaacaaacaaaacagctagatttattcaacaaatccgaacaaatccaaccaaatccgcagatgctcaacccgatcgcgctcagcatcgacgacgacgcggcgccaccggcctccggcttccgccgcgccaccccgccccgccggacgtcctcgcccggacaagctctgacaggtccccggcgttgtcgccgccgttcgcaaggctcgtttgctgcctcgagcaggacgcgtgcatcgacttaggcggcggcatcaggtcgcgcggcgcctcggacgccgcgctcggcccgccacactcctccgccattgccgtgtcgtccttgcaaggcttgccttcaccgtcgccgtcgccatcggcgcccgggccagcagccgcagccgatgccgccgccgcgacgggcgcctcgtagaagaggtccgagaagatgtccttctccagcgagttggcgagcacgaacgggaaccacagggcacaggccggcctcatcttcgtgcaccgccgccgccaacccttgcgccggcgaggacgacgaaggtggtggtgctatccccggccacctgggagcgggaggacgggaaggagcgagggggataaggacgggaacaagacggcgtgagagaggaggacggaagaactaactggagtggcatggttctaattttagaaatttcgagtggcatgtaaccgatatgacgaatagtagtggcattttttcaatttggcaaagttgcagtggcatggatccaattaaccctaaatcaaaacaccatacagagaatttaatgctagaagtctaaaaatttgcttcgttacacatgcacaaggcgagcggtggacccgtcctgcccttgtgcatcgtcaagaccctatactatatgattttcatttctgatgtattttcacggatgcatcatgcatgcgtattctataacaatcacgcaacatcacaggcttgggatcaattggatgtacgccttccgagcaaaaaaaagattttgtagctgtgcatatttttcttggttgtttctcccactgctacagaaaaggttgtgatcaaatgttcatggcctcgcggtacaattggctatgttaaacaggaaatcagtcttaagtttggagcaattcgggttcttcagttagcatgggtcttgtccactggccggcttacaacgcacaaatggacttaattttcctcttgttcttgaatacagattcctggtgcgtcccattctcagtatgtacgtaccaagtcatcaccatttccgccttccataatccctcaaaattgctcatgattgatacccctttaattcgcacacacaacacaatcagataggtgtgaatgcttagctagccccggttttaagagttgaatcagctacaacatatgtaaacattaaagtcatttgtacatttaaaggttatgttaaggaggagagattgggaacctctctcccgtgtacgaaaaacgggtttgtattagcacatgattaattaagtattataaaaaacttaaaaaatggcttaatacgattttttttgttgcaactttcttatagaaattattttgcaaagaaatgcatgtttagtacttcaagaagcatgcgcgctggtaacgagggagtggaggttggaagccttcacttgcaagcacatcataagtacacttaggtacacaccagctagctagcatgtgatttactcccaagaaactagttgttaattagcataggggtaagaacagtccacaaaaaagggtgcaccctctataggtaccatcattagtttcgctatattaatgccggttccaaaaccatcatctacgaggagtttggaatcaacatcaataaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagagtgtttctctgatagtaaaccacaccatgagaaaccactactccgtaatcagtagactagtaaagcacactgtcgatccgaactttgatgccattggaaacatcaaacactcattaatgtcttgtatcccttacgcactaaaattctcggtacatatcgttcctagtgcacctcaatgcctcatttgtttctgattaagatatagattttatcttggtttccgttagtacactttcaaactactaaacggtgtatttcgtgcaaaaaaaaacattctatatagaagttgttctaaaatattagacaaatccatttttcaagtttaaaataattaagactcaattaatcatgtcctaatggctttctcttttgcgtgcccatacttaatctttatcttcatcacttatggcaccacctcgaacttgccatgtctgttagtagttcgtatatatctctttggtttcgagacggaacatgggttgctcttcctcttacaaaagtcaaatacatgcacaagaattccatcatgtagactagaaagttgtctcactttatatgttgagcaaatgagtaatgtcatatatactcacaaagctattaactagtggagtcaagcaacggcttatttgcactccacatgttcatggaggcgacgatcgatcagactcgacttgagtagttgggcctgaggttgatcagttgttccacagttcgagtttagccatggaacacaacttatgctcttggcatcgtgcactaggctatagcccgacgtaacatcatccatgtgggttgttataatcccttccacgacattgtggtcaaatgatgaaggaccggtgctatggaaataggctgctaccgatggcattgttgccgatctccattagcaaactaacaagttccgtgtatgcatcccgcttgtatatataagcttgacgtcgtcatggtattgtccacgacaatgcccatctttccgtggatgtgtggaaatttcaataggtggcggtgtgaagaaaaattctatgacaactagattgtgagaaccaaatcatttttttaattaacaaattgggaaccaaactgtgtttgctaccagcttcttcttttttaaataatggaaatggtttacgtcttcggcctctatcagcaggcacatggtcaataaaatttagtattgagaaagaaaaataaaatcaatagaaagaaaaataaaatcaatatagagtgatggaatacgtccccaatctctgtaaaaagataaccgctgaattaaaagctaagaatgcataggcgtgggaatccaaagctcgggtgaaacagattggacctggagagaataatgttggggctaggtgattgtctgattatgcattatgatactgctgaaaaacagcaaggatagccaaacccacatccaaaataaaagcaaatttagacaagaggtcagagacccggcttttgattgtaagccgcaaaaattaaaagcaaatagctgtcttttgttctgaaactgtggagattatggataccccatatctacacagcgattatatttagactggatataggataccgaatatagatagaatatctttatttgtatctcgggtttgtttcttaacttgtacgtcaaggaaataccctgaggcttagtcggttacgattgtattttatctgtactctcgtattctgataaggatatgagttataccttgtaatacggactccttcccctatataaggaggggtccgagtcgttcctgggacatcaactttcttggagattatacatccaataatacactcggcggattcatccccggacaggagtagggtattacttcttgaa

SEQ ID NO: 60648 - DNA, 6070 bp, Oryza sativa
aataaatagatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagtttagtagtgtaaaagcccttttcttttccgttggtcgtgtagacgctgcagcttcggaagatccgctcttcgtggaagccgaagccgtcatttgggaaagcgagcaaggcaagtcacatcatccttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagaataaataaaaccccaactagtgggtactctattcatggttccactagtataaatttaggtagatgcttcgctgattaattaggcaacattaggtggttttataactttagacttgggatattctcatatcatttggacactatggaatggttggcttatgttggaattggacacacacctctcttcctctttcaaaacccctaaaacctgttttcggtggggtttgggtgcatgccagttatgggaagtagcaccccggccactataaggattaagctcgggcctctgttgcaaagcactaccgtacttccacatgtctaatgggtaaggcttagtttgtggctcagtctagtcttaaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggcaggattgggtcggtactcttgtttatggctaggatgggttggaaactatgtcacgtcttccgtctgtataccgtggtggtatgtggcgcgtggtaacacgtgaggaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatgtggaatggttggcctgggttggcttgggacgagctggaacccaggtcgggttgccagttcggtccgaatcatcgtaggccttgggttaaggcaggttcgtgagggttcacggccttgtttaataatattgtgtagctctaggatcgtctttataaaataactttgggcaactaagtgacttttaaatgctgtttactgcaaaacctaacccctattattatccccttgtactctccttgcattaatcatgcatctgccggtgtggcttgctgggtactgtggttgtactcattcttgctcaatctttcccctcttcagtaagagaagctttggagaagatgtcttaggtggagtcctagcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctcttttcttcttcccctaatgctatttgcaaaaggtttacccttttcttccttcttcaaatttcaactagtactagatggtcagctttgcgaagaagaagatgtcgtcagttgtttgccgaagctccggaaggctgcaggatccgctagcgaagcgaaggaagcagtgaagccagctgtgaagcaggagtgaagatcttggagaacccgtcgcagaacctaagccaccctctagtgtttcgtttgtcgtatgtttccttgcttgtgtgtgtagcgcgtggtttgcatcggtgggtggtgatgtaaccatgctaggttgtttgcttaatcaacttgcagaataagcaaaacaaacaacacatcaacaaaaagagttagttcctttaaggtcctgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaatcggaacaacccagcaggggcaaccaacgttcaagtatctacagtccagcaacagtgcaagttatcagaatttctcaaaacggggcctccaacctttgccattgccgtcgatcctatggaagccagtgattggttgcgcacaatcgagaagaagctagggttgattcagtgcaccgaccaggagcgggttggcttcgcaactcatcagctggttggaccggcttcagagtggtgggatagctacgaaacatcacggccagaaggacatgccatcacctggaacgagttttcatctgtattcaagagatcacatgttcccgcaggaatgatcacactaagaaaacgagagtttcgctacctgaagcaaggagatttgaccgtcacagagtacctgcacgagttctatcgtttggctcactatgcaccagaagacgtggaaacggatgaagacaaacaagagaagtttctccaggggttaaaagatgagctcgcagtgcaactactcctagaggattatgaagattttgagaaacttgtggacaaagccatgcaactcgaaagtgagcataatcggatgacgaactgcaagagaaggattgtcaacatcccagtaattccaggtggtaaccaaagacagcgcactgagccacttcagatcaccggatcttctgttgtgcatcaagagttcctgccccaagaagatgaacgcaatgcagacaacaacactagcaatactaatgatgatgataccaccaacaaccatggttcttgccccattagtgaccactcgaacaaagcgtgcaatgtcagtagcattcaccaagatgtcaacgatagtatcaatgttggaacccagaatgacaaccttagcaattttgactctgggaaggactccaatggtgatagcaataatggtaccactgatgccaatgttagcaaggattcccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgccatacctgtgaggcctcatgttaattctaacccatagtagatacaatgtaccgatgttaagcaccttccctttttgtttaaagcagtgcctcgtattcatgtaatatgggagaaatttgtaataaaaacaagctctaagaggattcttttggaagatgcggatatgtgatcatgtgtataattgtttactgacaaaggagacctagggtctcgtgccagaggaactacattctaacctcgagctaatcaccaacctgaggatggaaaagaaaatcaagtgattaaccaaagagacatttgtttggactaagagtttcagatgtgtctttttcggatcaaaggcaatgacagtcagtatagcttttggcgaaacacttcaaggtttcactgaaaggcagcaagccaaaggacctcatcatccccagaagcgtccgcaatccacattaaagaataccccctgttagagataagccgaaagaagattgataaaagagattggcaaagatgttctctagcatgaaagaagtaggccgaaaggtgattgataaacagaaacatgctctgcatcgctcaaggaagacccctaattgtaattgccccacaacagccaccttgtcattaagtaagcaagatgacctaggtaaaagtgtttctatgaaggcaaggggtgaagtcttcaactcggtatcagatgctacacggagtgaaaagtgcaagccccggttaccaggcgacgccatgtcttgggagatgatccaatgggaaagaacacatcaaggctgaaggtgcacaggaatacgttgaatgctaaatgatgacaacatgaagagaatagcggaaagtaaactgaacataaagaaagtgaatctgcgttgcttgttcgtgggagctattcccagttatgaatcaggtgatacgttcgaagatagtctacagaggtcagacaacgaagcttcagatttggcaggataacgatcaaacaataagaagtccagcagtaaagccatttggggagacgccaaagcatgtcaagtgggagaagttggttcggttgagaaacataattcaaaggcaaagttatcgaccctcgcatcgaatagcagaagtagctagcacccggagaccaggaaagctaatatgaggcagtttgtggcaagttagaagtaaatgacaagcctgatatccttatgacgacaagctggtatcacaagcatggtatcctagtaatgtcgagctgatctcgacgcatgacatgaagtgggtaacttgtatgaggttgactccaaagatgtgaactatgcaaagttctggaactgaagccccatcttcaagtgccgcaacccagtcgaagtcagctaaaggttcaaccagggacaagtcaggtgaagagaagattccatccgcaataggagatcgagccaagcagtcccgagtggagaagttttgctaggcaagtttgttataaaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttcaaaaaggaataatagaattaattaaaattcgaaaagaaattggcaaacactaaaacacgtacaagaaaaattcaaatgtgacccggagaatttttgttaaattctccttggtctaaaaggagccctcaaattttagtggaattttcagagcacaaataataagtgaaaagaaataaacaaagttaaaaaggttttataaaaagaaaaccctaaaagaagtcttttccccctcctcctcccttcttgggccggctcggcccattccctccctctctctctctctccccccccggcccatcggctccccgcgcgcgcgcgcgccgctgacaggcgggcccgcccgccactctcgctgacgggtggggcccacctgtcatctccctcctcccgccgcgccgccgcccgcccgtgccctagcgccgccgccgccgcggattgcgccgcatcccgccgtccccgcgcgcattaaagagaggggaatcactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgctctccccctcccgttgctataaaatcgatccccgtgcttcgctcttccgtttccgccgctcgccgatcgctctcgccgacggtttcgtgcccgcgccgggctcctctctctccgccgtagccgtcga

SEQ ID NO: 60649 - DNA, 6573 bp, Oryza sativa
aggcttatccggtcatcaagatcgataagcactccgcacttaaattcattaagggcatcacggttctttttggagtgcctaaccgtattattacggataacggcacccaattcactagtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaacattctcaagaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagcttcgcagagatgacctcgactacttggaagaacgaaggcggcgtgcgggccttcgagccgcacgctaccagcagagcctgcggcgctaccatcagcgccacgttcaggcccgatctctctgcgtcgacgacctcgtcttacgccgcgtccaaacgcgtgctggattgagcaagctctcaccaatgtgggagggtccgtatcgagtgatcggtgtcccccggccgggctccatacggctggccacgggcgacggcacagagttgcctaacccgtggaacatcgagcaccttcgtcgcttctacccctgaggggggggtcgggtgtcaggtttcgggctcgggccaaccccgcacccccccccctcgggtgtgcagggttggccgggggctgccacacatgcacattctcatttctctcatttcagtatttcaataaaagcagtttcaatttcctaagggctgtatctgtgccgctttttcctttttgaagaatttttgacttgaaatgaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatatccccacgcactagccccgacccgcgcttttcgaggactgggacttgggcacgggcccttaaatcaagctaagacacaaaaagaggaccgcggcacagatcatcctcatctcattcgcatagcaaaataaaattaacacaaagaattttttcatcatttttgattgcagattataagttgatctatacaaaaaacaggcctgaaggccttagaagaaagaaaaagaaagaaattgaagattggcgggggcctgggggctcattccgatgcgcccgggtcgccggcctcgtcttccacgtcgtctgcaccgctggcatcgccctcctcgtcggagttgggggcgaacgcgagctgaggggccgagccctcgaagctgtggacgatgtggtcggcggcatcccggacctgcgcgcgcgcgctgtcttcagtcccaggtgggaactcgtccagcgccatccacggagagaagttggggtccctggcctggtagctcgccaggacgagctccaccgctccttgggcgaggtccctcgaggatgacttgatggtcttctcgagctcctcggggagctgctggagagccccggccatcttcgagaggcgctgggcaaggcctcccaggttggcggcaggctttattgtctgccctttccagaggcccgcctgccgaccggcgcgatccaggcgggagactgcatcccacagcatgccgggccctatctcgcccgccaaacggagggctcggcttccccggcggatgagtctagcgcgcgctgcatgtcggcgacggtgtgttcggcatctgcgaggcgggcggttaagtcgctttcgcccgcagccgccccgccgatgcgcgccctcgcgtccagctccttttcccgcgcctcgaggtcggcagcccgctgctccagcgcggctctctcggcgcggacggattccaaattgcggcgggcctgctccgtcagcgctgcttcgcggagggacagggagtccgccaaccgttgcgcctcggcctcggcctcttcgagagctcgctcccgctcggcaagcgcgtcctcgcggaggcggagtgcggactcctcttcggcgcaggccgactcgtgcgccaccagcgttgcctcccgggaggcgacggcggcctcgtggtccgccaggtccttctccgcgacgcaggcgcgctcctccagcgccatggcgcgcgcctcgagggcctcttcacgccgccggagcgccgcttcggtctccgctgctcgctgctctcgggcagcggcggcatcaaggaccccctgggcggcgtcgagcttttttttcagctccgcctcccagttcccgtgctgaaggcggagggagtcctgcgcctcgttcatcactgtggtggcgatgagggcagccccccgctcctcctccacctctcgagcgatctccgccagtgccgtcttgcgggcctcgaggtctgagacgtgccggcggtgtgccttgcggcccgcttccaccatggcctccaccgagtgccgcccctcctcgacacgcgcccatgcggcgtcgagctccgcacgctccgcctgcagggcctccacctgggcacttagcccatccaacaccgcggtgtttgcggcggcaagggcctgcagaaggggctctgcgctcagcggggcgacggaaggcatgggaaagagctgccttggagaagatgccgcgcggctcggcccgccaatggacgtgccggcctcggggatgtcccccggacctgtttggtcctgggcgtcgcccgaaggagtgggcccaagcgatgcgcccgcggcctcgtcgcgagccatcccagaagctgtcgcctaggcatcgcccgaggaggtgggcccaagcgacgcgcccgcggcctcgtcgcgaactgcctcggaagccgccatcgcctcagcctggcgaacccgggcggcctcctcccgagcggcttcttcggcttggcgagcccgggcggcctcctcccgagcggtatcctcagcctggcgagcccgggcggcctcccgggcggcctcttcagcttcccgtaggcggtctgcggcctctcgccggtcagattcccgcctccgtgcctctgcggccgcaggatcttcggcctcggactggccggacttgggatggtgggaggaacgcgatgggatatcactgaagcagaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgttggcgcggccccctccgggcgcctgctgctggcacgcaccgccccgccccctcggggaggagatgggggaggtgttcctcccaggttgctcttcccccgggcgtcggtagggcggttgctccccgagcccccggacgcggggcccagaagcacgacccccttcaggggtagattgatcccctcggcggcttccgcctgcgccgtcatggcccttaggagcctgcttctctgaggccccgaccgccgtcataatggtcaagatggaggcgcgatctggatcgctgcagagggggaggataccgtgggggatgagggacgcctcaacggagttgagatttagcacccgttggaccagtatcttgaagtcctcgggagcccaatcccatctgactccctggtgggtccgcatgtagtcttcggacccggtgtactcccaaggcgccccgagcgcgccgctggagcggcgcaatccgacgacggaaggtagtcgccgtacaccatggccccggtgagcccctgggatcgcaggcccccgaggcggtcgaggacggcgtcatagccatcccccagatctaccggcgcccgccagctgaagccttgcgccgggggttggctcgaaagtcgaaggcgcctttcgtcgccgaggggggtgtagaaccagtcgtttttccagtcatcccacttcttgcgaaggacgcaggggatgtagcggttcagcaccggcccccgcggcaggaaatagcagccgccgaccaccgacggtggcgataccgactgcacggtgaagaaccaccggaacagccgaagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcaaagggaagaaagaagacggacctccccgggtagtctggcgccgggcgtccctcgcccagcatgactatctcacggccggtggcagattccggcataaagcggcgcggcaacccagcctgcttctcgctcacgatgcgggaaggcgcagcacactaccatcaagcagtgcggagccccgtgccatggcgccggacgaagagaagatggagagcgagcgcgtgtggcgaaagaagggcgcagggaagaaggagttagggcgcaagcggcgaaggcaaggggaatgatggcgaaaggaaggaaacaagtcccatcctcactgcctttatacccttgccaacgctgtgcccggctcctcgtttctcgcgcccattatttcgccccctcgtttctcgcgcccacgcttccactgatcccattcgcccgcttgcggcgcgtgaggtggatatgcggttgtagcagtcgagatagatcgtatcgtgcgcgcgttaattacgctcgccgaccgaagcgacattaccgtatctccaggcgaagcaaatcggctcgcccagattcgtgcgccgctcaggtgatgtggcagtcttgaagagaccgcccattattgacagccaaattaccattatcggcgtgcatggtttgagaccgttgggtttctgcccaaccatggagaccggtcccacctgtcaccaggctttaggagtggcgtcacacccggccgcttcccataagaagggcgatcgcccttgcataacgccgggggctactgtcggtgacatgggaccgggagtatcatgactagaggcttgaggcagacacaatcgcccacgtggcctggcaccctcgggggacgtcgagcccgagggtgatgtgtgcgcccacctcttggtctccccgaggggggggggtcggaccactcttgcctcgcccccgagggccgaggcgccccgaccccttgcggtttctactccacgtgtatgggttaggtgagcacagcggggctcacctaaccgcatttattgcgcctcggttaagcgtgtcacgccgcacgaagtgcagtgcagtgcactcgattatccggtctgtgaccagtcacagaccggtcaaatcgcgggttaggtggcgacaggcggtcagacgcacgcttcgccccatcctgtcaagacgagagcttctaggcactcgtccccggctggagctagcgtgttacatcccaaagatgacacgttagccccgatcgatatatgccaggcttcatcctaaccattacaagcaagatgttgtttgaagaagggcaaacatacacgttgctaagtcaacgcgtggtggacaagaatgaccgatttgtgaccggtctgacactgctcatgtcgtcagcacactgccaccttcccacgacgtgcccgcctcaggcacgagtggaggtaggtgtgtcccgtcccgtcaggaggatgcttggaggacgaccgtgcaaatctccgtccatttatgaagagaagaaaagtccagtttggaaagggaagggtgcatgtggtatccccttgaagtataaaaggaggaccttgcccatagaaaaggaggatgatcttttccagattcagaacctagaacaagggagaggttggctcacactttgtagctccttcatacatagatccaccaaaacacaggagtagggtattacgcttctcagcggcccgaacctgtatacatcgcttgtgtttcatgctcttttgagaggtcgcgattttcccatatacacggagagcttgagatctcaccctgagcccccggccgaaccggcaaaggggggcccgtgcggtctcccggtgaggagcaccgtgctccgtcaaagtggactcctaaatgtgcgcacgtatccgttgccacgtcttgccatcccacaatccaggacacgacgagcacgacaccagctccgcgcgaactcagcgcgtgtcaagccttactgcacatgatccgaaaacaaagccaaattgtgtttgactaagcaaagtagaaagaaccgaaagcagggaaaactaaaacaaacaaaacagctagatttattcaacaaatccgaacaaatcca

SEQ ID NO: 60650 - DNA, 20812 bp, Oryza sativa
tgagccccactgtgctcacctaacccatacacgcggagcaaaaacccacgaggggtcggggcgcctcggccctcggggccgaggggggtgcggctcgaccccctcggggggactaagaggagggcgaacgcatcaccctcgggcccgacgtccctcgggggtacaaggccacgtgtgcgattgtgtctgcctcaaacctctagtcatgatactcctgatcccatgtcaccgacagtagcctccggcgttatgccagggcgatcgccctctttaagggaaacggtcgggcgtgacgccactcctaagtcctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatacccacctcatgcgccgcaagcgggcgaatgggattagtggaagcgtgggcgcgagaaacgagggggcgaaatagtgggcgcgagaagcgaggagccgggcacagcgttggcaagagtataaaggcacagaggaagggatctgtttccttcctttcgccattattccccttgtcttcgccgcttgcaccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccagactacccggggcggtccgtcttctttctcccctttgcaatggcagggctggttccaccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccattggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcgacgtgctcggggcgcctgggagtacaccgggtccgaagacttcacgaggacccaccagggagtgagatgggactgggctcctgaggacttcaagatattggtccaacgggtgctgaatctcaactccgtagaggcggccctcattccccaaggaatcctccccctctgcagcgatccagaccgcgcctccatcctgaccattatgatggcggtcggggcctcagaggagcgagctccaaagggccacgacggtgcaggcgggagccgcaggggggaacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagtaacaggcgcccggagggggccgcgccaacatcgcagcccgagggggagcgcaagaagaagcggccccgtaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggttttttcttttgtttcagcgagatcccgtcgcgtccctcccgccattccaagtccggccagtctgaggccgaggatccggcggccgcagaggccctcaggcgggaatctgaccggcgagaggccgcggatcgcctacgggaagctgaggaggccgcccaggaggccgcccgggctcgccaggccgaggaaaccgctcgggaggaggccggatttcgccaggacgaggcgatggcgacttccgaggcagctcgcgacgaggccgcgggcgcgtcgcttgggcccactccctcgggcgacgctcaggaccaaccgggtcagggggacatccccgagtccggcacttccatcggcggcccgagccgcgtggcatcctctccaaggcggctcttccccacgccttctatcgccctactgaacgcaaagccccttctgcaggccttggccgccgcaaacaccacggtgttggatgggttaagtgcccaggtggaggtcctgcaggcagagcgggcggagctcgacgccgcgtgggcgcgtgtcgaaaaggggcgacgctcggtggaggccatggtggaggtgggccgtaaggctcaccgccggcacgtctcggagcttgaaactcgtaagaaggtgctggcggagatcgccaaggaagtggaggaggagcggggggctgccctcattgccaccaccatgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctggcggaccgcgaggccgccgtcaccatccgggaagcaacgctggtggcgcacgaggctgcctgcgccgaagaagagttcacgctccgcctccgcgaggacgcgctcaccgaacgggagcgagctctcgagggggccgaggccgcggcgcaacagctggcggtcaacctgtccctccgcgaggcagcgcaggaggagcaggcgcgccgcaatctggaaggtgcccgcgccgagagggccgtactgaaccaacgggccgctgagctcgaggcgcgggcgaaggagctggacgcgagggcgcgcagcggcggggcggccacgggcgaaagcgacttagccgcccgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaggtccgggatgccgccgaccatatcgtcgacagcttcgagggctcggcccctcggcttgcgttcgcccccaactccgacgaggagggcaatgccggtggtgcagacgacagtgacgtcgaggccggcgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggccaggccgggaacgtggtgaccgagggttatgggtgacccgattgtgggtttttgccgattccccctgggagttcaccacgcctcggggcacggctcggttctgggccccgtttggcgattttagccgacccgagcccccgagggcaggattgagcacgagtgacctatttcaagtcaagattcttcaaaaggaaaaaacaacacagatacagcctttaggaaattgaaactgcttttatagaaattcagatataagagaaataagaatatgcatatgttgtagcccccggccaaccctgcacgcccgaggggggtgcggggttggcccgagcccgaaacctgacacccgaccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgtcgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattaagagctgtcggccaatagaaaccctggcgaaaagctttaccaaccaagatgcgcgaggcggagtgggctccgcattcgccttcatggatatcggcaagaagcacaacgccttgttcccgaggaatgcacttcaggaggattccattagccgcgcgctgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcgggggccggtcaggcgcatccgtctctcctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgtgctggcctcggggatcgagacgggctcgggagccggggtccactctgccacaaaatcggcgagggcctagctcttgatagtgtggcgtggttcaaagtgcaaatcgaactcagaaaattcgattgcccatttcaccacccgtcctgtaccctctcgattatgcaagatttgaccgagggggtaagacgtaactactgtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttatcttctgtgctgatgacctcggggtcggaggataacaggggcggccttcccacagtggcttcggggccgtcctgggggtcgggggctcctggcgtcgtcgaaaaagcgggcaaagggccaactccggtcgtcaggggccttaggcctccgttcggctcgggggcctcttctccctgctctttcccgggtcgggtcagcacagggttagcctcggggtcgaagggcgataggtgcggccttcccacagtggcctcagggccttcctgggggtcgggggctcctagcaccgtctgacaagcgggcagagggccaactccggtcgtcgggggccttgggccaccgttcggctcgggagcctctcctccctgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccgtccaggtaaacagtccggagcgtttgagaagcttaaataagggtaacgccttctctcccagcctcgatatgaaccgacttagggcggccatgcaaccggtgacgcattgcacatccctaagtttgctgggggggcgcatccgctctatagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctagttgcacgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgtagtcttttcctcatcctccctagccatgcgaatctgatggtaaccagagtatgcatctagaaaacacaaaaggtcgcaccccgcagtggaatcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcttccagaagtcgcgccacctcctcgcggatgaaggcttgacgtttcggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcgcctgtgatcatccgttgcctcggggtggcgggggcggaagcgccaagcctctcgtcgccaccctcgggcttggatgcagcgacgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcaccatccccggggccttgatggcgtcaaaggccgcaggggaaaggatgttgagggccgctcccccatcaatgaggacacgccccaacttcacgttgcaaacggtgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcgggggccttctgcttggcctcacttcgccgattaccggaaggaaccgccggggatttgccctctcggcgctcctgcctcctcttctcctcccacttcctcgtccgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctctgcggtagtctggggctccttggaggcgatcttttcaagcatgcggttgtgccgcacaccccccctgaacgcgtaaatcaccgcgtgcgcagggatgcatggtatggtgttgcggacttggacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccgacgctcgatactgatgcgagcatccggttccctacgcagatcttcccgggtcggaggcgttcacgaaggagtggcggccgaatggcgaacagcggctgccgctcgccgcgccctccatcttgacgatgcggagccgatggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgccctggggcgtgctgccgtcgccgtagacgaggaggcgatgctccccatctcgccgcccttctccacctcctgtgggtgtcgaagtcgcggatccttcggccctctcgagcgccttctcccacctaggactttggcgtggagggggcagtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagccccctacctggcgcgccagatgacggagcgtggggctcctcaccgggagaccgcgcaggcccccctttgccggttcggccggggactcagggagagattctaagctctctgtatgtggaaggctcgcaagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttaccccccccccttttcataaatggacggagatttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggtttggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtgttaggtgagccccactgtgctcacctaacccatacacgcggagcaaaaacccacgaggggtcggggcgcctcggccctcggggccgaggggggtgcggcccgaccccctcggggggactaagaggagggcgaatgcatcaccctcgggcccgacgtccctcgggggtaccaggccacgtgtgcgattgtgtctgcctcaaacctctagtcatgatactcctgatcccatgtcaccgacagcttatatcccgacgctccttgagccaaatcattagcctctatattctgttctcgagatatgtgcttcaaagtcaccagccgaaattcacttatcaacgttcggcacttttcgtaataaaccatcaatgtatcatccttgcattcatactctcctgtcaattgactaatcaccaacaacgaatcacccatgatttcaatagcatcggctgcaacttcctgaagcaactgtaacccttttaacactgcctcatactcagcctgattattagtcacacggtgtttaatagcataggcaaattcaaaacttgcccccaaggcgcaattataaccaagccgataccataaccatgactgcatacagattcatcaaagaataatacccaaggcataatgtcaaccaagccgattgaatcatcacgatgacccacaataaaatcggctacagcctgtcccttaatcgcctttggtgattcatgccgaagatcaaactccattaaagaaaatatccacttgccaactctccattttaaaatcggagccgatagcatgtacttaatcacatcggctttacacaccacagtgcactcattggacaacaagtaatgcctcaacttagtacaagagaaatataaacacaaacacaatttctccacaggagaataccttgtttctgcatccaagagccgacggcttaaataaaacacaaccctctcttttccttcaagctcctgaatcaagaccgagccgattgacttatcaccggccgacaaatataatcggaaaggaatccctttttatggagggatcaatactggaggagaacttaaatattctttaatattatccaaagctttctgttgttctgccccctaagtgaattgctgatcggctctcaatcttaacaatggtgtaaaaggttccagttttccagacaaattagaaataaaccttcgaacaaaattaattttgccgatcatctcctgcaactctgtcttgtttcccggaggcttaatctttttgatcgcattgatactcctctgaggtatttcaatccccctttcatgaacaagaaatcccaagaactggccagccgatacaccaaaagcacattttgtcggattcatcttcaaaccatatttcctagtcctctcgaaaacctttctcaaatcggctatgtggtcctctatttctttggatttaacaaccacatcatcaatattgacctcaaccaaccatccgatcagatcatgatatatataattcatagccctctggtacgtagctccagcgctctttgagccgaaagtcattacaacccattcaaacaagccgattgcaccaggatatctgaaggccgtcttatggatatcttcttcggccataaagatttgattatatcccgcgttcccatccataaaacttagtatcttatgtcctgaagcagcatcaaccaactgatcggccattggcatcggatattcatccttcagggtagctttattcaaatccctgaaatcaatgcaaaccctcaccttaccatttttcttgataacaggaactacactagaaaccctttcagcatatcggcaaggacgaataaaaccagcatcatacaaacgtttgatttcagccttgacaggttcaagcatatcggctttgcatcttgtcacgaccgaaaaaacccaacgggcgttccttacgtgcgtgtattattccttgtcccaggaggcaaggtacaccaaaagttgatacaatacagagtttaacaagcggaagcgtaaataattaatttattacatgggcggcgaaggcccagcacacatgaagacaaacgaaaaacagcggaagactagggtgacgaccacaggcgcttgacggcaggtacgagctagacaccaaagccttcatcttccaggaactcctcttctgggtttgggaaaaattgagcaagactgagtacaaccaccgtactcaacaagacacacccacaagtgcagaataaatgcaagggagtacaagggagtcataatatagggggttagggtttgcagtaaacagcattaaaaggcacttagttgctcaagctattttgtaaatacgatcctagagctatacaatattattaatcaaggccgtgaacccacacgaacctgtcttaacccaaggcctacgatgattcagaccgaactggcaacccgaccctgggtcccagctcgtcccaagccaacccaggccaaccattccacattttagttgttaagcaagttttaagaatttaaaacactaacttgggtacattgctcggcttgcccataactgagggcgcggctattcgaatagattatactctgatcagaggtgtacatctttacccacaagacatgtcttcctcacgtgtaaccacgtgccacataccaccacggcatacggacggaagacatgacatagtttccaacccatcctagccatagacaagagtaccgacccaaccccacctacggccggaacctccgggacaggtaggcaggactgagcccctagcagcaggacaccagccctgtgccatgacatatcgactaccgggccgcagctcgtgtagccttcattttccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcataaaaccattttgagggttttgaatagagggggaggtgtgaatccaattccacaataatccaatcattccatagtgtccaggtgatatgaatattcccaaagtctagagttgtaaaaccacctaatgttgcctaattaaccagcgaagcatctacgtaagttcacactagagtacccactagttggggttttgtttattctagggtgaacaaggtaataataacaataacaataataataaggtcataacaaaggtaaataggcatggctaaataaaacaatgataacgcgggaatttaagtaaagcggtaatgcaataatttaaatcaaaataattttataaactgggattcaatatgttcaaggatgatgtgacttgccttgctcgctttcccaaacgtcagcttcaacctccacgtagagcggatcttccgaagctccagcgtctacacgaccaacggaaaggaaaaaggcttttactctaaaaaactccatataacaagcaggaacaaaacacaaaaatgggttcttgacttcttaaggaaaaattagagacttgaacggtccaattccgagttcaaatggccaagttatgaacatttgaagtttatatgctctttaagtgaatatttgcgaatttcatcatttaaattttaatttaaaaaggatttattgcttcagccaaggggagggggcgcgcggaccgggtccacgggagtggggcccacgcggcagcctcacggtccacggtggaccgggcgcacccgggctcacaccggccggcgccgtgggtcccacgcgtcagccgggccccacgcggcggccattcgacgcgcccgaaggcggccacgacggcgcagccggccggaggcggcgcccgctcccctatggtcgccggcggcggccataggcacggcggagcggcggccgagagaggggaagggaagggggaaaagaggcggcggtccacggctcaccctaggtcgacggcgacgacgaaaagggcggccggagcggaggaaggcggcggcgcggcttaggtcgatagggtcggcggcgttccggcggtcggcgagctcggcgagggggtggacggggtcgacggcggtgcggcgaagccggaggaggcgatgccggggcgggagactgtcccggcgagtggagaaggccggccggaggtcgtcggcgatggaggagagagagggcgacggcgcgagctcgattccggcggggagacggtgcggcaaggggcggaaacgggcgagggaggcgcggggagggtttaaatagggttggaagttggagaggaaggaaaccggccgggaggtccggccgccatcaatggcgccggcgagatttgcgggagcaaatccgcccgtttgaatgcgagagagagagggaaaaatggggggacagggggaggggatcacggggaatatttccccccacttaattgcacgcggggacagcgggatgcggcggattcggcggcggcggcggcgcttggcgcgggcggggaggcgggagcggcaggaggacgaggatgacaggtgggccccacccgtcagcgagggtggcgggcgggcccgcccgtcagcggcgcgcgcgcggggagaggccgagtgggccgcggggagaggagagagagggggagggagatgggccgagccggcccattagagggaaggggacttttttgggtttttctttttataaaacctttttaactttgtttatttcttaacaattattatttgtgctctgaaaattccactaaaatttatttatacattttaggcttttaggaaatatacaaaaatcctctaagccttatttgacttttactttgcacattttaatttttggaggctttcacacggattttaattattctaggcataatttaaaggatatattttagggtcgttttgggacgtgacacatcttctcggaggctgctggtgtggtctaatccctggttttaaaggtaatcgatgctcgacgatcgatcggctgagtcctggcatctcataatactcccaagcaaagcaatctctaaactctttcaaaagttccatcagcttggttctaaattctgaagacaaattcttactaatgaatgtcagccttggtcgatcacccggacctatatccacttcttctaaatcatcggctgacataaaaccctgaccttgcttgtcatcgagatcatctaccgtgtccttggcgtagacgcttgaaccctccacgacgccctcaaaataataacttgggttcttcatcttcaatcggttgtatatcagaatcggacacttttagaaaatctccaacccaaatcttcccggataaacaatcaaggtcatccatctcccaaagagctagatcggcactggcaacattaactgacttgtcggctggcacaatctcaaccttgtcgccttgccattgaatcaagcattggtgcatggtcgaaggaatgcaacaattggcatgaatccaatcacttccgagcaacaagctgtaagaacctttcccatcgatgacaaaaaatgtggtagggatagttttactgccgactgtcaattctacattcagaacaccctttgtttccgatgggttgtcaccaaagtatttaagcaccatgttcgtcttgatgagatcctcagtagttctagctaactttctgaacgtagtataaggcatcaaattcaccgcagccccatcatcgaccatcatattagacatcggcttcccattgacatagccatttatatacaatggtttaagatgccgattttctgtcccctcaggcttttcaaagactgctcgttctggtgatagaaccaacttagccgatccctcttctaattcgtcaacatcggcctggtcaatcccaaattcggctggcaaagtaaagaccatgttaattggcgccgtcacaacacttttcccatttgccaacctctttgcttcgtcggctgcaatatcatcggctccaagatcttgattcttaacacaccactccttccttggctttgcttttctcagccgatgaccaatttcttgctcgacctcctggaagcgctccctactcctcaacctttgaacccttcttttctgattctttgtaaaaaataccagaaggataccactgggtctttgcgttctcgtcttcctccaagtaatcgtcttgatttaccgggcccaacctttgatgaacaggaattctcgcctgcttcagccgattgcctctattgtacgatcagcttgaactctctgtaatatcactgcacccaggacagtcttcaatagatggtagcctcataccttcgttccagcagaaccgaaagaactcacaactccaatgaggatcgaaaccatcattatcttcttcataatgcctctcttgttgtttgccgtatttcttctgatacttatttataattttagccgaattcacgcgaaaacctctcgctcgtcccacatcagctgtccgaccaacggtatgcaccatgttaacggggaaaggattaccatcaaccttcatcggctttttggaatcatcaaacttaatcttccctccttcaatggccacttgaatctgctgtctaaaaaccttgcaatcattagtagaatgagatccagaattatgccatttgcaatacctccttttgcctagttccttggccgatggaattacatgaccagcggggagttgaatttgcttctcccggagtagcagatcaaaaatcttgtcagctttggtaatatcaaaatcatatttctcctcttttccagaattctttacccactgacaaggtataacctttttactccttacccattcggctgcagctatttcggagtcatcgtcgtcatcatccgatccatacacgtaagggcagacatgattaaccctcttagagcttctcctggcctctgcaaacctttgttcatgcaatgttaccttctgcacgagatgcgacaggctatcaaaatcttcagatgagaatttctccctaatcagaggaatcatgccttgaaaagccaaatcggctaactgggcatcagtcaaacttaagctaaagcacttgttcctcatctccctgaacctctgaatatactcatgaacaggttcatcatgcctttgcttaattgccgtcaagtcggataatttcatctcatgaactccactgtagaaatagctatgaaactgcttctccaaatcggcccaactattgactgatccatacggcaaagaagaaaaccatgtaaaagccaatccagacaaggacaactgaaataatctaactctgagagcgtctacagccgatgcttcgccgcactgagctaaaaatcggctaatgtgtttataagttgacacaccatcttgtcccgaaaatttggagaagtctgggattttaaatcggttgggaagagggactttctcaaaccactcagggtaaggttgccgatacaattttccagtatctctcggcttaagcccaaattgttctctcattacatcggcaattacatcggcccatggtcgttgttgagctactccttgcgactgttgctgtattggttcaaactgattatattgagaagcaaactgaggttgggttagccctccctgctgatactgaacttgaggggaaggaggctgatattgataatttatattgcccccttggcaattctggtaatttggctgaatactttacaccaaatgttccggcatactttgcaccaaatgctccggcataatctgaggcatcaccgtaccatctggctgtatatggtgaaccaaatgttctggaacaacctgattcaggacgtgcccagccgattgcccagccgattgattcatcaaagcctgctgcagaatcggctgtacagtttgttgttctggaggtgttggctgaactggctgcacaacctgctgccttggtggagtctgttgaatcggctgcacaacctgttgccttggcggcgcctgctgaatcgaattgacagtagattggaggggtagaaacatagcagtcacctgatcctgtgttggccgatttaccgtctgcccgctatgctgtggctgctccctcatcaatagccgaggattattcggctggcctagtgtcgacgctgatggagcaggcaaagaagtcaatggcggtgccatcggctgagccgatggtgcactcggaagaactgcttgagtaggcggctgaacatcagtgatcagaggttgataattcgggaaaacacctccctgcaagtagaccgggcctgcagcttgatgctcgactattgatccatcggctatcgtcttcatcatgttagacaaggtgttgactaacactctagattgattgatcagagcattgtgtacggcgtagtccactcgatcttggaaattgttgaaaaaatcttgtgttgtctcaccattctgattaagatttcctctttgtggctcatgagcaccatcaccttgaactgcatgtaccccctgagagccgtcaccctgattctcttgagctgagccatctaaaactcttttttcttctctctccttagaggtactggtctcaggctcatcgggaaccacctttaccttgtacttttgaacaatgttgccttgcgagtctgtgtgaatgacttgaagaactgttctcttgttgcatcattgcttcgaaatccttcttctggtcaggtgtgagcttttccggatcaatagccacaatattcccttcattaacttcgctcaaacctagtatttggattttctctttaacagtacctgggctagccgaggatggcgacggtggcagcttctcggccatgaggaagattaatttctgactcctaatgggtcccaccgggcgtgccaaaagtgtgttgacagaaaacacgaggcctgggagatctgcttaactccagtgcaggtccaaagctcgccttcagatgtatgagcgtgccagttgatttgatcctgcaatcaacaagagatagaacaaagaaaccgcaattaatcctataaatgatagccgatcgactagatgccgatgacatatcatttatttcaagccgatgtcatgcgtacatcgatcgg

SEQ ID NO: 60651 - DNA, 10717 bp, Oryza sativa
ccccacggccttgataaataatattgtttagttctagaatcgtgtttacaaaatagccctgagcaactaaatatctttaaatgctgtttactgcaaccataacccctttatggtataactcctttgtactcccttgcatttattctgcatttgtgggtgtgtcttgttgagtacggtggttgtactcagtcttgctcaatttttcccaaccccagaagaggaattccaggaggatgaaggcttcggtgtctagctcgtgcctgccatcaagcgcctgtggtcgtcgccctagtcttccgctatttctcgtttgtctctgtgtgtgctgggccttcgttgcccatgtaataagttatctaattacgcttccgcttgttaaactctgaattgtatcaacttttggtgtaccttgcctcctgggacaaggattaatgcacgcacgtaaggaatgcccgttgggttatttccggtcgtgacaagttggtatcagagcccctttgaccctaggacgagccgtagatcccaagccttagcaatattttcaaaaataaaatcccttcttatttgtgaaaatcctctagtctctctctgtcttgctgcttcatttatcgccaaaatctgacctttaaaatgttgcttttctttttgtttttgtttgtagatggccggcagcgtcacccgtcgtggtttggacatgactggtttcgtcttggagctgcggggtatgtgcgtggccctagggtatccacacggagtggactaccaggccaggccgcttccggagcaggagggtgatgatgcagagccccacgctgcttgggaggtcactgcagtgatcctcgctggctctcccgagcggtcttcgctgacagtcaccgcgggtggagactccttccccgccgcttgccagagcgccgctctcctcgccatcagcactcttcaccagcgctacccggacgagttgcagcactcgccctaccgctaccaccctcgtcgcggaggagcccgcgaccacgccaccttccgggatgctagctcggaggatgacgctaccatcgtgcacctggcgcgcatggtggaggcgtacgacgcggcttgtatcgacttccatcagatggtgcgccgtgggatggtcgagaacaacctgaagatcctggagctgcgtcaagagaacctgcagctcaagaaggacctagacgcagtggaggcgcagctgcatcagctcaagatcgcccagggagagatctgccgccccaagcgtcgccgcgtctgccgcagcctgaagatcaccgcccgcaagagcacctccaggcccgagcttgttcgtcagtccctggcgtggacttgcttcgtcgagacccctcttgccgagcccgcgcccgtggttccccaggagggggaagcctccggcgttggtagcacggaggatgcgcagttgctcaccttccgtcctggcccgtcgcagcagtagacgagcagttagtaggcttgcgcgtgtgttctttctcgtttgtcttgttgttgggttgtgtggggcacggttatgccggtgtgtggtgtaactgtgtcggagcctgtctttattttattcgcctaagcaacttgaactttaatgaacccatttaatagcagtaataaattcaagaattatggtagtcgtgggtggttagctttaattgtcagctctctctgtttgctggttctgtgtggggttttcagatggtgatgaccaggagaagtgctaacaccggtgatggcaaccaacctgaaggcagcaaccacaaccatcagggcaacccacctccacctcctcctccacctccaccaccaccaccagacaccaacgccattctcacccaaatcctcgcccagcaggccaacatgatgactgctttcctccaccacctccaaaatccgccacaacttaatgctccaccaccacccccacaacactctaaactcgccgagtttctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgcagggacccgcatctctatggtgggaccatttccaggctacgcagccagagggacagcctattacatgggctcgcttcaccgccgctttccgaagaacccatgtgcccgccggagtcgtggcccttaagaaaagggaattccgagagttgaagcaaggcgaccgctccgtgatggagtatttgcacgagttcaacaacctggcccgttacgctccggaggatgtgcgggaagatgaggagaagcaagagaagttcctggcaggaatggaccctgagctgtccgtccgtctagtctccggggattatccggatttccaacgtctggtggacaagagcatccgcttggaagccaagcacaaggaactggagtcgcacaagcgccgcttggcgaatttccgcaaccaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctccaccgactgtgcagcctggtcaaggccgcagggacgctcaaggtccgcagcgtctgtgcttcaactgcttcgagcccgggcactttgcggataaatgcccgaagccaaggcgtcagcaaggccaagcgcctccccgccccaacaacggtggtaaggacgtcattcggggtcgtgtgaaccatgtgacggccgaggacgtgctgacaactccagacgtcatcgttggtacgttccttattcattccatccctgctaccattttgttcgactctggagcttcccactcgtttatatctgtgccattcgtggggagaaatcagttgggggtagaaaggcttagaaaccctctgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagatagaactgtcagaaattcccatcgtcagagagttcggagacgtgtttccggaagaactacctggtatgccgcctaagcgagagattgagttccggatagatcttgctccaggaaccgctcctctgtacaagcgaccctaccgtatggcagcaaatgaactggccgaagttaagaaacagttggaagagctgaaagaaaaggggtatatacgtccgagtacttccccctggggtgctcctgtgatttttgtggagaagaaagacaagacgaagaggatgtgcgttgactacagagctctcaatgaagttaccatcaaaaacaagtaccctcttccccggatcgatgatctgttcgatcagcttaaaggtgccactgtattctccaagattgatcttcgttccggatatcaccaattacgtattcgcgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgtggtggttttcattgatgacattctgatatactcacaatcagaggaagaccatcagcaccatctccgtctggtattgggaaagctgcgggaacatcaattgtatgccaaacttagcaagtgtgagttctggttgtccgaagtcaaattcttagggcacgtgatatctgctaaaggagttgctgtggaccccgaaacagtgaccgccgtcaccgattggaagcaacccaagacagtcactcaagttcgcagtttattaggtttggcaggatactaccggagattcatcgagaacttctccaaaatcgctcgacccatgacacaattgttgaagaaagaagagaaatttgtgtggagcccgcaatgcgagaaggcgttccaaactctcaaagaaaagctggtttcctcgccggtgttaatcttgccggatactcacaaggacttcatggtgtattgtgatgcttcgcgccaaggattggggtgcgtgctcatgcaggatggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcactcagtcggacctgaatcttcgacaaaggagatggttagaactcatcaaggattatgatgtgggaattcactatcatcctggtaaggccaacgtggttgccgacgctctaagtcgaaaaagccattgcaacactcttaacgtccgtggcattccacccgaacttaatcaacagatggaagccctgaacctaagcatagttagtcgcggattcttggctgcgctggaagccaagcccaccttgctcgatcaaatccgcgaggctcagaagaatgatccagacatgcatggactcctcaagaatatgaaacagggtaaagccgctggtttcacagaggatgaacacggaaccctatggaacggaaatcgagtatgcgttccagataacagagaacttaaacagttgatacttcaggaagctcacgaaagtccttattccatccaccctggcagcacgaagatgtacttagacttgagggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggatttcatcaccggacttccaaaaacccaaggtggatatgattctatatgggtagttgtggatcgattaaccaaggtagctcgattcattcctgtgaagaccacctatggagggaacaaactagccgaactctacttcgctaggatcgtaagtctccatggcgttcctaagaaaatcatatctgataggggaagccaattcacctctcacttttggaagaagctccaagaagagctgggtacccgattaaacttcagcaccgcatatcacccgcagacagatgggcagaccgagcgtctaaatcagatcctagaagatatgcttcgcgcatgtgtcctggatttcgggaagacctgggataagagtctcccctatgccgagttctcctacaacaacagctatcaagccagcatacaaatggcaccttatgaagcgttgtatgggcgcaaatgccggacgccgctaatgtgggatcaagttggggaaagccaagtgttcgggactgatatcctgagagaagctgaagctaaagtcagaaccattcgggataatctaaaggtggcacagtcccagcagaaaagttatgcagataaccgtcgccgtgacctggaattcgcagtggacgattttgtatatcttcgggtcacgccattgcgaggtgtacacaggtttcggacaaaagggaagctcgcacctcggtatgtgggtcctttccgtatcgttgctcgacgcggagaagtcgcttaccaattggagctgcccgcctccttgggcaacgtgcatgatgtgttccatgtgtcgcaactcaagaaatgccttcgagtgccatccgagcaggccgactcagagcaaattgaagttcgcgaagacttgacctacgtggagaggccagtgaagatcctggacaccatggagcgcaggaccaggaaccgggtaatccgtttttgcaaggtccagtggagcaaccacgccgaagaagaagctacctgggagcgcgaagacgagctgaaggcagcccatccagatctcttcgccagttcttccgaatctcagggtcgagattccgtttaaggggggtaggtttgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaaagggttttataaaaagaaaaatccctaaaagtccttttccccccttcctctcttgggccggctcggcccaactccctccctctctctcctctcccccgcggcccatcggcctcctccccgagcgcgcgccgctgacgggcgggcccgcccgccaccctcgctgacgggtggggcccacccgtcatcccctacctcgcgccgcgcctgccgcctcgcccgtgccctagcgccgccgccgccgcggattccgccgcatcccgccgtccccgcgcgcaataaagagggggaaatcactccccgtgattccctccctctttcccccctcttttccctctctctctccctcggattcgtttggaatccctcccgaaatcttcgccggcgcaccaatggagcccgagatcgccgcgccgatttccttcctctccggccgctctctccccctcccaacactatttaagcactccccgtgcctccctcctccgtttccgccgttcgccgctcgctctccccgtcggaatcgagctcgcgccgtcgtcctctctctccgccgtcgccgccgagcttcggttcgccgccgtcgtcgccccggacctcctcctgcttcggcatcgcctccttcggcttcgccgcgtcctcgtcgacctcgtccaccccttcgtttcgcccgccgaccaccggaacgccgccgtcctcgtcgacctgagccgcgccgccgcctctctccgcttcggtcgccgttcccgtcgtcgccgtcgacccggggtgagccgaggaccgccatttcgcttcccccttccctcccctctctcgggcgccgctccgtcgcgccggaggtcgccgccggcgaccatcggggcgcgggcgcgccgcctcccgtcggccgtgccggcgaggccgccttcgggcgcgccccgcggctgccatgtggggcccggccgtcagccgcctgcgccctcgggtgcggctgacgcgtgggacccacggcgccggccggcgcaagccgcttgcacccggtccaccgtggaccgtgaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgttatcgttattatttctttgttcaccctagattaaacaaaaccccaactagtggacactctactcatggtgccactagtacaattataggtagatgcttcgcttttaattaggtaacattaggcggttttacaactctagactttgggaatattcatatcacctggacactgtggaattgttggagtattgtggaattggattcacactgccccctctattcaaaatccccaaaaatggtttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgacggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtgtttacaaaatagccctgagcaactaaatatctttaaatgctgtttactgcaaccctaacccctttatggtataactcctttgtactcccttgcatttattctgcatttgtgggtgtgtcttgttgagtacggtggttgtactcagtcttgctcaatttttcccaaccccagaagaggaattccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctaattacgcttccgcttgttaaactctgaattgtatcaacttttggtgtaccttgcctcctgggacaaggattaatgcacgcacgtaaggaatgcccgttgggttatttccggtcgtgacaagggtggattaatcataccgatcatatcaattccccaacctctaaaaggccacggtttaataataggattcatagccgatgctggcgccctttggatcgctccaaacttctgacaatcttgacaacctttataatatctgaaacaatcctccagcattgtcggccaaaaatatccagcacgtcggagcaaccacctcattttatgagccgactgatgtgtaccacatatcccttcataaacttcgccgattgcaacttttgcctgatcggcactcaaacatttaagcaacactccatcaatcgtccgataatagaagtcatcatccaataaagtatatttcaaagctttataacgcaatttccgcgaagccgattgagatggattctgtaaatactgaaacacatcatatctccaatcatcggctgtaattgtagcaatctctatttcgatatcttttatcattggcttatgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttacccccccccttttcataaatggacggagatttgtatagtttccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggtttggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggatcaacgactgcactgcactgcgttacatgcggcgtgacacgctcagccaaaccgcaataaatgtggttaggt

SEQ ID NO: 60652 - DNA, 1762 bp, Oryza sativa
atccgcttttgcaaagtccagtggagtaatcactcggaagaagaatcaacttgggaacgagaagatgaattgaagtcagctcatccgcatctgttcgccagttcttctgaatctcgaggacgagattctgttcaaggggggtaggtttgtcacaccctgagaattcaaaatatgtaaattattgtttaaatggaatttttagaatttatttttaaaagcctagaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatctaaattgaaaaaggttttaaaaagtcttcttttggctttgggccgaaagtcggcccaaaaccttctctctctctctccccggcccaagtcggcccagtccgcagccgagccgcccgcgcgcgccctcgctgccgctgacaggtgggtcccgcttgtcagtcgtcgtcttcctcgcgcagccgccgcccgaaaccctagcgccgcgccgccgccgttcctttccaaatccggccgcccctttccttctccggccgaattgatagaggggaaatgatcctcgggatctcctctaccttttctcctttggaaacatcggctaaatcgttttggaagttcgtggaatcgagttcgattcggatcggcctctttccttcaagccacgaagtttcctcctcgtcgccggccgccgtgggccttcgtcgccgcctccgagcccctttaaaaggaccccgagctcttctctacccgccgccacccttgccttcgcctctcgtcgtcggaaatgccctagcgccgtgtgccctagcgccgtcgtcgccgccgtcgctccagccgtgcgccgccgccgttccagacgtcgccgtcgctcgggaaggacgtcatcgtggtcgccaagtcgtcgccgtcctcgtctgccgcttcgccaccgtcggagaccgccggagcatcgtcgccgccgtcgacccgaagagcttcgccgcttcctcctcgtcgccgtcgccgtccgttgatcttccgccgtcgctttggtcgccggtgagtccgtcgtgccgtccgctacccgttggtgccctccgttcgtgccgtagtgccgccgttcgccggcgagcgtgcgccgtccgagccgccgagccgccgccgccggtggtgacatcaccgctgacgtcatcggggccgttcgtcgtagaccggtcgtggaccgatcgatctcggccgtccgttttggatcaagtcgatctcggccgtccgttcgtgtgaaccgccgccgtgcgcccggtccaccgcaaaccctagcctgctgacgcaataaatccccttttccttttcaaaaataattcattattgcgtcataattcaattaaaatcaatataagtgttttaatccgattaaatcttcaaaaattcatatctaattcatcttagctccgatttagttggttcaagtctctaattttttctaaaattgagatctacatgttaaaaatatccacatgtactgttcatgcttgtttatgtgctgttttggtgtttttgctcttttctgtttagattccgtcttttccggagagtccgttttcgccggagaagagtttgaagagttccaaggccagcaaggcaagtcacacagatcccaaacaaccctttgagcatgttgatc

SEQ ID NO: 60653 - DNA, 2395 bp, Oryza sativa
cggttaaccctagggcgtggcatgtgggctttgttgaactttggtctcttcaacttatcgatgttaaagtattattgaactttgtttatattattcgtcgaacatattatcatatcattaatcatcatataatggtattatgtggagtgtaatgatgtaagaataaagttataaagttatcttcatgtataattaaatatgtgattatgcctcactttgttgtttccaatatgaattttcttccaaccaacatcgctaggttctgtttcgacgtttccatttccaatatactgatatcgttatcgtttttttataccgtttcgattccgttttcggaaaaaaagaaatatagaaataaaaatggtagagggtttttccgaccattttcatcctaaacaccaacagcaccatctctctccaaattgtactagcatcgtgttattacttattccacgttattatggtaaaaaatttcacggcgcaaagcatctaggctagtccttaattcactacgtagactcgtggtaccgtttgtaaaaaaaaaaattgctccttggaaatcgagcgattttacaaaaaatgataaaaatcctagtatgtcccaaaaattgtttagagttttaccctgattccaaagtagcaaaaacttataaatttccttttgttatgaaggaggcccaagttgcttagatgactacgtacgtggtataattttcaataaaaaatcggtgcgtgttgtatacgtgagatcctttttgtttgactatggcaaatgtcaactaaggaggtcccacttgcaagacgttgatgttcccttaattattttgcaagtaaaaaaaaagattttgcaaagtaagcgtaattcaatcgattaggtttttttttagaccaatctacccaattgaagttatagacttgacatgggtgctcatatttatagtttttattattatttgatgggaatagcttattattttataatggtaaacgacatacccgtcgatagtgagtcgtccgtggtttcgtcaatctcaagatatatcggtcggtctttcgaaggtacttgtatgactagggtgtgagtgtttgcatttagggtaagagcgcatatgttgtgtacttgtgtttgtatatgtttgtaccatatttctcggaagaaaaaaaaaaggattttgccaaatgcagccgataaagtgttgagtacttctattttgcccatatatattgaaagatcagtagtgttccttcctttgcaagaagttggtgtaccattctggaaagagactaatctattgatctttcaacaaatttggaactctaaatcttgcagaatattgaactaatgtatagaacccattttgaatgaaaaaaaaggataaacacataaaaatcataaatctagagaaaaaatagttgtcaaaaacataattttgatgcactataactaatataagttttatgtaactaagtataaatgcaatgtaattgggtataactacaagttaaatctacatgtacacaaatctttgatgcaatgcaatattttacagatgaaaaatcaaaatatatactctctccgtccctaaatatttgatgccgttaactttttaaaacatgtttgattgttcgtcttatttaaaaaatttaagtaattattaattctttttctatcatttgatttattgttaaatataatactactactcaagcttttgaatattattcaaaaaagtttttaaaaaaagacgaatgattaaatatattttaaaaaatcaatggcgtatgatctagaacatatttaggaacggaggagtatgatctagaaatctattctggttcatgtacggcgaacagcacaaagggcggaggcgcccaggcttcgttccccaattgggccccttagaacaacatctaagcccgcgggccacccaacttaaaatcccaacatcggagcatcctgggcccaagtcataaaccctagcttctcccttggaatcaatcgaaccgattcgcccccctcctcactcactgtcgtgcttgcctatcgtctccgctcccggtgcgcagccggcgagccggagccgccgccccctcttcgcgccggcgggcttcttccgcctctctgccgccagtccccggccgatcccatcggcagtcggcgggcggtctccccgcgggtggggtgggggcgggacggacgatgaaaccggtggtggggatcgtggtgtcgaacaagatgcagaagtcggtggtggtggccgtcgaccggctctttcaccacaagatgtacaaccgctacgtcaagcgcaccttcaagttcatggcgcacgatgagaccgaggactgtaacatcggcgaacgggtcggtaaccgagcttcccttttcacttcccct

SEQ ID NO: 60654 - DNA, 8601 bp, Oryza sativa
ttgtgacattgagtcttacaagggaaaatgacagtgatgttctgtactgtttcaagtctcaacgcattttcgtctcgtctccttgagagtaatgtgttgatgtgctgtttgcggtggggatatttttcttgtcaaagtgttgagatttcctaatcttgtttaattatttgataataaataaactgatctgatgtgtgttagtccgaaaagcaattaatctgatgttgggatgacagggaccattgctgttttgtcattgcttctgtgtaagtctgctctagggatctgatgctgttggttaattagtagtacgtcctatgacaaaaacaagaggcgtttttcttgacccttttttctatcgaggtccaagattgcgatatctgatgacagtactaatcaatgtccacattaatctcatgcatcttggtatatgtgtgtgctttggttgttaatttggcacgcgtacggccccatctttcttctaggagttcaggatctgcagtggttggcccttgcttgccacttccgtgcaactgctaatgcctcgtactcccttcgtcccaaaatataagagattttggatggacgtgacatatcctagtactacaaatttggacgtgctctctgttcatattcataatactaggatgtgtcaaatccactcaaaatcccttatatatttttttgccgggtaaatcccttacgtattgggacgggggagtacagaacagcacctagttgcaattcaccctgtgtctcatgtcatttagaataggaagtgtagaacatagcagaacatgctctactgttaatttcataactgaatgtgggggtggaatgtctttgctaggccgggagaatggaaaggacaatggtgtgaacagtaaaagttagataatctccacacaatggccagttttggtactgaaaagggtgtagtaattcaggaggtgtgcacttgcaatatgcttacaactgcctagcactgtaacttctgctaactttacctgtttatcgcgtactagttgtcgcaggtgtacccaattgtggtccacattggccatgatctgtagcttagggaaagcatattgttttcattgtcatggactgagcggttggtggtgtgtttaaatcctttgttcggcaagattgccttcattgttcctttacttgcatggttagttgtttagttgctttggggggaacactgacatgtgtgctttacataagtgtttactacacatatgatcagtatgccatttaggtgttttgctgatcatactttctttctagcttgatgcactcatgcttgtagaagttgttcaagtgacattgaggccatcataatggtgacctatcaaacaatgtaccttcatcctgtggtttaattgcaacccttgctgtgatccatttcttttatttcttagtgagctatcgtaatcacttttccattgttggctgaagatatattcatttagacaacggaacatgtatgccttgtagtacattcttttttctaggagattcttatagtacattcagttgtgtggtcatcttcagagtccttttttgcaagcacaacctaaatacttctctctggtagtataagaatggtcagaacctctatatacacaatcagtcctgtcttgagaaattgttaggtctttgtatcgtcgtatagagtactgctgcccattagtcttcgtccgttgaatggataaattcactctgaacaatgtaactgagattatggatcataactcattatttagtaactttattcattgtttcaattacatgcttggatgcttgtcatttacctttgcgccatgtggaactgttataatgcatcagaagttcagaacttgaaccttgttttttttttttttttgagaacttgaaccttgttctgtaatattgaatgtttgaatggtgcaggaaacaaatagtaacattttgaattcattcttttcaggaaaatagatgcgaaggaagagagatctttggatggagaaagaggggattgagatcgaactagccggaggagaaaggccggggcacataaaatggggaagcggcgaatactcccttgatcataatgtgcaagtcactgattaagctgtgatcagaactgaaacctgatcgatgagaatagtatattattcgtaattatgatgccattcttctcttcaattgcagcagaatgcagcttctctcttgagtgctccatcatcttttctgccatcatgtccaatcaagcgaaacccgttcaacagaaacagaatgttgcctgtttctgacttctgtgttttagtactactacaaaaagttctgcaaaaccaaatcgtactactcccctctgtcccaaaataagtgcagccataagttctctacctaactttgatcatccgtcttatttaatttttttttataattagtatttttattgttattagattataaaatatgatgcgtgacttattctttatatttttttaaaaaaaataaaataagacgaacgatcaggtttcaggtagtacaatttctattcccacctaccgtcagaatcaactgaataactgcacatatatctgtgttcttggtactgaacaaacgaggcagaaaattgcgacctgttcttccgtccacaatgcaggaaaaaaaggcacacggccattctttgcatgctgttcttttctctgtttcttgcttctttttcaaacttcaaagtgggcagctttggaagtttgagcacggaaacctgatgaggcaaggaaggcatatcctgactctgcaaagagctcaggacgtgacacctttgcaggcacgtcgtcttgtcatcaaaagttactcctcctagattgcagaggacagtggcagagatccggcatgggagtgtgttcctctcgtctgcacgtcacgttctttagagcctgtttagactgtgtttagatccaaacttccgtccttttccatcacatcaatctgtcatacacacaaaacttttcagtcacatcatctccaatttcaatcaaaatccaaactttggatccaactaaacacagccttagtttcgaaacaaaaagtttttcactccgtcacgttaaatatttggacatatatataggatattaaatatagattaaaaaaaaccaattacacaaattgcgtgtaaattgcgagacgaatcttttaagcctaattacgccatgatttgacaatgtggtactacagtaaatatttactaatgacggattaattaggcttaataaattcgtctcgcaattttaagacggaatctgcaatttgttttgttattaatccatgtttaatactttaaatgtgtgttcgtatatccaatatgacacgccaaaagtttttgttcgtaaactaaatagtcccttaatctttagttacacgatttaaggtgatgtttgggtgggagggactaaactttagtcctctcagagactaaaattttggtgagagacctaaatttaattgaagatgaatatcggagtgtcagagagaggacaccaagatccagacaatcaggccccccttccctgtcacacccgtgtcactggtcactagacatgcaatgtgtacactgtacagtactgaaaagatgacacacaaatgcacttctttgcgagtagtgcatttcggtgtcagttcatatgcgattcatagacttttgaactttagggcccctttgattggtaggaaagtgtaggaaatttgaaggattttaatcctattaaaaaaattcctatgaaagcctttgaaataaaggattggatccaatactatccttaaaagttcctatagaatgactaatcctatagagattttggaggaaagttaacaagaggtccaacctcttggaaaaattcctttgagtctatctctctcatccgattcctgcgtttttcttgtggtccaatcaaacggttatttctgtgtttttcctgtatttttcaatcctctgttttacacttgcattcctgtcaaaatcctacgttttttctattcctccgtttttccattcatgcgattcaaagggacccttagtccctccatcccatgttaaaatagaatgggacatttagacccctttgatttaaaggaaaatcatagaaattttagagaatttattcctataagacttttttcttatatagccctccgaatcaaaacattaaattctaagaaattctataaaatgtctcatttcatgtaagttttggaggaaatttaagaggtagaatcttatgggaagtttcctttaagtctttatctcttctcaaatttatgtaattttaatagttattcatatgtttttttttgtattttataattatagttttacacttgcatttctgtcagaaccatatgttttttctattgctttattttttttcgttcctgcaattcaaatgagcccaaaactttttttttccaaaataaagaaacctaaaatatgataagatatagccatatccagattctttatactaggttattttccatcttattttacgtttgcttattttgggagtaggtttgaagtcttgagcaattttacctttgtctattcctatcacaatgttatgcggactcctatactacttccatttcatatactataagatatttcaacttttttaacttaatacatgattaaatagctcaaatttcatctactacttttatctgaaattatcttatcagtcatgaatgtggctatatgcagttacagttggtagatagaatcgttaacattctgtggcttaaggccgaaattaaacgcaggttgtacgtttgtgaaggctgtatgttgcagtcttgcagaggcgcgtgtttcataaagacctgacattgttgtgaccatatgcaaatgcattatacctgtggatctagatctgctaccgtggaaagcactgatcttgtccaaggaaaataaacgcccacatgtcggcaaaatccacccattgcctccagttgatctttttgctgtgcacatatggttttgtgtgcagtggctaatgcaaatgtgtgtcgtggagagacctcgtacgatctgcgggccgacgtgggggcgaaatggcgaatcgtgtttaaccgagcacgttttactctatcggtagtcatctcggccgtgccatctcgttgtgcaggatgccggtgaaattctctgtgcttgggccggcccagctgaaaccggcccatgggctgcgattgggttgtgaacgactagctacagtacaaacgccatggatgtgctgggcttgccatcgttcagcttcctcagctttgacgcaagctgggcctcacggccgtggtggtgatccctcgcgccgcgcttcttgcgcttcgccgccgcggcggcggcgtcggcgtcggccatgtcgagcagtatccttgcctgctcgagcagcgtggcgagccccgcgtacgcccgcttcatctcctccacggcggcgtccccctgcgcctccaccgcgtccaccgtctcgcgcagctgccgccggttcagcccggcgaggtacgccgtgacggcggcgctgggtggcgcgccgttgacgagcgacgccgcgtgcgtggcgtcctcgacgcccactggctagtccgtctcgcccccgccgccgccgcagcccaggtcggcgaggtcgacgcggagcgcgcggccgcggagggcgcggcggtcgaggttgcggcacgcgctgcgggcggtctcgtcgtcgaggtactcgacgaacgcgaagcccctccgccggttgccggcgtcctcgtcgacggcgaggcggagcgactcgacggggccgatctcctcgcacgcgtcgcggagctccgcctcggtggcccggtacgagacgttgccgacgaacaccacgctgctgcaccggcacgacacggcggccatggcgggcgaacttcgaaccggggcgaagtcgatcgaacaggtttggtttgatgattgaatctgaaaagcctttcgatttttctatacaaggagtagtttaatttccgacttctgagtcggtggcgagtacgaacgcgttgggttcgattcgtgaactttcaacacgtttccagatgtttcaacacgttggaagtatttgatccgaccctattttgtacttttaaattaggtctcgattatctgatatcctaattcacttttatgcatttagatgatcttacgtagtatcatcttcattagtatccgttcaagtaaattaacaaaaacaattgctaaattattaaatttctaaaaaataaagagcatatgaagcacttaatttgcaacatctggacggtggaaagcatcaaacagttgaatagtacggagtttgttcgatgcatctcgccaccatgacgtgtaccgcgaaagaaggcgccaaaccgtcgtccacggcgacgacgtgtcgccccgcgcgagctccggtcgggtcgccctcgcgccacgtggaggtcacctcccatttcctcgtctcccacgacgaggtgttcgtccgtgctcagcagcagcaggaggaggaggaggagaaccacaagaccaaaaccaaccatgggcgcgggcgtggcgcgcacggcgtggcgccacgtgacgcccggcgcgcgcgcgcgtccggtcctccattatagggggggaggggggacacgagcgagctccgcgttccccggatcgatcgccatcctcttcttcttcctcctccgtcgttcgcgtgcatgcgtgaggtgctcctcctcggctcgttggtggttctcgccttgttgtcgctgttcccgtgctgctcctgtctctcgcagggagcggaggaggaggaggacgacggcgaggtgcgcttgatggggctcgccggagaggccgctggctcgcctggcagtggcggcgggttcaggtattccgtttcgcttcatctctctttctgatttcgttttcgtttgatccgttttaagcaagttgggggccgaacagccaacgaataagccaaatttaaaatttttaaacttaattttaagattgattttgagatattttcaacgtagtttctttaacaacattggtttttaaatcacccagaacgcatatataaaagttttacctacaaatttatttttatttcctaataagccgttttggcttattatgaaaaaagccaaacgatgggggtttttatttattagatgggtgatttttcattttggattgggagtgttagtttcgaatatctgtatatagccattgacagagaattcgtttctgttattattacctgatattgttgttcttcttgtgttatcatgacagtgcaaatggtaaatttagctatggttatgcgagctctcctggaaaaagatcctccatggaggacttctatgacaccagaattgatggtgtcgatggagagaccgttggactgtttggtgtctttgatggtaatctgatgctttttcatgatgcaattagtgttttgtgttgacttaaataaatatcgtcacctgcttattcagtgattactgatcgtaatactacgtggtttgttttctgcaggtcatggtggagctcgagcagcagaattcgtcaagcagaacctcttcaccaatttaatcaagcacccaaagttattcagtgataccaagtctgcaattggtattgtgctatttatctgtgtctattttctctaaagcaaactacttcacccaaaaattttgtttgcactttggatgtttaattccctgaacattctgtcctgcagctgaaacttacactagcacggactctgaacttctgaaagctgaaaccagccacaatcgagatgcagggtcgactgcctccactgcaattctcgtaggcgaccgtctgctcgttgcaaatgttggagattctagggctgtcatttgtagaggaggagatggtaagattaagaacatttcaattcatgtttactttactgattgttgggcagatagcgtaagtgcttcacctgtacatgtttttcaaccaatgtcctgtcctggtctgtatcatgaatgttcgttgtgtcaaccgagcaactctatattacctattacaatttgcttctaaaatgattgaaacctcagttttgtgatgcattatttcatcttgatgatgcagctatagctgtgtcaagagaccacaagcctgatcagtcagacgagaggcagaggatagaggatgctggtggttttgtgatgtgggctggtatttcaactcttgatctattcattgtgctgatgctacatttaccctttttttcgacattgaacaccaagtccttaatctataaaaatgctaaaattctgttggcggaaattttgtaggaacatggcgcgtgggtggtgttcttgctgtctctcgagcatttggtgacaaactcctgaagcaatatgtggttgctgatccagagatcaaggtcctcaagtttcttccaatctcaaattcataattcatgcagctcataaagaaagtatatgcatagaggccatgaacgatttcaggatacgaccatattacgttatgtactgttgcaaatcgaaattcgacatttatctgcttatttgatctgtaca

SEQ ID NO: 60655 - DNA, 1743 bp, Oryza sativa
atgtctggatttataataaattatatcaaattttgaaataataatttttcgatattatgtcaaattgtcatatttgtaaaagttaaattgctagatgcagctacaaaataggggcaaatacataactaataaataaattaggggaaattgagagtatgaatgtcttttcgccaaaaatttaatattgttaacatgtctatttaaaataggggcaaaacttagttttgtttgaaaaaacaggagtgaaccgatataaaaataggggtaagaacgagatttccccttatagtaaacatgtaacatattacactcatctatgtatggcgtgaatatattatacaaatagcaccggtctataccactgtttatgttttttttataaaactaataactgattttagattgtatcaatgacgtgggtttagacagtgatcgatatggttttgtagagtattttccatacccaaccttaggctggcctgaattcgagagcgagccttgcctactaacacggaaaaccaaacaaagaattagtacataattaattttaattaagtattagttaaataaaaactttaaaataaattaatattgtttttttaaagcaacttttctagagaaaattttcgcaaaaaatggtaccgtctactgatagttttggaggcttgtacacgaaaaacaagatatgggagactgggaaagttgagagaagaaccgctccttgcccccgtgaaagagaagccatcctgtacaaccaccatcacaccttcacaaaaggctcactattcattagtcaactaatatttctggaactatctatctatatattggtgatttctaaaaaaaaacatacagattttttctacccttagatttacacccaaggtactataaaagaaaataacaaaaacatatttacttgcatattatttttatcaaaattactatgaacttacatatcatatcagctgaatttacaaatgttattttaatgttttcctttacaggttaaagtccaaattacctccggactattacgacagtttgaattactcccctaaactacaaaacagaacatttaacactcaacttttttggactggatgaataacccccagtacaaatttggttttgatcttacgtggcatagaacgtgacaatataatccaatttttaatcctaggtggcagtgagccagtgaggcccacccatcatcttgtccgccacctcatgacgcctgtcacctcctctaggtcatgttgggtgtgtatgagatagagagatagagagagagagagatggatatgggaggtgaaagaaaggagaagattggaagtaggttgtcaacaagccgagctcaagtgagctttcacgtctaggctcgagctcgacaaaagctggagccgagcccgaattgagcctaatcctccttcgagcttttaagcaggctcgcgagctcgaccaagtataggataatatataatttgatgataaaattttgtaaaaataaaaatttaattaataatattgaagaaaaatattaggtgtcacaccctgagaattcaaaatatgtaaattattgtttaaatggaatttttagaatttatttttaaaagcctagaaaagaagatctaattttaattaataaattccaatataaaatggggccagataaaaattcattaaatacttggttaattctataatcctagatttttctgggatttatttgagctaaggaag

SEQ ID NO: 60656 - DNA, 8919 bp, Oryza sativa
  unsure (1)..(8919): unsure at all n locations
gaacggaaatattggcgtgagcaccttgttgaaatgtcggaagcactggtaaactgagatatttttcaggagtttcctgcagctccatgcaaggcagcaggaagaacatgagggtgaacacccaaaacctggcattccaggttctgttgttctgcatgcggcagttccacaaagaatgttcaggtactgccggcttatcccagcagatatgccatcagattaccactggtttattctgatgcctcaacagaaagctcgctgaacctggtatagcctacctgtatgtaccacatatatccttgctaggagtacttggaaatattggcacaagtacaacggtactcggtagtacctatccttacaaaaagtggtacattttgatcagagagtgacgctcagtatcagtattgagatcataaaacatgttgatcagtgtgggactttcagtatcagtattgagattagtacacgtcgaacacagcgtgacgctcggtatcagcagagagataactaagcttgacaaatgacaacatgtaattgtcacaggagcttaagacgtttcatacttgagcaacaaagcgatcaaaacaccagcacatcctgcatccagccgctaagtacacaggcaagataatatcaagcacgtaacagatgcagccagtaataatctcacaagagccaacaatagactccgatattacgcattgacacataaaacacattaaggttttgatagataaaaagatctccagcaggagtgtgacaccacatagtctgtaaggaccgtctgggtttattgaccaacattacagataagcaagcgcacaggacacacgaacaaactcgaagcactcataactcgtaggaaaagcacacgacgatacgaactggaaatattcatggcgaacgaatactcaaaagacgataaggcgaagtaggcgatgattggggacgaggttggacgcgtcactcttcctcggattcagaatccgcgctctggagccactccacgaatggtttggcattcttcaccacctgggactccttgccagcagcaacagattcattgtaccactgagttatcacttcttcatccaggatgtccccatcatacagggccttgagaacaatcggcacctccttcacagcttcagggctagacttggcaccgaaggccaccagggcttgcagcaggaccatctgggaggcttcatcaggtacagcagccgcgaggaatttcttcttcttcacaacctccttggcaaatcctttgccgaggccgccaaagagtgcatcaaaaagagcattcatagcatcctggggtggcagggctgaggaagtcatcagacccttgagctgaacagcagtagcacccttgctcaagttatccttcatctccttgaccagatcatcataaggactgcttttagcctcttcaaccacatgttttgcacttccgttggaggcaccctccttgtgtgaggcctcgtgcttcttcttcttctcaggttcttcagtggacagcatcaccatctcagcagttgcagcgctcagttgctcttgcatgcgctgttttgcagcctccagcgaagtgtcagtctgccactggacatcatcgtcgtcatcctcatctgcagccacattgtcaccatcatggctgcgagttggtgaatttgaatgatcctcatcagagccagaagcagccttcttcttcccagcaccacttttagaggaggtgctttccttggatgcacctttcttctttgcttccttctttagcttcttcatctcctcatcagcagcctcaccttcctttagacgctccttctcagctctcctcattgccttcttgtctttcccaccacccttcttctgttcaggtggattcttcaggataaaagttgtgagcttgtccctcatgtcaacgtctgacacgaaaccacaggcagcacacttcaatgtaatcatctgggccttggagatgaggacctcagtctcagggttgccacatccatagcattggacatacttcttgatgaagttctcgaggagaccagccagtttagcagtatcatgtgccccattaaccaaggaagtaccagtcttctcatcaaatttagactgtgcaccaagctcacatccaaagtactttgttgtgtaggaagcaggcctagctagggcttttgctatatccaccatgttcacgatgttagtcttgatgccattgccacggccttctattttggtgatcatcctgggcatcttatacctgtagaaagcatcatcgcggtttgaagcaccaatgttttgcagagccatcttggattaattttctttcaccgagataatatcagaagcaccaagagccagaagtgacaatagtcttgatccttgaagtggatcagcagaaaccagtgcactccaagagcagccagaagtttgcataaattgacaaggcttcggatgcatgcagcagggccttccaagcgggagcttgtgcctttttctcgtccgagaatattctccaagtaatccaactgatcccaagtaaagcaagtcttgttcagacataaaagaagcttcaacttttagaccctccactttgtcagattgcagcaaaactgatgctgcctcctgcatcatacgtcaacatcagattcttcactcatacagacaccatagaaatgtacttatgtaagaaataattcaaatgcaagtaaaatatacaatatactacatatctgatgcatatatatgataccaaagttcaaacgaatactataaatcacttatcacttaaatattcactccatcaacaaagcgaacaatctatctgtttgtattctacttgcattatcctgtataaaatattaggatagtgaataaaaccatttgcatgtccaaaatactgtacaagaatggcatttgtatgaatgcaagatgaagaatgcaacaaaaccatgttgcaatgcgcaacaggctcctttgttacattataatgccagcaaaagttgaaaaccacaaggcacattactgaaagttctaatatgtcagacacactgaccaaacagtttgtactattatacaattgaagcacttattacacatttgtcgaattcagcatatactggattaatgtgtcatctagatcatctgcataataaacctttcaccaatattatataggataaccactcagaaactctatggaccaaacaaatagcataaccatatccatcaaaagtgcaaccagagctaaatagacaaggagactgtcactcaggaaatagaaaacagaagctcgtaagtgcgacatagctacgagtaaagaagtaaccatgcataagcaaataaaactgtgattttgctggccaacatcaaaagtgcacactaggcgtagtaaacaatgccataaataaactcagcctagcagattgatgacatcatggaaaaattaatacaaaaggaaggatagtaaataaggaatacgatagcaattggcaaaaacacatgaacattcaatttcagatggcaaaatattgcagtaataactgggaatggtcttattagcacgacgaaacacaatgcaccagtacaactactacgagatttgattacataatggattcgatcaccccctaaataccagaatggctaattcagtgtactaagaaacatacgacagacatcttttgcatagcactacattcgatgaaacaatcgaaagtttcataaactatcactacaataattaatgctagtaaaatccaaccaatagatggtaactaatgcaactgcaacatgtttaacgcatcctagcagcatgaagtacaacaatattaactgaaaaactacacgaggcacaataatcgaagctggatgaactgcaacagcacgagtatatgaaaatccacgcaacatcacatgaccgagctgacacgttagataatagacgcaatatacacacccaaagtatctgtattcccccaaactccatcactagcaaattactcataatcaggactatcaacgacttcccaagccttagaaatcgttcgatccgacgagatttgaccatgagagaactcctaaaatggcataaatccgcaccactccagatgccgaccagagagaaaccgaaacctgcagagggtgaggagatcaggggaggaggagggatcggggagttgctcaccttgcgatgggcggattggatttggggacgtcggcggcggcggcgggatcgacccgacgagggttcgcgaagcgtggggaaatttgcttgcggcggctggattgtggaagaggggggaggaggatggttaggtaggggtgggttatatagctaggttggctagggcttccattccgtgttggggttggattcgaattctgtgagaggggggaggatctgttgggcctgaaaataggccggaccagggcttagtttggtggattcccacggcctgttttgcaagagaagagaagaggaatggaagtttaaagaagggagttgatggtgtgattgatcatgggagtaaacatttttagtacacatctcttgtttggttttcgcatctaattccctcacagtctcatgaattaacatgtcttccttagataagagattggtaggagtcggacgccttgattctctatcctaaaccctctcgaattctcaagtcctccaaccaaactaaactttttaagctcggttggcatgttcgttgtggtgcgaatggccggtcgcgagttcgactcgcgggacctcacctcgacgggttttttctcgtctttctttaggactgtccttcgggtagtcttgactagaaataacggtacacatatacacacgcgtgagtgttcagtgggactgtatgtttcctgtgcaccgaagcctaatgcctctaatctcaatcttagcgtgtgttagggacgcgcacgcgtgtgtgtgcgtgtgttgttgtggcgtgtgtgagtgtacactctgagttgtatcctctgtcaccaactccctcaaaccaaaccgacccctattattttgggctgtaataaggtccttcacagtacgtctagctctcgtgtgaacttttgatgcgccatctcggatatcggcggcggcgatcggccacgagggttcgcgaagcgtggtgaatcctgtggcgagcggtggtggttaaatctctctctagaagaagactcgaagcgggctgtatctgggctggtatggggtgaacttttttaattgggccgtaattattttacacacctgtacatgtgggccgagagcgcgggagtccgccagaaaaattatgccgtctcgaactcccgacgtcgccggagacgaagacgaatacgacggcgagtcggcgacgtcgacacgagatggagcccaatttctcccgagaaaacggcgcgagaaacgaggggaatctcctcctctcgtgatgcatcgcacacaacaattaacgccgctctagcaacctgggagtactcctatcaacacaaacacacaacagcaagatggagctagctagagatgctctttgcatgcaacgatgcaagcaagaagaacactactcctgtagagtggtagtagcggcagctatacacgcctatacaagcgaatttttttaaaaaataatacgattttaatagaaaatcgcaaaaatataggtcggttcgacgaaatcgtaaatttagcaccctgtcgaacaaccgtgtctcgatagaggtacttatcgaactatggcagttcgacatgtacctgtcgaactgccatagttcgatagggtagttggtccaagggaaaaaaataaaaaaaggacagtaacagtgcctggcaggacatatcgaacaagcaaacttcgatagggtggcatgtcgaacagcccaagttcgatagggtctcagctacagtgtgctacagtgtttttcctctttttaaaaattattttatcatctgtcgaactgcgggcaccctgtcgaactgcggttgttcgataggtaccctgtcgaaccacggatattcgatagagtgccaaacttgcgatttcgtctaaccgacctatatttttgcgattttcctttaaaatcgtattatttccaaaaaaaatcctatacaagcacgttgggtgcatgcactgcacgcagatgagtgaatgcatcgcgttgatcgagccatggatgtcacggtgcatcgacctgggatattaattaatccatccgttctgcttcatcttataattaagtcgctttaactaccttttgagttaaagttctataattttaactaagattatagaaagtttagcagccatctanancacaaaatattttcattaatcaagaattgaatatatttttataatatctttgtgttaaaaatactactatattttttttatgaacttaatcaaatttatactacctctgccttacaaatactctatttttcagtttttagatgtaatgtatgactattcgtcttatttaagaattttctatgattagtatttttattgttattagataaaaaaaagatatgaatagtatttcatatgtgattaactttttcataaaatttttaaataaaacgaacaattaacgttggacatataataaatttaaaatgcagtctttatgaaacggagggaataagtttaactgataaaaaaatcaaaacgagttgtaatacgaaacggatggactggtcctagtgcggtgtcttggatggcgaagctagcgaacgaaccttccatcgatcgatgagagatcgagcagccggagaaattaatagttcccgtgtgcccggccggaatctgattccttttgctaaagtgtgcgcatggcgtatgcccaatactttggaaatttctttattcacagcattcaagcttctttatagttgttttgctatgtgaactttcaaagatgttgtcaactttaggttgtacgcatcatattatgccaagcagtcggtatatcacttggatcatattattcggggattcacaccgcatatgctatatattgatatcaagtcacttggttgattacaattatcaaaaccactcggttggttagattatttattccttgactatatgtttggatggttcaattaaccacatagtcgggggctacacctattaggtgcatctattcgatgcacctgactttatttttcagccctccacagtcttcagatttggtaaaagtactcgggagaccatggcgaagatgattgaagcactcggctttggagtaatctagttcgagagaagattatattttcgactgtgaaggtctcaggggctactgtggagattatgggtaccccatatccacacggcatggttatccgactagtaataggggataacatatatgtatggaatatgtaacagatcgtgacttgggtattacgtttccctatatattatggaacggcctaaagttctggtttgataagattgtaaagtagatttaggaaaccgataccgtattggttaaggtttctatcttgtaatcctgccccccatcctatataaggtgggcaggaagccctctagggggcatgagacacaacctgatcgtcagatcaatacacactcggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacacgatgagagatcgagcagccggagaaattaatagttcccgtgtgcccggccggaatctgattccttttgctaaagtggatacctagcttcggcggcgacgtacgtctccaatggaatcgtacatgtggagattatggatatcccatatctacacggcgatgatatttggactgaatataggataccgaatatagatagaatatcttatgtgtatcctgggtttgtttcctgacttgtatatcaaggaaacaacttaagacttagtcggtcacgactgtatttaatctgtatctgtgtattccgttagggatatagattatcttttgtaacccggactccttcctatatataaggggggtccgggcgcctctaggggcagttgttggattttctccaaatcatacaatcaataacacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggtagcgtcaagcttttcgccgatcagtgcaatgggttccatctccggcatcgacggcctcgtcttcccacccgggcagacgtttcggttcggcagcctcgacttcgtcaccaacaacttcggcaagatttctctcctcgactcggaatcagaccagtcgggagagaaccggatttcggtcccgtttggattcccgaacgcggctgaaagctacttcaagaccatctcaaccgagtcggcttcaaaccactcggccgagatcgcatcttctccaacgataccagatcaagatgatggggcttacccaccagtcctgatgaagctccccgacgatttagcggccgtctccaccacgacagcgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgacattgtggagtacgacgaatttagttctcgatacaacgacttcgacgacttcgacgac

SEQ ID NO: 60657 - DNA, 9803 bp, Oryza sativa
acaaaatgcactcatcaaggttaagaaaagataagagccaaacaacctaagattagagaaaaaaaaacagctccctcaatatgaacatatttattatttgagtaaaagcataacaacactagctatctaaaccgatagcaattaggattaatttgttcggactccagatagcaatgatcaattagcatgatcccagggtacaaggtttgtgttgttctgccagctgaagtgatcatcagcagccatgcccgaattccagctgtacaaagcagaatctggaacagttgatgcaggttctagagtgctgatgttattggtcaccatttcagcagttgaggttgttgcagttcccaagctgtcaacatacatggcattctgagatgcagagctgatcatgctttcctggctcatctcacttggctcccatcctgaattctccatcaatccctctgcttgattgatatagcctgcaaataataaggtccaaggaatcaatgcatgcttttttgaaattaaaaataaagctgacaaagtcagggagctacagcaatttcattacttggcatgcctgaagaaatcatgggcttttcatcatgaaatggaattaagcttttatcaacaagtgccatctcattctgcacttcctccatctgatcccactgttggtatgcttggctgaccaattgcttgatttggacctgcaattgagatcaaagcaaatttaaggtaatcttaagaaattagtaagacaatcaaatttcattgaccatacagggattaattaatttggtggaatgaaggaagttaccatttggtgtggaagcagttcatgcaaagagcacatccgaccgccgaatctcactgctaagatctctcctacggggttgaatttaatctcacaaccttcagatttgaaaacatagcatttccctcccatgtcacatgattttgcttgcttcaatgtcgcgctccactgccgatctgacatgccaacaagctgaacagtgtgtgcacaacagaacaaattaaagcagaaataatttgtattatacaaattatgaactataatcccccaaagtgtttgaacaaaattgaaacaggagaacctacacttttaagcttgttgggattcatggtgttaagcttcaaaaagtcctggacgttcttgatcccctcggcctccaatctcttgtcgattggcccatctttgcctatgttcctcagcctccagacgttgtccgtcagcaaaggagggaaatgcttcttgtacactgcaggtaaaaggaactctgtgattaataatttgttccttctattgttgtacttaatatgatctgttcatcgaacttacattcgcctcgatgatctttgactgtgaagctctcactcactgcctcttggatcctcaatccgcaactgtctgtcagcatgacaacgcgcacaccgattctgaacttcctgctcctgatccagcttgaattgtcagtgaatgatacatcatcaatcactgcaactccatggttgctcatggtcacactgactgtacccactagcaatggcctcctcccttcccgagccttgacgatcgcggtgctgaattgatcatcagtccacctagcgccgtcttcatcgtatcggaaatcgccatctaggacaagtacttccagttttattgctgaatatcctaggtgagtgtttgatggtgttacaatgaggttggtccttgtgtcaacaagctggatttctattggattgttgtcgatgtcgacgagcttgttgttggtgaagattggtagcttgagctgcttggtgaagacaagcttcaatggaggtgagacccctacatcttggatttgtaatggaagagatctgatagagatggttttattgtcagattatgtgttgaatatgtttaacaagtactatttccatgcgtattgctcaaaacttgtttttgtacatccaaatttgcagaataaaaacgtttgccatttgtttcagtaatcttacaaggtttcattatactaacctctggccttgtgctatatatatgcatcttgttttaattcaaaacctcgcaattaattttcagagatagagagagattgagaaattttatttcaccatacctatgtggtaagtcatgaccatactggggaaatatgttccgaatttcctcacgcacctaagaaggtaaaaaagaaaaatcatccaaaagaaaaagggttaaatgaatgttcatatatgtgcactaaaaactgaaaagcataatgaaattcacacatacaagagaaggaaatggtatacaactacaagaagaacaaatagtcattcatatgtgtggatgcataacaggtaatgtaagttttattgattctagacaaatttattaaaattcgctttctctacaatccacagaaagtgaataacttaatttgaatccaacgtctcacacatgaaaaataatcattaattatttctccattgaaaatgactaataaatcgaggcctaatacatgggaaagggaattgctaaaaaattatcgcgaattcaaatgtgactatagtatacttgtactgtatagcatagttgtagtgtatagatgaattaatattaacttaccaccctacgaatgaccggttccaggttaagaacaatttgttgaattgtttccgctgccactgcccttctcaccaccctgcagaaagagcacacaactatcacacacccagttcgcttcaagtaattattgaatttgttcgaagttccagttgaactaaattaaaataagcatgcataatatgcaaatataatagatacaatactgttcatatctctacatatccagagtgatcaagagatcgagattatgatttatatatctcaatggacaggagaagaagcatggaactgaatcttgccaataaaccgtaatcaaatttgacgaggcttgcaaagtgatcgatcgatcaacatgaaaatttgacgaggaaaaaattgaagagaaatgagttgaactaacgatctgaaggagagcacagggcggagacgcctggcgccatggcgtcgctgctgatgttcctcggccgaaccgctgctcccatcctgatcatcgtcgtcgacctcctcctctacccgtggccttcgcaccgacatcgatcgatcttcagaaccaagaagtaaaatcgatcatctgcttgcagggcgtacgtgcaagaacaatattttcagaaatagttacacgagcagtaatatgtaactaatgactgaaaataagctcgattgctaattaactagacgaatatttatacacacaataattaagatgagataaaaatgaacgcaactgaaagtacctgtctgccgaactgaacaattaatcaaactatatggctagctagctaattaagcttagccataattgcacactaactatataatatggggatcctctagagaaacgggttgttggtagcagtatatataggccatggagatagagggccctggtcatttcctaggaattgttacagaggaagtgaagaagttgctgcaagttttctcctgcagtcgacagaaagactgtggatggatgagagacaggagaatgttccggggaggccgcaggaaggtagctggaagctatgcctcgccgtcgcatatgcatcccaatttctcgcgtactactagtagtagtagcctgcatgtgcggctcgcgagaggaagtagctgcagcttttgcagcagttatatttaccatttacgttatatatactccttggttctactccatttttataacaccaaattagtttcattaaaaactataattgaatatattttcataatatatttattttaagttgaaaaggttgctatttttttctacaagattagtcaaacttggaacaggttaattttgaaaaaaaatcaaaacgacttttaacttgaactggagagagcagaatataagcttttttacttatgaatctgaatatgtctatattctttgtaaaaattactactccctccatctctaaatgtttcacgccgttgactttttttaaacatgtttgactgttcgtcttattcaaaaagtttaagtaattattaattcttttttctatcatttgattcattattaaatatatttttatgtatacatatggttttacatatttcacaaaagtttttgaataagacgaatggtcaaacatatttaacaaagttaacggtgttaaacatttagggaatgagggagtatatattttgggatagaggtagcatatccattccattataagtttttttatttatttagcaaacactaagattaaaaaaatcatttcagtcatctaaatggttaatttttttataaaaaagagtaaatttaagcatacctaggttttatggtcaaaattgcaaaaaagaaatcataggtattattacatgagccacttaaccccaaatattatggtttgaaagttttacaaaatgccaccttaagcattttgagcacaaaattaatatataaaatttttaatggtgaagttctttactaaggttgatagtttaattctttcctattttcaaaattttgtttaaaatatgctgacatttatcaagattttaattaaggtggggttttatacaacattgagacattatgtgtcatacatcatataagcattggttttctacaactttaaccataaaaacacgagattttccgaaattttttagttaaaagaaaatagaattgcttaaattcctccttgccagcacctgattggcgcaaattgtatgtattttgatgcatgcattgtaagaacctgtggcatataaatgtctatatcgtggtatgaattcccaattttatatgtctacaacgacaaaactttactttgggtatgtattttgtagacaacgaaactttcttcggctgagttcttatcccaatttttccaactcacatctctcgttttcagcacgcacgcttttcaagctgctaaatgatgtgtttttttgcaaaaatttctatacgaaagttattttaaaaaaccatattaatcatttttaaaaaataagttagttaatacataattaatcgtgcaataacgtgtgctctgttttgcatgccggggtgccgaacacagcctttgaaactttttattaccaaattaaatactccatatagcaatgacgactgggagcgggatgcatggtataagcactaatcagtcaagaaaggtgctggcagaaacgcgttactagctagtacgtgtgagtccggccaggagcatggatgcagcttcttgggcatgacgaagcaaatacgtatacgtgtagcatggatgcgaccgagcgtgaagactcggtcggtcggtccgccgtgttcatgttacatgcggcgacggtttcatgactagaccacgaccaccacagacgacggcatggtcgtaggttaacttccagggcccttctgtcaaactaaccactctgggacgagatatacgtagtgcaaaacctagccaacatactagtatagtagtagtggtgtagtaggagtactactgtacgcacttccacgaacattctggcctttctcggtcacatttggattttggagatagggcctttttaatccctggcaagttttttcctcctatcatatcgactgtttggacacatgtataaaatattaaatatagacaaacaaaaaaactaattacacagattgcgtgtaaattgcgagactaatcttttaggtctaattgctccatgatttaataatgttgtgctacagttaatatttgctaatgacggattaattaggcttaataaatttatctcacagtttacaggcggaatctgtaatttgttttgttaatagactatgtttaatacttcaaatgtgtgtccgtatatccgctgtggcatggtaaaaatgttcacccctgaatctaaacacagccataatgccaatatcattaacgtgatgtatcaatcttagctaggttgaataatatcatagataaacaaaaataatatatagcttaagttttccttcgagaaaagcaatagcagaagttcgccgagagctgacaaaattctagatcggtatgcgtgttatcctatggaaatgtaaatatactcaaattaagttgaatagaaaagttacattaaagttcgaattttgatttaaaaaaactacttcttcacatactcccggcccttatctccactaatcacaatagtctcttatttaatttctcaatttacttttccacctcaaccaatcacaatcatctctcattaatttcacttttttttatatccataaaaatctccgtgcaagttgaaactattcgtgtacaaatttaattaggtagctaataaataagaaaaagactttctccatttcaaattactcaccatttgttgtaggtttatcataaataaaatatgtgaacattaatttttgaaaattcgtgtagtttaacagcatatcaattatatactaagaaaatatttctagtggtgaatctataaataaaaatataaatcttatgatattaaatctatatagaaattggtatttacatattaaaatatttaacttacgacaaacctagaatggacgataagtaattggaaatgaaaggtaggaaatagtgtttttttttaatttctgcttaaccttctttcaatcgtggtcgcttcgaacggttaattttatcagatatgcaatttcgttgttattaaccagctagttgacaggcgactggacggaccgacgaagaacgccgcatggtcagtatctaccgaccaaagctaagcttccaccacttttctgcattcctcaatctctaacgaaagcaactactggtactagcgtttttttctacatctcaaaagttacactttggcatgacatctccttaatttggagagacttgagtagaccacgccaccatttaaattaaagtgcgttgatcgccggtcaactaaacagtgtatgagtatgacatcagacagcgactgttaattgattagcaaacaaaatacatcaaatcgagcaagcattcaggtatacttactactctaaatctattataagttacatccacctaaaatcccttacaatttaaaataaagggagtacctgacgttcatgttcctagttttcatcagcgaatgatggcatgatcaaatcctagccacggccccacccaccctgatagaaagatttgttcttttaagagcaggtacaatagcaagctataagccagctgcaaacatattttaagaagataaataaggagagagaagagcagcgggatacagatttgtagccaggtgtagcacgggctccaagacgtaatgtgtgtatgacaggtgggaccagatattaatagtgtaatatgtaactattgtatgaatgagctattagattggctatatatgaattggagctattagttggctatactattaaactttctcttagacctgaaacaactagaattacatatgttaatttatttcgagacaggtcaacacatgttaatttgaacttgtggaaccatacagtaataaatctcctacaagattttgcaactgattttgatcgataccgttccgtcccaagctagccagtagcaatatcagttcagctgtttttcatgtgcccgatcctctactttagccctaacttaatgcagcttgactttgtaccggcagtcaaggtcaaggtcaagtatatatgtagatagagctaatttaagtctacaagtagaaaagaagaaccaaattaacaaatctccctctctttctcggttagcagaccaaaagaaactgaacgtacaaaagttccattcttctatctttttttttaaaaaaaaagtaaagtaaaacccatgacaaaagctccatttttattttaaaaaatttatcaaatcccatgctttatggtaaaaaattaaaaaaatcgcatgtattatagcttgtaatacatataattgcatgttttagttttgtggttcaagtgttacatcagtcttgttgaaatctcaattaattttagtgtgtcggaaacaatactaggttttgaagtagtgaagagttaaaataaataacctaataaagaaatcaaaaatatattttacactcaatactctaaaattttaagtaaatataacttcaaaactcctgtcaccagaagttcagaatacctgaactttgctaaataaaaatatgttctataatccaggccaggatgggccgggatggatagaagcatgcccgtatgggctggaaattgcaataggaataagttcactttaggtcccttaatttgtcagctagtctaaatttcgtccctgtttcgcaataccagatatggcacgtcccgcaactctcaaaacagtataaataaggatctaaggcagtttggatggcggtttcggctgacgtgacacttatgtggtgttgatatggcacttcaagcaaaaagaaaccgttggacccacgtatcatccggttaaaaataaaaacaatacagtgggacccacgctatcaacccatatctttcccttttatcactcttcctcctctctcatcctacccaaccgtgcgcccaaacccgcgtgcgctctttggagcgtcggagccgacagtggcacgcccctggggtgcgcctgaccggccatcgccgtcgcgcttttcggcgttgggttcctcctccttgacccgctcctcgacagcatccactcccgtgacgcgctcatatcctggtgacagtgactcgtccatccttcatccacactccttgtccacgcagtacatggaggaaccgagcgagtttgtacactaaccgtcaccggtggtgaacgagtagaggttgcttgtggcaaacgcacccttggcagcccatccaagcgtcatctctgcggacaacatcgcaaagaagggcacggacaccacatatgtgtccctccagtagatgtcggggtcgtagttgagcgcgcgggcacggatgcgaccagtagaggtcaaggaggccttagttgggtgcgcgagcgagtttctcaacgtagaccctgaggccacgatcggcaatttgctgctgtgggaagaggagcagcagggaggtggggcgcaggaggaagaagaagagggagcggaggagcatggtggggacggggaggcacgccatggccgtcttccaaatctcgctctgcttgcttcagatggaaggagccaccatggtctcgctcattctgtttgcttcacctactctctcccgctgctcccctttttcacttccacgaccattctcctggggctttccatcatgaagttggatgtggacaagagcggcgacaacgcgggggcagctggtcttctgttgcttctagtggcgcccgctgtgtccgtcataggtatactgctttggctcgcgcgtgcgcggtcaaacctcgagcccgcctgtcctcaccctcagcttcctctccccacgcccgaccatcttcgtctcgaggcatgtcgtcccccaccgtgcgctcgtccggtgcaacaccgcgtttgccagccggccgcctgccattgtgcctttctgcgtgctcactactagccagtgcaccgtcagctccacaccgtgtcccaacatgtgggttactcactaacacgtgggtcccactttttatctaacttgaagtgccctgtcagcgccacgtaagtgctatgtcagccaaaaccgtcgttcaaactatgttgagaccttatttgtattggttttgga

SEQ ID NO: 60658 - DNA, 743 bp, Oryza sativa
aaaagacgaatgattaaatatattttaaaaaatcaatggcgtatgatctagaacatatttaggaacggaggagtatgatctagaaatctattctggttcatgtacggcgaacagcacaaagggcggaggcgcccaggcttcgttccccaattgggccccttagaacaacatctaagcccgcgggccacccaacttaaaatcccaacatcggagcatcctgggcccaagtcataaaccctagcttctcccttggaatcaatcgaaccgattcgcccccctcctcactcactgtcgtgcttgcctatcgtctccgctcccggtgcgcagccggcgagccgcagccgccgcccccctctccgcgccggcggcctcctccgccctctctgccgccagtccccggccgatcccatcgccagtcggcgggcggtctccccgcgggtggggtgggggcgggacggacgatgaagccggtggtggggatcgtggtgtcgaacaagatgcagaagtcggtggtggtggccgtcgaccgcctcttccaccacaagatgtacaaccgctacgtcaagcgcacctccaagttcatggcgcacgatgagaccgaggactgtaacatcggcgaccgggtcggtaaccgagctcccctctccactccccctctctctgtttcagcttttttctttttttttaatccatgctgatttgtgatgcgagcatttgatttctctggtgtgatgtcgttcatt

SEQ ID NO: 60659 - DNA, 1397 bp, Oryza sativa
gaggagagagagaaggtggggggagattcaaaatcgaatcccgcccctctcgtgcgctggcgcggccgggagacgcggggagagggcggcgacgtggcgtgggcgcggcgacgtggcgtgggcgcggggaaagcggaggaagtgggtgcggcggcagcggtttcggcgggacggcgcgagcgggagaggcgggaggtgggagacgggtccgacaggtgggccccacctgtcggcgaccccgggagggagggaggcgggcggccggctgggcctcggctgcggccggcccagcagggaggagggggaggaaaggaggagatgggccggcggcccatccgaaagaaaggaggaaaaagagaaaaaaaagaaaaagaaaaagaaaaaggattttttttcctggaattaaaattgcactttggtgatttttaattggttaaaattatttctagggctctgaaaattccactaaaaatcctgttagtgagtttcgacatgtagaactcaagaaaaattccacatgccaaatccgattattatttgcattgattaaatagggattcatctctaggttaaattaaacaatttcttcggacgatttattttatgaatttagagcaagggaggggtacttcagggcgtgacacctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccttctaaaaatattggaaaagtagaactgttctcctccctttctcttttaattgaaccaaactaatggcacatgcacttcataatctcttttaatggttctcattcaaaaatttattccagtgttattagtaccgtacatctattactgtactaatggctcattttatcagcaaaagttttacaatattgttttatttaatcttgctgcaataaaataaatttagcatgttgattttataagtttctttcatttcttttgaaaccagttataaaaaaatacaaaatttgtaacctggtttccaactgtttcaacttatctcgcaaagcttggtttac

SEQ ID NO: 60660 - DNA, 1594 bp, Oryza sativa
tagttggttcaagtctctaattttttctaaaattgagatctacatgttaaaaatatccacatgtactgttcatgcttgtttatgtgctgttttggtgtttttgctcttttctgtttagattccgtcgtttccggagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcccttttgttcttgattactttattccttgataccttgggttattataacttgactagttgagctttatatattggttcaactagatattagatataattgcttagccctgcttagaaacattagctcactattgggataacttatgactcactgttatttaatgatggtttaatgatagttcacgatggtcaatcgtgactggttaattaattaatgtgccaactaaaacctggtaatggtgggttgtgagcacatggttttgatggttgtgctcatgacaattaaggaccggttcacgagtttcggttgtgaaacattaaccgtgccaaccacaagccagcatgggcaacggctttatcttttgtgtagcatggttcattgcggggcaccagactgagaagtggcggagataagcccacgggggtcgctggggagtccatgccttgtttataagggggtgattatgatctaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccacaatagaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcttttgcaaatgaaaccctactatgccatcctttgttatcctgttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcacaccgg

SEQ ID NO: 60661 - DNA, 1922 bp, Oryza sativa
ctatccttgaaaccaagaaaagctatttaccatcctatgatgaaaggtattcatccatggttttcccttgcagggagacgtggtgtctttgaaggcgtaattgaagagattcatcaacactggaaacataaagaggttgtgaaagtaattaccaagcagaaccaagccagccagatcacgtacacatctatgatgcttgaggttgagacaggaggcacattaatagcaatagagaggttcactaccagccatgccataatactttaccgaggaaagaattatcgtcggccaacaaaatcagcacccagtaatctcctgacaaaaagagaagcattacaaagatcaattgaggttcagcgacgaggggtatgaattgacatataattctcccttctccccttaatttccaattttctggctgtctgggtatctcatttcctcattcgttttgcagtcaatgaaatacttcgctcaggagaggaaaaagtccattgatgaattgaagagagaactggttagtttacatgctgtttatatcaatacgacgaaatgaaacttcatatgcttaagcaactggaattttatgtacttgatttatcactcttgtgttacagaggaatgtgacatgggaaatcaggaagctaaaccatgatactgaacagtcttggacagcatgatcgctatcaacattgaagattggaataacgattcatcctctcttttttttttcgtttttaacatgataactacaaagaacaaagtacacagaggccactagatctggtaggtatggtagatatggccacaatgaattatcttgcaagtgtgaagatgtttttttttttgtttatgtacatgtgatacactaaagcacatgagagcagaatcattcaatttggctctgatactacgacgaaatacgaactgattactgggtgttgattaaagctcggggagtttgctgaatatgcttagcgctttcatgttctaaaagaaaacaagtcgtatgacctattgaagagaaactaagaagattcagaaggatgctgtactatctagttctacatcactgttacaaagttactataccttttaagggcgaggttacgagggtacaaaaacatgtgctgaaattctttccccaagcaaactacagaaaagatcctgcctagcaaaagcggtactagtcacctggcccctgaggaaattttacaggatttttggaagatttgaactaagtcctgttatccggtgaaaattctgcaaaattattgtgttcgaagatcccaataaactatgcattggtcgcccaaacgagagcactcaagcagaaggacacagagaagcacaagtgctgaagaatctcactggacggcagatggcaagctttgcattcatcagcttcattgttcttgccgtcccgtccttcatggtttgcgaggctctcccctgaactgctgctgctgctgctgctgccgatgatgatctctcttgggcctctgcggcgcgttcttgggattggtgaaccaggtggtgtagaggaactgcttgtgcggcccgtcgtggtcgcagatgaggcggagcttctgcttctcccgcatccaccgcatcatgatcttcatctgcctcttgctcgtcaggcccctcagcccaacgtcctggacacgaaaatgccaaagattttctcgctcgtcagggatgcatgcgatcagggtggcaatcagaggaacacaagatcgttcagggatgacagtttccatctgtcaagcactgctggttcattttgacactgtgagacattacgtcgaacaggtggcgcgcgccaccgggggggccagggcgaacggtttaaaaggtaacgggtgggcccggcggacagggagaaggagcagcagcaaggatgcggcggcggcgatcgagac

SEQ ID NO: 60662 - DNA, 550 bp, Oryza sativa
cttctgttgcttctagtggcgcccgctgtgtccgtcataggtatactgctttggctcgcgcgtgcgcggtcaaacatcgagcccgcctgtcctcaccctcagcttcctctccccacgcccgaccatcttcgtctcgaggcatgtcgtcccccaccgtgcgctcgtccggtgcaacaccgcgtttgccagccggccgcctgccattgtgcctttctgcgtgctcactactagccagtgcaccgtcagctccacaccgtgtcccaacatgtgggttactcactaacacgtgggtcccactttttatctaacttgaagtgccctgtcagcgccacgtaagtgctatgtcagccaaaaccgtcgttcaaactatgttgagaccttatttgtattggttttggaagctgaggagacatgttttatctagtattgcgaagttcagactcggcgacaacttgaggtacctgaaatgaacttattccattgcaatatacgggctgaacacggacagatgggcccagaaaaaaaaatatcccacactccaaacggacat

SEQ ID NO: 60663 - DNA, 2623 bp, Oryza sativa
aaggaattctttctgccgtaacactcatggttcaggcacggtgaacgctgatcctgaagaatctactatgttgtgcgcatactgcagaatggaaaatttctgccttgcttcccccgaatgaatcattatcctgttggtccagttctaaccatatggactgcagagtacagaatgcattgtttcacataaagagaaagaccaaacctattcaattttgtgtttgatacttgatagatcctttgcagatagtttcgataggcttgtgctttgccatttgttgtttgcagcattaaaaccatcaatcaaaattagctacactgtccgctaactttacattggtgtctacatcggattgttagtgttaggttttgtggcattaattgacagcctgaatgggctagaaggacatatttgcctgagttgtgaataacaccagcaatttactggctgataatttgcagttacagtaacaagcacaacgtatttcattttcctattaaaaacaggatattctactctaaatgattctttttcttgaaccacgtttttctgattagtactatataatttggctcaaactattttttgctaatcaataatttaccctgtgattcgaaacacagggacagaccttctcaagttgctctggacagggacaaggacaaggtggcagcatcatccagttcattggtatgccctgacatgtcaatttgcaattgatgccttctcacctgttcttgattttctctaacatactttcttgacgtgaactctgcttttgcaggtttcaggtacaccaccgttgagagtggatctcaacaaagttagagaggcaaagagatatgctgtctttcaagcacagcatgaggggtgccttggaagctataaaagttttgattcctcgtttggtaattatcttgtccccgtcatcccaagcaatgacttctttgtgcaaattacaaataaatgattggcaataaacaaagtgcaattctacgccgtgaatcatgaggatgtagtttctgttctgtcatgttatatgtggaaattgtggtactaatatttcaaactaattctaaccaaccagataacagttgaaagttcagaaaaccaaactgcatgctttcttttacttgttgtaaataccaaaaccttctaatttcttagtaaaaggaactatctagattggtgaaaactgaaaagggtttgtattgtggaagcatttcttagtgtatatctggacctttccctatctttcttttatttttgggtgggaattttatcagcttcatatccttccaatcccatgcctccaatggaatgtatatctggacggcaatcattttattcttgtactcttccatggcctaaacaccttctcaattattgatggggctctttctgacattagttctctcctctggccctctaggctcccagcaaatcaaatatctgtagtactgaagaattttggcaaccaagtatatccatgcgtgcaatgcccccggtgataccgtactgattatttgtcggtcaactaacttgttgaagcgctagcagttaaggtgtccaagctgtactaacatgcttacttctcatatactatctagcagttaaggcttagctttcactgcactcgttttccacaaataatctccatcgttacattataaaactcaagcttatctgattaaaagatatgatcagcaaaccagttgagcctatgactaatggctttagggcctatatcacgttttgcgtgagagtgattgtgcgaaagctgtttctgacattgactaatcaaatcgtggaaggtacccatagatatgcgcctttcaactcttcgtccttgttagcttatcgacagtaaccaaaattttaatcttcacacttaattttagagttatttaatcgtaacacatttcgatatttttaagtattaacttttaaaccactaagaacatagatatagtgttttacctgtaatttatctaaaactgtttttcgttgctttgttcactgctttttgttgcctttgttgttaaatataataatttttaactataaatttagatatatatttgtttagattcgtaattaaaagttgttatattataggatggggatagatgttttattagcagtagctaaaacgatcgtgagttttgggtgtgcggcgacccatccgagcgtcggccacgacgatacgtagtgggccggatggatggatcgctcgctcgctacagtcgtgaattatcgacgcccacgcccaagcgcgagggaagatatgtgctcagagtcgctgagcacgcatctccaggcagccggccgttgcttcatcgacacgtatacttctgagctcatggtcacgtcatcggtactgcaggtgggccccaacgtgcacgtgacccccgtatcataatcacgtcctgccacccttttaactaatcactcccagccttttgctgatcggtgggcctagttgcccgagttctgacaaagtaatcagttggacatttggaactgattactcctactactctagtgaaaattagggaatttgacgggaacacccttcttggctctcctaaatgcacggccggcaggtgccatctgctggtcc

SEQ ID NO: 60664 - DNA, 704 bp, Oryza sativa
ttactccatggcattcagcatattgctcgttaattacacagctaattaccttgcttcgttcaatctaatggagcccaacacgcatgatcaaccagcgcaaagcaaggttttatatgccaaatctacttgtgtttgtgattaatggtcaaggttttatgtgcatgcttcacccgctgttaggtttgcctaggctcaagaaaatttttagatccgttactgattagatgaatcaaacaagtgtgctgcttgtttgcagaatatgcggtctaccatagcttgtatgatgactttgtgtggatggagaagttcggagatcccttgttccgcaggcacgtcgcaggtacccctgtatggctatatcttactttatgtatatttgtcatggcagctgtgtctgttcttgggggaagcatgatggcatgacattttcatgtacatgttttttcaactttgtatgaagaaacatgaatattgaaacattctctgctttgctgggaattgaacctcatagttttctatgcaattatattcatatcttacctttttggccaaactatatgtagaacttggatatagtacggatgtattgttgtagtgcacatgtactgagaacttgcaatgttccactgcatttatataattgcctaataaattaagtatgcaagtaacttttggtataaaaatttatgtgtgctccatcattt

SEQ ID NO: 60665 - DNA, 11210 bp, Oryza sativa
ggtttggctgtggagtggagtcgcccgctgctgaagtcaagcttcccggtttagctcgcttttatcttttccgctgcatttgtaatcttttctatttttgtaaggcgtggatctgtatgtcaacaattgtcgtttgtgtaccctggctggtcctggacagggatttaatgcacattcagcttagaaattctggctcgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcgggaaaaatcttggtcgttctttcggatcggattttttttttaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagttggcggtcgatattatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcagatggagataaggaatggttcacgcgactcgaacaacgccagtggtagcgaagagccgatcaatggagcacgtgccaacggtgcatctgacaacagtccgtccccaccgcccgagaacccaacaattgctcaggtgttggacaatcagactcagatgatgacaatgatgatgcaacagatgcagcaacagtaccatcaggtgttgcagcaggtgcagcagcaagcacagctgcagcagcagaacctgcagtttggtcctccacctcctcagtccaaactgttagaatttcttcgtgtcaagccgcccaccttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcgtgagttcaacctcctcgcgcgctacgcccctgaggacgtgcgtaccgatgccgagaggcaggagaagtttctgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacgatgggacatcacggtggaccttccaccatgattatccggcagcaccgtccctaccacccgggtagattcaacaagaaccaccatagtgacagtcacaacaatagtgagcagcacagcctcaaccctactccgagttcactaaagattccagcccaatcagttcagccagctctgccagaacaacccaagaggttgggagaaaaacccgaactctgcttcaattgtaacaaacccggacacacggttggaaagtgcccgaagccaagacgtgccggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagtgcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaagctggaggatattcccatggtcagagagtatccagaggtttttccggatgatctgacaacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggaaaagaaagacaaaaccaagaggatgtgcgtggactaccgcgcactcaatgaggtcactattaagaacaagtaccctttgccaaggattgatgatctgttcgatcagctgaaaggagctactgtgttctctaagatagaccttcggtcaggctatcaccagttgaggatccgcgaagaggatattccaaagacagcattcatcactcggtacgggttgttcgaatgcacagttatgtctttcggactcactaacgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagtcgttcatgctttaaagatctggcggcactatctcatcggtaaccgttgtgaggtatatacagatcacaaaagtctaaagtacatcttcacccaacctgatctgaatctccgacaacgacgatggttggagctaatcaaagattatgatatgggaatacactatcatcccggcaaggctaatgtggtagcagatgccttgagcaggaagagttactgcaacgtcgcatgggtagaggaactatgctgtgaggttcaacatgatttggaacgtttgaaccttggtatagttgagcacggattcgtggctgccctagaggcacagcccacactggtggagcaggttcgcatagctcaagcaagtgatcctgaaatagcagagctcaaaaagaacatgagggtcggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagaccttaaagaaaagttctggtgggtcagcatgagaagggaaatagctgagttcgtagcactctgtgacgtctgtcaacgagtaaaggcagaacaccaaaggccagcaggtttgctacagccacttcagattccagaatggaagtgggaagaaatcggaatggatttcatcaccggtttgcccagaacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattgggaacccggttgaatttcagcaccgcttaccatccacaaacagatggccagaccgagcgagtcaatcaaatactagaggatatgttgagagcctgtgcgcttgactttggtggagcatgggacaaaagcttgccgtatgctgagttttcttacaacaacagttaccaagctagtctacagatggcaccgtttgaagcactgtatggacggaggtgtcatactccgctcttctgggatcagacaggggaacgccagttgtttggtatagaagttttaaatgaggcagaagagaaagtcagagctgttagggaaagattgagaatcgcgcaatctcggcagaaaagctatgcagacaaccgccgaagggagctcgttttccaagtaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctcccagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacctcttcgccagcccttccgaatctcggggtcgagattccgtttaaggggggtaggtttgtcacgccctgaagttttcccccctttgcttgctttaaaaattggctaaataaatcgtccgaagaaattatcttaattaacctagagctaattccctaattaataaatgcacttaataatcggaaatagcgtggtggaatttttcttgagttccccatgctccaatgcattaacaagatttttagtggaattttcagagccttggaaataattttaaccaattaaaaatgagcaagcgcaatattttaatcccaggaaaatcctttttctctttttcttttcttttccctcctttttctttgttgggccgtcggcccatccctctcccgcggcccctcctccttgtgggccggcccaagccgcccctccctcctctctcgggacgccgacaggtgggccccacctgtcggtcgtctcccacctccggccgctggagccgaagctccaaccgctgccgccgaaaccgccgcgccgccgtcttcttcgttcctcccgcgtccacgtcgcgcctccactccgcgcccgcacctcgcgcccacgtcgccgccctctccccgcatctcccgcgcgcgcgcgcccgcaagtggtgggggatttgaaatccccaacgccctctctctctctcctccacctctccacgttgccggccaaataggggccatccccggccgtttccgcccctccctcgcccataaaaaccctcccctgagtcccctccctcgtttcccccatttgccgtcctctcccacgccccctaccgcgcccacgccgtcacacccgagctccgccgcttgccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgtgagccggtgagtttttccctcccctccatctccggccggcaattcaagccgccgtggtcgtcgtctcctctcctaacgcctctccatcttctcctagggtgtcgccgccgcccgtccgtgcctccgcatcaccggtcgccgccgccgctttcttccttcgcgccggccgccgtgctcgaaggtgaggaatcccctctcctccttcctttcctctctctcccatgagcgccgccgccctccgcgcgtgcgccatcgtcttcggccgccgccgccgccttcgcgccggtcgccgccgtctcccgcgccgccggtcaccgccggtgaccacgcgtgccgccgccgccgccccatggctggccggccggcttgagccgtgccgagctgccagccacccactccctcccccttgagccactgcccagtgggcccgcttgccagcggccccctctccctctcttagtgccgctgaccagtggggcccgcctgtcggcgcccgccccccttccgctgacgtcagccctgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatagttttgtttcctgcttcagtagtcttatagcctgttttgcttgtgtgctttgtttgtcgcgtagatttcggccgtttcgtcgatccgcagttcctcgaagacgttgctgaggtctcatcagttcgagagcaaggcaagtcatgcaatacgtttgatcatattgtacccaatttacaaatatcccgcatttctattaaatgttgcattcttttacaatatcatgtgggatgggtccgactactcagccatttattgtttaccatatgccattgataacctgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacattgaatggtgggttgtgagtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatgcttcggggcatggcgacatgtgtggaatcgtgtcttgtgggtacagttgtacacctctggccagagtaaaactattcgaatagccgtgcccgcggttatgggcgatccaccagattcaccgtgattagtctcacccctagtttagcttaatgaactggtgtagttcaggtggttggttgggcctgttgcaacatggtgtagcgttggacagtgattggttaatattgattaattactacaactgttttactgctttcaactactgcttttaaatgctagctttatgcaaaagaacctctagcctcctgtggttatatcctgcatcatacctcctcttccggtatgacttgctgagtacagtgggtagtactcagtcttgctctcttttcccccacaccagagttgaagttcttctcagttggagccgtctcagagaggttggtttcgttgctgccgtcaaggtttgcctgtggagtggagtcgcccgctgctgaagtcaagcttcccggtttagctcgcttttatcttttccgctgcatttgtaatcttttctatttttgtaaggcgtggatctgtatgtcaacaattgtcgtttgtgtaccctggctggtcctggacagggatttaatgcacattcagcttagaaattctggctcgagaatttctgggcgtgacacgtcgcgcccgctccgccccggccgccacgcacgctgcccaccgccggcctccctcaccgaagaagagcagagagaagtgagaagaaaagaagaggagaagaaaagaggagaggacggctgacatgtgggccccacatattttttaaatttttctttgctgactaggatgccacatcagcgaaaccacccatatatgtgttaacaaccaaatttggtaatatcggcatcgggaaagaagattagatcgaagcaaagtcggaggcggagatcgggttcggaaacagagcaggaatcggctagagtccagatcagctacgattaggatcggctgggtctgagtcggactaggtaagctgatgcagccgattccggcaatgcgacttgatgtatgatatcgggttgagttgaggcacttcaaggtgattgccgcacatggatagagtcctgagaaggcaattgtatctattaattaggatgttttatgtaatttctttagagatacgcttgggcaaaagtctaccgtaaagacttatggtatcttagagtttgttagagatattagtcgtgtccgttatggacatatattgtaattctcgggtataaatagacccgagccctatgtaacttttaacacacacgttcaatacaatttcggcacatcgccactctttttgctttagttttgtttcgacgagttcttactttcgggttgagctgcatcggtttcaatcttcaacaagaggtaaaacttattatgacggcttgtattctcgggattagggcttccatctttatgacactctaatcttgtttatgtaattcgttgagttatcacatatcttacataatctctggcaatattgttatctaacctacaatcggctaacatttgttagtagagggcagccgattaggttagatttcgacgttagtttagattatataagatatctaccactctatgaaacttctagtggcttgattgtctagatattgttcttcttttcatacttaatgctgcataagtttagtttgatctattaagtcgtgcttagaatattaatctctagcctgccttttggttgccgattaaggtagcatcggagtttcagccgatcttatctgatttaactatatttgctccatatgcttcattgacatgttaaatccgccctttatgtcaagatattgctgtatctaagtatattaagcctttgtttgatacattattcctgttttaatatcctgatatagagtagcatcggagtattagccgatacatgccagatctatctgattggctatgctataaacatatataatcatgttattaatatatatttcgatctaagtgatttatactgtctcggcatggcgaccgatctatcccaatcacttgatttaagtatatatcgatttaaggagtatatgttgttaatatctacagccgatcgagtagatttagttccttcttatttattcatgaatgacgatcgattcacatatgacatcggcccaaagataaatgatatgtcatcggcacctagccgatcgattatcatttatagatttaaccacggtttctttactcctatttcttgttgattacatgatcaaatcgactggcacgctcatacattcgaatgcgagctttggacctgcaccggagttaagcagatctcccaggcctcgtgttttctgtcaacaatatgctgccatgggacctcttttgaacggtttgagtgagtttaggggtacacattaatttctggttttgtggttaaaggacctcagaaaatctcgctgtcaagttgagagacctccggtgaacttattcctaacccaaacgatatagccaattatccaagatcaagggcccaattactcgtaactggacttaatggcccaggccgggctgcaaatgcaaagcctaatagtggtgaaacaaggagaggagagcgttttgggttcaggcccgcgaagcagcaggtatctgccgtgagcatatggcagcggagggatcagagcttggctccccaccggcggcggcggcgccgcctcccaagcgtcggaagatcgagccgtcgcggaggtaccgattctatcttgttcacggcttcttgcgagccttttataattaggtttgatctggtgattcctgcttcgaaccatccccatccaattaggtggatatattacattattacgcctgatttctagcgattgcgctgcgccatctttctagtttcgagcagattggaaagggaggtgtggatgttggttagcggggtggggcgatccagtggtgggggatgactacaagtgtagggttcttttaggcaagattccggactaggtgatcttgtgagcatctctatacgttaggttttggtgttcttataaaggggctttggaatgtggcgttgtgcgtttatctatatttcggcaaaagcctcgatattcccacggaaccttgttgattgaggcgaatctctcgaggccttttgcatttctgccctagacagataat

SEQ ID NO: 60666 - DNA, 2170 bp, Oryza sativa
ggaatttgacaacccagagaggcctgaatgcaacaatcttctctcgatctaccagattattacagggaaaactaaagaggtggccaatctttacatgcatgctttgcaaacctaaccaaccagagcgtgaagcagggtcacctgcacatgatggtttctttcgtgtccagtccagcgtcatgttttcttgttgacgatgacaagataattttcctagttcactatccaagaagttgatcgtttcaataattttattttgacaggaagttatcagagaatgcgaaaatatgaactgggggtcgttcaaaacaactcttacagatgcattgattgatcatctgcaacctatccaggtattccaatcccaggaaacgttctgatagcacagctcattgcttaccataattattgtacttgataccgtggtctgctaatcatttttttctgggtcgagtaatcaatttcgtttctacatctccctcttttcacccgtctaggtccgctacgaggagataatgtctgatcctggttatttggatggtgttctcttagaaggatcaggaaaagctgctgagatagcagacatcaccctcaacaacgtataccaagccatgggtttcttgcgcagatagcatgcgcttcaaccatccggaacatttcaaagattttttacgaggtcaaaaagttttgttcggtctgtgttactttgttccccttaccattggccttaagattgtttttatgcacatattggccttactagatttacaagagctccattctccaaattttataggaatatcaatcgttttgcttgatgttacgtagtagcctctttgtttctggctctacaaaaacctgtatggtccattaaatttctcatcttaatgacactgatttctttgaagttttgagttcaatgttggctccatgactgaatggtatttggacgtaaaaagtaacatgtttacgtggactgttttgacattttgcacccattgaagtgtagctaacaaaaggtgaaagcacataacacaaactaaaatgtcgaaattttgttttatctttgtttactgttcctatttgatacagtttactttccactctgtagctatcaaaggtacatgtaccctttattccctcgagtcctattttgatacagtttactttccaaagctttgctcttcacccttcgctctttggatttaaaacccacaaattcctctatttttcttccttttttttgttccaaataagtgacatgaacatttcatttatcgcagtcaacgattaccagtcccccgagtagaaagcatagttccatttccaccgcttccccaacagttgtttatgttaaccctccacttaggactagcgaggcctggttgatgaccctagcaatcctgtaaatctcatgctgcacagatcgccaggattcggacgtattcgtcctctctgccatctgaatggcatcatcaacacctggatacacctgcgctccgtaatcatcatgcagtgatggtgcataaatctgcgttgttttgttccccataagtaaagcactcagcagttttttaaaaaaaaataaagaaaaggaaaaaactacagcagttcatcaaccaacaatattggcacaaaaaacttaccaggtgtttgtaccatggcctcccagatagtccttctcgatcggtgaatgctcgctccgtcatcatcaaccgctcattgagatctctgaccttcaggggattgtttctccaggggttccaaactttccttgtctgtaaggcctaataggaaagggaaacaggaagcttaaagttttttccttttgagcggagagcttaaagttgaaactatggatcaggcaacagcatgcaacaaacataagaaaagacaccttcatttcagaatccatttgtagagctgcccttttgaactcggcgattgacttttgcaggggagatgagctgacaggcactcccagcaatctcttatttatatcgattgcacccttctgcgaattgagagcaaccattatgacactagatttggacttctcataatgcatagaagttgcatggttttgaaaaagaaaatcattaaatttgtttgagaacagaacgataagttacctcaagctctacagcataagtgctgtagttgaagggta

SEQ ID NO: 60667 - DNA, 8157 bp, Oryza sativa
  unsure (1)..(8157): unsure at all n locations
tcaaaaattagcgcgaagcttctattgataacatgtaaagaaaatactccctccgtcctattttaagtgcaactataagttttcgcattcaacttttatcatccgtcttatttgaaaatttttacaattagtatttttgttgttatgagatgatgaaatatgaatagtactttacttgggacttatgtttttaatttttttcaaaagattttcaaataagacagtcggttaaagttgggcgtggaaaatcgtggctgcacttaaaatgggacggagggagtaataataactagtatggtgacccgcacagattacgtgggtagcattcttttttctcgtataatggcgccggcatatatatttccatattttattattaaaatatattaaaatagcaacataacttttaaattatgcactaactggaccaaactaactaatgtgtactctcttcgtcccaaaaagaaacaacctagtagaggatgtaacccctcttgtccacatacattgtcctaggaggggtcacattccctcctaggttaattctttttggacggaaggagtaatatttatattgtactatatatgtgtgatagttattaattattttttaactccaatcttcttttaaacatctaaaaaagtattaatagtggcggagttgacggtgccatcaagcccgggtgactaataatgtctttcggtgatcgattataggtgccaattgctaacgagagtgaagatggcggagcctgggcggtcgcccaacctggccatgaagtggctccgccaccgagtattaagcttcttcccaaatgaaaaataagtgtgcaagtattacactttgaattggaggaaaaacataggaattttagaggattttaatcctataggaaaatttcctatgaagccctttgaaataaaggattgaatcctatcaaatccttaaaattcctatggaatggacaatcctatagagattttggaggaaatttagcaagagcttcaacctcttggtaaatttcctttgagtctatctctctcatccaattcctgtgtttttcttgcggttcaatcaaacggccattcctgtgttttttctgcgttttgcaatcctctattttacacttacatttctatcaaaatcctacgtttttcctattcctacgttttctcaatcctgccaatcaaaggggtgaaagaactaagggcccctttgaatcacaggaatgaaaaaacagaagaataggaaaaacataggattctgacagaaatgtaagtgtaaaacagaggattgtaaaacacaggaaaaatataggaaggaccgtttgattggaccacaggaaaaacacaggaatttgagagataaagactcaaacgatttattccatgaggttctacctcttgttaaaattcctccaaaacttgtatgggaagaggcattacataggaatttcataggattccatagggttcattcctttgattcaaagggctttgtaggaaaaattcctatagggatgaaatcctctaagggcccctttgaatcgcaggaatgagaaaacataggaataggaaaaacataggattttgataggaatgtaagtgtaaaacagagaattgcaaaacataggaaaaacagaggaatggtcgtttgattggaccgcagaaaaaacataggaattagaggagagataaagactcaaagaaagtttccaagacattttacctcttgttagaattcctctaaaccttgtatggtattaggcaatccataggattttcataggattccataagatccattcattcgattcaaagggctatataggaaaaattcctataggaatgaaatcctctaggcccctttgatttggaggaaaatcataggaattttgaaggatttaaatcctataggaaaatttcctatgaagccctttgaaacaaaggattgaatccaatccaatcctttgaaattcctatggaatggacaatcctatagagattttggaggaaatttagcaagagcttcaacctcttggaacttttctttgagtctatctctctcatccaattcctgcatttttcctgcggttcaatcaaacgttcattcctatgtttttcctgcgttttgcaatcctttgtattcctatcaaaatcctgtgtttttcctattcctacgttttctcaatactgcgattcaaagggggcctaaaatttctatgaatttcctttgaatcaaatggggcctaaaattcctataaatttcctttgaatcaaatggggcctaaaagagggaggagaaattaaatcctgaacgttccttcccagatggatggttggatcagtggctactgccaatccgttgggtacacggctactacacatcagtcttccgtaatcagtcggggtatctaatcaagaggatagagttgcgtggctactccacaagcctacaacgacagtggaaatgtagtagtgctacctcgtttgatccaccagcaccaatgtgggcattctcgatcggttccatgtgggctgttgcctccggacttccatcgatagattgggtaggataacgacctcacctcactatcgtttgtactgtcatttgatccatttattccgataaaatttagtttccgatcaaggtttcccgagattggtctactgttgtcaggacatatcgacgcattgtgccactggccaaccagggggagcctttgattgcacgaaatcttatgagtaactcagcccactgtctcccgaaaatattacaggctgttccaactttcaaccctgatggcgcaaaaatatcagtaaactgcacgtaaaatattcaggtacaaaattgcaaacgtagttgaagattaccaagtgcctgcgtcttttttactactgctgtcagtactgtcagtaacggattaacatccttcaactacaaattagagtgtgtttagttggggaaaaagaatttttgggtgtcacatcgaacgtttgaccggatgtcggaagggattttcggacacgaatgaaaaaactaatttcagaactcgtctggaaaccgtgagacgaatcttttgagactaattaagccgtcattagtacatgtgggttactgtagcacttatggctaatcacggactaattaggcttaaaagatttgtctcgcgatttcccccgtaactgtgcaattagtttttctttttatctatatttaatgtttcatgtatgtgtccaaagattcgacgtgatgtttttggaaaaaaaatttggggaactaaacatgcccttaatggtttgtgttgacttgcctccttgcctgttgtcataccagtatgaagtactactccatatgctagttctaactgccgtatgttacgaatagcatggaatcagtataactgctatactactttcatgttgaaaagtttgtgtagtaagtacaactgtgcaagtacgctgacgactattcggtgttaaatatgccaatccagactccactgtactcctccaatcggcgttcattccaaatggagcagacggtacttaataatgtataatgtttgctaaaattagaacaaacatttctctgggccggtcagagacataaggctttttttaacggttgatgatattaaagaagttataaaaattacaaccctgatgttgcaataaatagaaatacaagatttgccattaaataaaaaaattccacatctgggaatactaaataaatgcgagcaaacgatctaccaagctgacgaactcttgtacgcgaaaaataaaggaaggagtgtcagccaccatttaatcatattggcatgttcctttagcaaataagcaaaccgatgcaaccaaataagtcaggcgacccgaactctaaagacaacgctccgatcactattggggagggtctctttcccgctcagtaaccccttatagttttaggttacaaaccaggacacctatctttagtttcagttaaaataatcaggagtaaaaaaaaatctttaatccagatcagtaacattaaagatggtagcgccatctttactccagttaggctttttttctttttttatccttgttttttttgttgcttgcatttattgtcaccctcaaatcccaacaaatcatccacaatttacaagtccatccacaaaatcatccataatccacaagtcattcacaaaatcatctccaagtctgaaataaactacaacaaaatttacaaattgtttcaaaaatgaaaaaaaaatcacaaaacacaggcggcccgccgtgtgccgnctnccgccacccggcctcccatcccgtcagatctggcggaggggaggccacccggccatgcgccgcctcccatcccaccgccactgccactttagcggtccagccgccgcccggccaccgctagaggagaggccgccgcacgcctgccgcctcgtgcgccgccgcggtggcttccgccgggctgccgcccactgtcgctgttgtcggaggagggagtagggcgaggagagaggggaaggggaggaaggggaggaggtgaaggagagaaaatgataggggaggagatggagaggatgagagggaaggagaggatgagaggggaggaggaggggataaggacgaggcacagctagcgcgcgcagctcggggcagggattttcacaattttttttattttagtcccgagcggtataaataactggactaaagatggatctttagttccagttggtaacaccaaccaggattaaagataaaaaaaaatatccgtcggttttcaaaccatgactaaaaatatttttaatcccggttcttacttaaaccgggactaatgtgatttttgcatgattcagtaaagatcatttttccagtagtggattgatttgtcgaggatcttgccaaagaaataaccacaaagatatatgaagaggaaaaactctaaaaaaccttaattaactccaaataaatcacagacacaaggctgtttaatttgccgtgctcttgtctttgaaagttttctctgagcttggacttcgtcattttttttcagacatcttatacaaaagcaattcattcttgcgttgtaaagaagatatccctttatatttagttttttactgatagattacctagtactacctccgtcccaagataagtgcagccatgaatttacgcgtccaactttaatcgtccgttttatttgaaatttttttataattaatttttttattgttataagatgataaaacataaataatactttactcgtgacttatgtttttattttttttcaactttttttaaataagacgaatgattaaagttgggcgcggaaaaccatggctgtacttattttgagagtagtacccagcgcttaggcctgttagtctccaaatttttttctcaagaacatcacatcgaatctttggacacatgtatagagcattaaatatatatttaaaaaactaattatacagttagaggggaatagcgggaggaatcttttgagactaattagtccatgattagccataagtgctacagtaacccacatgaattaatgacggataaactaggctcaaaagattcgtctcgtggtttccaggcaagtgatgaaattagttttttcattcgtgtccaaaaatccctttcaacatccgaccaaatattgtgacatccaaatattttctttccgcgaactaaatatgcccttacatatataggacaaatgccatgcccttttcgcaaaattacaacgaaatgataatgaaacgtagatatggtcatggtcaccgcctatgatatggtcatatcgcacggtagcactgacacgcatggccgaatctgcagctcgcacacttctttcaattattcttatctacgttcttaatatccgtgctagttaaaatatacctactccctccgcctaaaatatagctatttctagcagtgtcttgtcccaaaataaagctatttcttcacctacctcctctcaaccaatcacaaccattcttcttcacctactttcctttttcaaccaatcacacacttcctccaatcattctcacctactttcttaatacccgtgccaatctcaaaaatggatttattttgggacggaggaagtacattttaagatggatgaagtactgtatactcctaatactccctccgtccaaaaaaagacaaaacctggtttccgtgcccaacgtttggccgtccgtcttatttgaaaaaattataaaaaaaaattaaaaagacaagtcacacataaaatattaatcatgttttatcatataacaacaataaaaatatgaattataaaaaacttcatataagacggacaatcaaagttagacacagaaaagtagggtttgcttttttagacggagggagtactatgtagtaactggccagtgaccactggtacatagtacgtacccagctacagttcatcggacgctggcaagcacgagcgacaagacggccgctgtagaatctacagtacacacttgacaggccagtcgtagtcggtcgcagcaccgccgtgcggttgtgtccgagtccgaacggagaaaccacatgtgcacttgggactggagcacgtctgcacttgcctgctggcatcgtggagcgccgagcgcaacggaaccatcaaccatcacagccgaatgccctgtagctccttcaaaaaaatttcgtctcttggaagctactgtaactctgaaaggcttatagttcagactcccaggccgtctttagttccatgcctattttttttacatatacggatacacatttaaagtattaaaagtagtctaataataaaataaattacataatctacctataaactgcgaggcgaatttagcctaattaatctatcattagtaaatatttactgtaataccatattgtcaaatcatggtgtaattaggctcataatattcgtctcgtaattcacatgcaaactataaaattggtttttttccacatttaatgttccatgtatgtgtctaaatatttgatgtgacagaatgtttgaaagtttgaataaaactaaacacagcctcagtcactcagaacatatactacagttttggtaaaaaaaatgtatactacaattagtccgtccactgtagaccaaacgtactccgtatcatttatccatcagtgacgagctcacaacagaagttatcaatcgtcctgtatgtacatatatcgtacaattcggatcctctaacacatataatactataattttcaactaataatatagttaatactccctccattttaaaatataagacacaaccatcttaacccaaagaccaaaaaaatagttattactcatctcgtactttggatcatcctaataaatataatgcatgcatccaatagagttagagaatgtgagagtaaatgattttaaaaaatagtaatgtaatggagaatatgtcatatttaatgacatgcatgcatgcatgtcttatattatgaaacatatgaaaaaaagtagttgtgtcttatattatggaatggagaaagtacccgctaaaacaagtaaagattaaagattaagattcagtggggagttccgccttcacatccacacttgcactcgatgtatatgctcgcaagaaacttctttctccatttcatattataagactttttagcattgtatatatatatatatatatatatatatatatatatatatatatatatatatatatataaataaatctagacatatatgtgtgcttagatttattaacatctatagaaatatgggcaatgcaagaatgttttataacctgaaaccatatatatgttaataaatctagacatatatgtgtgcttagatttattaatatctatagaaatatgggcaatgctagaaagttttataacctaaaaccatatatatgttaatgaatctagacatatatgtgtgcttagatttattaacatctatagaaatataagcgatgccagcggtgtgcattccctatctcaccgaggtaagtcgtcgaatgggattcgttgtgcagtttatgtatggagcctatttggagctacatttggtgttatagtgtggactactccctccgtttcaaaatgtttgacaccgttgacctt

SEQ ID NO: 60668 - DNA, 3342 bp, Oryza sativa
ccaccgtctcgtcctggagcacctccacatatgtatctgtcttgttgtgtggcaacggtggcgcgggcgtccagcggccgtcttgtcgtgggcgaacggcggcgcggtaccccggcgtggcgccgcgggcgtccagcggcttcggacacgcttggctgggcaccagccgggagctcggaagtgaggaggacgcggatgatgtggatagaggggaatcgagggagaagagagagtgaaagggcaagagggacattgttccttcccggacccacatgtcagagctgccaaacagttaaatccaaacagaatagcgacggaatggggtggaggacgcgataaagttcgacgatggcacagagaaagactcgaactttttagtggcaccgaggcagacaccatctttcttaatagcatatagaaaaaaaacctctgtgccttgtggggtgcagccttgcaggtaaaataccgttccagcgtgcacggcacaagatggccagacactgggtacataccaggtaaattctcgtacacgcatgtggcccttggcacccttcggcagtcagctagagcgctctccgatgataaacttttaacgcacgtagccagttgagttgaatgctcaactgctcatgttggcgtcggcatgcaccaccacccacggcggcctgcattaacgcatgttgcacgcgctccactccaattcttcgctacacggtgtgagccccccaacatgccacaccactgtagaagtgtagagtggactgtagagatctcccaccgtcgccgctccagcacagagatcctgcacatgcggacagaagcggaagcggcaccagtggcagtggcagtaatgggactgaaaggcgcaatgaaaccgatcggccgttacgcatatggtgatatatactgatacggatggccgacccctaccgagccctcccatccgttccgatccgcgccacaaaagcagtcaaacgcaggtgccgacgtgccttacgtaggccgtaggcgacgcgagccatgggtgttgccgtgttgggtgccatgcccatgccctgccctgcgccgctcgccgacgcgtgtgcttggcgtctgcagggaagcgaagcgacggccggaggacgggctgtttctgagccgggcctctgctacctgccgcgtggcatgcagttgcgcagcgcagtacgggttggcgggcgaggtgggcctgttattggcatgttgagagcaagtataataccaactgaaacaccgacgataggactgccacgttggataggatgacgagctggcactgagaaggaatgagagagaaggtaagttggcgattacagtgtcaccggactgcacacacaattcaagaaaaaatgatccttagtgcagcacgttgagagtagacatggttgagaaagaaagaatataatagtatttatatgaaaaatttatagactacttactgtaagtgttggcttttagatcgacggtaaccaaggaaataaatttgagccaccgatgggcgctactattaaacctgctctgatgaatgcacgcgggcctactactccactactcctgatgtgctctcgtaatcgttcgtacgctggttgagtgggcgcttcttctgcagttctgcgtcaggaagtactcccgtacgtgcaccacacgctagcagctggagtgtgcagttgtgcactgcgcctatacgggatggaaacctggagagggcggggccacatatacttctgcctgcagtatcagttctgctggtgttggttacacagtggcacgtacgttcgcgatcgtacgttagccgtgggtgttggttacaccgtgacaccgtcgctcagtggtgttgcaaatgtacagtgaactagtgatacagtggccatcagtgtgtccgtgcgtgcagtactaatgtgacggccttaattagattcgcggtgtgggcaaaatgaactggaaccgatcgaaagaccgaactaaccaagtgtgtaaaaactggttaggagttcgctcttcagttgtaactagtcgaatttaatatggtcatttgagggtgtgtttgcgaaggaggggattgaggagatttgaaagatacgtaaaacgaggtgagccattagcacatgattaattgagtattaattattttaaacttcaaaaatagattaatatgattttttaaagcaactttcctatagattttttttttaaaaaaacacaccgtttagtagttcgggaagtgtgcgcgcggaaaacaaaaatatctttctctctttctcctgcactcgaacgcagccgagtccctgcctcagtcaaacgaaaaaagaaacaaaattgatggcacaacccaacagcagcaagtacatgcatagcccagcaatattaccagattatgaggcacaactctaagggtgtatttggttcacggttaagattggatgggatatggcggtccatattttgttggatatggcgatccagttttttgtttggtggagtgaatatggcgatccaaatttttatttggttgtagggatgaaggtgaatttggtgatctttttttgttagggggagtaggatggatgagtggatgcaatcacccctacaataaaggtggtgagtatacccctttaaattcatcaaaaacacaaaaatataaatcactacaaacaaaaaaaatctcaagggaaatatcagaaattacaaataaatagaacagaaacagaaggggaaaggaaaaaaaagaaaaaaaagaaaaaaaaaaatcatccgcgctcttcttgccggccaccacctctggattctccccctcgcacgccggccgccgcctccggtctcgcctcctcgctcgcacgccggccgccgcctccggtcgccgccccatctcctcgctcgctcgctcgctcgccggttgacggcgatgacgacggaacccgctagatccggtcgccgtcgcctcttcccgctgccgccgccgtcgcctcttcccgccgcgtgtcgcgctcccttctcgcactggccgccgtgctcgtcgccgttgtcgcgtggtggggggtgacgagaccctgctcgcctcgctcgccctgcactcgagcggctgcccggatccctccatccggcatatcagtggaatattccctgttgggccgcccgatcctatccctatccatcaaccaaacacccacaaaaaatgggcgccatctcctatccacccaaatccctccatccaaacacaccctaagcctacaccctcggttcacttccttagcacaacttaaaaagtggatttgtttgattttttaagaaactataacatatattttttaaaaaagattgtgttta

SEQ ID NO: 60669 - DNA, 980 bp, Oryza sativa
ccatacccaccaccttgaccgccgccgccaccaccaccatgtccacctccaccaccactagcaccacctgcacctgatccatatccagagccataaccctcacctgagccatacccagatcctgcaccaccacctccgccaccttcaccgcttccataaccaccagctccaaaagcaccagagccatatcctgatccagaaccttgtccagaaccatacccggagccagaaccaccaccttcaccaccgccgccgcctccaccaccaccatggccatacccaccagcgccagcaccacctccctcgccataccccgatccagagccgtaccctgatccaccataaccacctcctccgccgctaccacctcctcctccaccaccgccaccttctcctccatgccataacccaagagagttctagcactagtggtcattcctatgctaaggaggacaaggattattagcaacacaaaatgcttggtggtagccatctttacttgcaagctctagctacttcagtgcaagtagtgcagctgtgtgatgagagtgaggagatggccattggtacttatagggcttgctctagtgctttttgcatggcttgatccaccagtagctcactgaatggtccagagctaaagaccacaacaatgcagcacgtagatagcacacaagagtttggacgcgtttggtgtgaaatgaggaccagtagtgtgttgtagtgctagtggttatcgcctttcttgacgttttagagggcggtgtgtgatgttacttgtgttgggtttggtttgctttatgctttctttcttttttttttcttgcttttctggaaccaaataattggtgtatgatcagtgtatctcagtggatgccatacactaccatacacacattcacacccagctagctagtcagctgatgatcattagtcactcgattcagttatagcttcacactggcaacatgattaactgg

SEQ ID NO: 60670 - DNA, 10254 bp, Oryza sativa
  unsure (1)..(10254): unsure at all n locations
agtcaaggctggtaagaactcccagccatacgttgtaaaggaagaaaggctggaaggtgcactgcaagctaattacatagtcgcaagttgtatttcaagatactgtgcctatctgcttgtctcagagccagatttgctacctgatacctacttaagttctgcggaggtatttgaaagcaccgtgaaagaggcttcagatgttctaaagggatctgacaacctgcagagcatatacagaaaactgatgtatcatggggatgttgtgaatgtcgataatatgaacagacgtcacccaagtgtgatactcgcgagaagtgcacaagttgctaagtccttggttgaaactgaagtcatggatcgttgggagatgttggctggggtgtgggccgaaatgttagtacatatagctccctcttggaatgcagcagctcacaagaaatgcctttcaaccggtggcgagttcgtaactcaaatctgggccattctttctcattgcaacatacaagaaagcaatctctggccacagcaggaatctccaaatgataatgaagcagagcagcaggaagaaagtgtaagtggcaatcaggcatctttttcagcacaacagcgggcagctgctggtcatggtggagtaagggatgatgaagctggaccgagtgggacaaagccaaatgatgaaacaaaagacgatgacgaaaagaagatgtcggttaatttgagttcaagaacaccaataaaacgtgacagtgtgagttagtataatattgttgaactcgagctttcttatgtcacatatatgttcctttcttaagaacatgtctgttcattctccatgtgtagtagtttatatggttgttgcttgcatgtactaaggtgtggtctcttgccgtactatgtactttaaacagctgcaaatatcgtgttactttttttcttatgagtgttgatcgatctccagttatttttctgcgagtagtcccagtaaatcgctctttgcaactcgtaccagtatttgcacaaggagattgaaatcagaagagcctacttgagttgcatgagcttttaggctttcatggaggttggagcagagagatgttgatgagctgatgacaaaagagaaacgctaccatgaacttacaagtagtagtagttccatggtagaaactagtactaggtggcaggcacggttcacgcgcacagttcgcatctttgggccgcgataaggctgcgccgcgcgttatcctgcgcgttatcgtgccacaaccttacaccgagttcccttatcctcaataccagaaatctttatccctaaacaatacaaaaccattcaatttaggtcccatagcagtatagatgtctgatttcgctgatgtggtatcctagtcagaaaaaaataaaaaatatatgtgaggcccacatgttagccgcccttttcttttcttcccaagtggcagcggcaggcagcacatggagggccgcaaagacatcgtcgacttcctccttgccatccagcttgtggggcccaccaagctgctcgagtccacgaccttcatctggttggactcacaggctgacaccaacaacggcggcggactttatcggtgcagcggcggcggctagcggccagcgacaatggcagcgggggtgacaccagcggcgagggtgagtaggacagccgagagcggcagcgcggggaggaggaggaagaggcggggggcaccatgtctttggcaagaggtcctcctccatcttcgatgtcccctccctcccccctcattcccaccactgccgccaccatcaccatccgcccaagaggtcctcacctcccttcaccgctgcaacgggtgaaggcggaggctcacctcccttcgtcaagcgtggcagaggcgctcccttcaccgccgccaggaggctcacctcccttcaatgcgatggcgggtggaggcggaggaggaggcatatgaggtgtgcagaggtggaggctgctcttcagatctcgggagtggcggcggcagctgaggagccccccgccggccgcttctcgcctcccctatctcgcgccggccatccctatccccatccccatccctatccaaaaagaaaagaaaaggaagaaaagtgcggctcacaagtaggacctacataattttttattttttattttgcttactagaatgtcatgtcagcgaaaccagatatccatactgttgtagcatccagattgcacggttttagtacagtttaggggttaagatttctggtattggggataagggatgtcaaaccaactcggtgtaaagttgagggacaacaggtgaacttattcttgcgcattttcggctatcacatgtgggccgtgtgtagctttgggctccgtatttagacgggagtttcactcgacgatgctccctggggcgcgagaatgctaaagcgnnnnnnnnnnnnnnnnnnnnnnnnnnnnnnnnatcccacaagctttttcgttttcggcacggaatttttattgttggattttgtgcaatggaaataagttcactttcagctcctcatttttgccactgagtctgaaatttgtccctcactgcatgtaacgcttcgcttttcgtgaggcgttaaaaactaattcggcaaaattctaatttcaaaaattttgttctttgagtgatagtctaagttgtgccaagatctcaattcaaatccatccttgatccctctcgtcaccatcaaaaattgcctcctcgaaattccccttccgactcaagtctccaaatcaaactccgaaattctatccctctctttgaatcatcgccaaatacttccccagatccaaagtatccaaaaccccatcttgaatcctccttcgactccttcctctcatccagatcccaattccaaagtctaagtcaaattccaagttcaaattctcttcgaatcaatctcctctgcaaaagtttattttgcctccctctgtttttgtgggccgaattcctttccctcgccccatccctcctctcagcccgtttcccctccccagcccatctctctcctctgccatctccctcccgtgtgctgcacgagccgtcgccgagagaaggatctctctctctctctctctctctcgttttctcgctccctctctattcctctctcacgccaacgcctcttcctgctatcgctgcccaaaacctccaccgccttcgcccaatcccgcgcgcgctcgcgaggtggccgaccggccgatcgcagccgcgtcagctctgacgccgctcggccccgctgcccccgcgcgcgtgcgtccaaagccgggagggcgcgcctctctcacgcgctctccctcctccctctgctcgcccaaatcggcaaggagcagggctcccttttcccctcccttttctgctttttcccctgaccaccaccgccatgccctgtcgccgcctggtcatttgcgcccgtgtaaacacgcgccttgtcagaactattcaagctatccaacaggacaaggagccagtcaggcccagtcatagcaaacttcctttccggcggtagcgcccagaactctctgatggcttctcgcaacgatctcgccactgtacattcaacagtcgcatggaaaccattttcctcctttacaccacagatagggcagatgcctactggttgtatccttcttttccgtttatacctataaagtttatacaagtaaggtcccaaaagcagtttggacgacggtttcggcagatgtggtgcttacgtggctggtttgaattggtcattgtcctacgtgacggtgttgtggcgttggaagcaaaatataaaaattatatatttttttaaaaaaagtggcgcacatatatcagtcagacaaaagattaaaaaatagtgagacctacgagtcactagatcccaccctcccctccatctccatggatggcagcgcctccttctcccctctctcctctcctcttgtcgccattggtccaaagggaggagaatggtcggaattggcgaagctcggcctgagcgtcctctggatcggcaagatgatgccgcgtactttgccgccatcctctaccctacctacccgtctcctccaaccaatccctctcctcgacccccacctcttctcccatctcccctccttgtcgatgtcgccacggccgtccccaactcgctgccaccaccaccttcatctggtcggcttcccatcaacgttgacgagactagctagctagtcgacggaggctgggatagccctggctggatgacaatccaagatggtgtgtttgttctccacctccggaacggcctccacggtttttgaggggatccacctcgatcccatcctcgatggagggcgaggcggcatcggacaatctcacactgctgccacctagactgctcgagagtgggtgtgcgacggaagtggaggttgaggacgacgtacagggtgcgggaaggctggttggggatggcacggtcggtgtggtcgaggaggatgacggctggtccgctccattggtcattgccattgagtcatctatctctctgctgcccacgctgcttgggagagaggagtcaaggcgacgcttgagctcggtgacgccgaccgtcgcccttcttctctccagtatatgttgtgccctcctcatcgctaccaccatctactgcgctcatctccgcagtgaagtctcctccctcaccgcctccacaaattgccaggggatccctcgtcctgcccctcctccccttgcgatgggggtgggtcaagtcgccgccgccatactctacttgtcggggatgagcgggtgttgcccatgttccacgaggtggagaggcatggttggtatggatttggttggtagccgaggctatgggaggcccccctcgccagtcttccggccgcctctctcccgaccccgctcaccggcctccccgccttgtccctctctgtgcgctctcaccgacggggagagaggagatagaggtagagagggtgaggtggaggaagtgggattcacatgtcagtgggtcgtactatttttaattttcttgtttgattgacatatgggccgcacatattttgttttaattttttttagttttcaattttgctcctttatttctttcggatcaaattgctacatgggacgaatacctagtcaaataagccacgtaggtgccacgccagccaaagatgcagacaatactaccgagggatctcatttgcacaggttttataagttggaggatgtatcgtatccggttttgcggtgtcacaccccaaactggtaccgccgtacaacggcacctgacaggagcgtgtcgtagggaaaacggcgtgaaccgcttcctacgaaaccgcgatctcggtaccagtcccaggacatagtgctggtacccacggtgacaaataggaatcatagcaatccttaaaataaatagaggacttatttaccttaacttaggttgcagctcagaacagcccgagaatgcaaccgacgacacgaacgaggaaacaccaacaacagcagcagcagcagcggaaccaacgaactaacacccaacaccacaggtgacggctgggaaccaggacgaaaccctaatcttcgcttcacttcatcttctcttcaagacggaggaactatatatatatttatatagagcaagggtgagtactttcgtactcagcaagccatgggaattaagtgtttaatgcaggcttcaaaggaaaggctgttgtttttgcaattgattttatttaaactcctttttggaacagctaagtgagtgcttctcaaatgacacggatgagacggtgcgtctcgtccagtcggagtatgtgcaatgtatcagtctttgaattgattcaaggttggcacccggccaacaactttcaaacggccactcgggcctagctgatcccatcagctgcagattttccaaacattgatcccattccacaacatcaatttcacaaagcagtagtcaaacaaaactacgctaggaatcacctcacatccgcccatgaccgtgggcacggctgttcgaacagtttaataacctctgcagagggggtacactttacccacacgacgttactagccttggtcacctagcccgtgtggatcagacacgtttggtgacttggggctttcacgacaaggcatttcgaaagccgacacaggttcaccatatgccaacgagaggggtcctagaccaacaccaggttaggtcccagaccatactgtgccaggaaacccgggggttctccccggcaccaccctgttgaatccacatgtctcttggcatcatggctccccagattagctaattactcagccaggggcgtcccattacacccatgtggtcgcacttgtcttatgttcggatgaaattccaaggaaaaaggtccttaagtgcaagagtgggaaaccgtactcccggtacgttccccggtccgcgattttggaaattcatttagttcgcaagcactgacccaggtgtcgggttttccaagtcttttataaaaccccaagttttacccatcgttggatatttaaattttaggggaggtgttccaatgcgcgtgcccgaaggctcgtgcatcgaagcacaacagtcgacaaaggaggtttgagtgttcaataattcaaggagggtaattgcagctattaggattagggccggcaggttatctcgcaagccgcgcccgatttacttgtgtaaatcctattgatgtaatatttgcgaaaaagaaatacttaaatttaaattataggtgcaagatgatcaaaggtgacttgccttgctcaagatcttcacgaagcttcacgaatctttgagaaaacccgcgatcgacgaaaatccggtaaccacgaccatacgcaaacaatcaaaaacctaaacaaggaccaaaagagaaatcctatttaggctaattaatagtgccattaaatagatctcaactttagagaattactggaagtggaacggagtcaatcggagttacggatcgggagatatgaattttggaagtttaagtggaatttctgggcgaaggaagatatttgtggaacaagggggaaattgatttattaaatcccttggaaaagaaaaggaaggagggatgtgatttagacttcctagggcggcttgggcgcggcccgagaggagaggcacggctcggccgaactaatgggccggccggcgcgaggaggcggcccattaggggcgcgcggaagagagggagcggtccggtggaccgggtgcacctcgcggggtcccgggtggagcccacatgtcggcggcaaggttcacggtggggagagcgcacgcgggtgcggtgctagggtttggtgggtgcggtgtgtgggcggtgtgccgggtggatcagatggcggcgggcccacatgcagctggttggcgcaccgtggaccgcgcgcgcgcaggtggggaagggaggcggcggctgactaggtacttgacccggtcgcggccgatgtggccccgacgtggcgccttcgtggcagccacgcgggctggcgagaggaggaagaaggagaccggccgagacggacggcggacggcggtggtttcaccgggggtacaaagcgacgattcgagagggagggagtacaccggaactatgggacggacgagaggaagtgagccactggctcggattcgccggagagaggccggcgacgacaaatcgcggcggcgcacgccggcggtgagaaaaggggaaaacggcggaggggcgacgaggattcaattcaaggaggagggagcatctctggggttcaaggagtccatttccggcgtcggataaggcagagcgacgccgtggagggctagcgacgacggcggcctccgggagcgggcggcaatggcggcaaggccatgccgctcggcggcggggcttggggcttcgtctacgcgtgttcgagaggctagccgagctaccacgcgagctggaggtggcgagagagagcgaggaaggggaacggaaggctatcgcgtcaggacgggcgctgggagatggccaacggcgcagggcgggctctccggcctcgggccagggaaggggaagaaggagggtgcccggagtcctcttcggctcctcgcgcgcacgccggcttcaccagcacgtgcggcggcgaagggaggcgaggtcggcagctgcaacgcggtaacaatggcgcggtagcggtggaagagagatgccgagagagaatgagatggggaggctcggcctgggctttatagatggaggagaggtggtttgggagggggaaccgacatagggcggtcaagggcgcaaggaccgcgtgtggagagcatggttcctcaggaacgatatgatcgatggaaaggggacagccacaattgcagagtctgtaagtttcctcgtcaactatgagaaggtacagttgccgatccgacaacaaagcgatgacatcaaaggaaaaggattaatgtatgatgaaccaatggagaaattagtgcaggtttagacaaccaatcaggttgataaatggcacgcccctcccgaaggttcagcaaaggtaaatgtggatgctggttttatagaagacacaggagtttcagctgctggaatcatcattacggactgcaggggtttagtgctgtttgctgcgcaaaaaactctgaaatcctgtgctactgctgtccaagctgaggcattggcatgtctagaaggattaagggcagccatggaatggattcatatgccaataatcttggaaactgacaacatagaggtgttcaaggctctgtcacaacaggagctgtcaagatcaccctgggcagcgacaataaaggaagcgagagggatgatgtagtgtctccaaagtgtgcaggtttgcaagatcaagagggaagcaaataggattgctcatgctctcaaatggctatgaggtctagatcgtgtgtggagtggtagttgtgtgctcccgcaggaatcttagacttgatagaccaagaatgtaatcctctcttccgtaatcaataaaattccctctttgaagtcaaaaaaaaagttgggcttaaattagaaatacataaaaaataggcttagcttcaaatacgcatgtaggttttctttaaaaagaagttgtatttttttggccaaagatgtgcttgatactgttatcatgggctcgatgactttgatgtttgaacggctgaagataaaggctggaattttcatggactccaaaaggcatgtgggatttgctgggatgcatgcgcgcaggccttttcttgtggttgtttcctgatcacacggaagaaaaaagagcaaggattccggtctctcctcaggcgcgagcgatcactcgggcatcaagggacaccctctctcccacttgatgctgctcaactcatgtgactgactgactggattaaaaaaaaaaaaactcaagtgactacagtttgctcaggaggaaaataaaaactcgtagcctatcaaggtagtggctactctccagttatgtattattgagaaacgcccatggtcttttggctaattccacgagggacgggctagatgacctgggtttcaaagtctcactccttctaattacttaatattagatccttttctaatattagcgtcttttttagttagataattattgacgttttgaacaacaacaaggtcttcaagcatatctttgactataattttctattacgatataatatacaatacaacattaaatattactccccctcctaaattataaggtttatagtgtttttacacagtctttaatgacatactttgaccattaatatattccatattatgttctcaacaaatgtgaaattagcattacataaaagttactttaaaatatttaatctagtgatataatatgcataatatttagcatatatataatttgtatgactattgatcaaaagttcccgagtttggtttttcttaaaagaggacgtcctaaattaatttaggatggagggagagtaattaacttttgttataataccttttaagaataatctattgttctagtggttttaaactaaatactttaaagttattgatagttaaagttgtaaaagtttaatcacaaccttgatcaaaacgtaaccggactagttttgaagaaacataaagcccatacataaaagtttggcgtttcccgtactcgaaatgcaagcgtgtaccactgccagtcgagagttcaggatcaatctgaacaggga

SEQ ID NO: 60671 - DNA, 2875 bp, Oryza sativa
aaactccggcgagaaacgtgagcacacgctcccccgtcgacagtggcaatggtggccccaggttcttggaaacctaggtcatcatcaccgtcatcgatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccaccctgtctgagcggcggatccgggggcggccgaagctgccacaccggaaccggaggggttccaggtccaggcctcctccttacgagccactcggtccgcgagctgaaaaagttctgcggtagtctggggctctttggaggcaatcttttcgaacatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggtcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggcgccgacgagggagtggtagccgaatggcgtgcagcagccgccgctcgccgcgccctccgccttgatgacacagagccggtggtggcggcgccggaggtcctggtggtggcggaccgtccaccagcacccaggcgctgctgtgccgtcatgaccaagttggccacgtcgtccagccatcgctgggccggagactccgggtcagggacgatgggcgggtgacgtaggagcgcgccaacagcccgaagtgcgccttgaggcgtgctgccgtcgccgtagacgaggaggcgacgctccccatctcgccgttcttctgcaccacccgcgactggcgatgctgcggatttttcgaccctctcgagcgcctccccctgcttaggattttgttgtggaggaggtgggggcgtacgagctcgacggcgtgggtttggctccccgtcgtcgccgctcacactcggagagaggtcgtgcgcctttgcttgctcggccattaggctgaacaagggaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtatgtggaaagatcgcgtgccaggaagaaacgcgagacacggacgatgtatacaggttcgggccgctgggaagcgtaataccctactcctgtgtttttggtggatctgtgtaagagcaagttacaaaatatcaaccagccctctcctctcccgggaaaatccagtcccctctctttgtgggcatggtcctccttttatatcttaaggggataccacatgtacccttttctttccaaactggacttttcttctctttatggacggagattggtatggttgccgtccgaatgacacttcgatgggacagcccacacctacctccactcccggcggagacaggcgcaacgtgggatcgtggctgtctgttgctgacgcgaccagtgtcagaccggtcacagatcggtcattcttgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctagaggctctcgtcttgacggaacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttatgtgagccctaccgtgttcacccaacctatgtacatagtgcataccccacaaggggtcggggcacctcgggcctcggggccggggcaggggcaacccgacccccccctcggggaaatcaggaggagggcggacacctcaccctcgggcccgacgtccccgaaggtgccaggccacgtgggcgattcaatctgcctcaagcctccgggcgcaatactcccggtcccatatcaccgacaatatatatatgtctatatatatg

SEQ ID NO: 60672 - DNA, 2579 bp, Oryza sativa
  unsure (1)..(2579): unsure at all n locations
cccatatccccggcaatatatatatgtatatatatatgtatatatatatgtatatatatatatgtatatatatatatatgtatatatatatgtatatatatatatatgtatatatatatatgtatatatatatatatatatatatatatatatatgtatatatatatatatgtatatatatatatatatatgtatatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcctagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagataggtgaacaagggcaggcgatgatggaaaggaacaaagaaaatgccgccaagaagaagtaccatcaccacttgnngtcaggaggctatagcgtcgcgatgccgaagtgggagcagatggaggctagcatgattgaaagggtgtcgaaccggcaacagccaattggccggaacgatcgaagttctggtactatgctcacggggaacgctcaacccagctgatggctcactggtcttcngctatcagatacaagaggctgcgcgacaactaacagatgcagtggaagcctcctctcaggcacgttccgaccagacagaaatagggacgagctgacactcgccctgcagactccagagcatccaggacgaactcgagggaaaggggtgattctttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatacaaacacaggacgaatcgacatgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaagg

SEQ ID NO: 60673 - DNA, 13637 bp, Oryza sativa
caggtcccagcatcgactcctcctcaggatctgcaccgactcctcctcgtggctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctagaagtcgcaccaatcgaaaaggcggaagtgaaatacatgtacgaattcggtaaaccgcttgtcaagcctgagttgctgcagtccctacccacacaaatgtacaagttccatcagctgtacatggagatgagcgcccccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactatgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcaaggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatgtagtttattcgcatgagggataacctaaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatataatataatatatatatacatatatatatatgtatgcatatatatgtattgaaacatatatatgcatggtttatatatatatatatatatatatatatatatatatatatatataaaccatgcagcaacaggggcatgcaaaaaaaaaaggtcagctcgatctttagtcccggttggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtgataagtaattaattaaccagcaaatgggttggtgtagcattgaatttccgttgcaacgtcttaatccaaccaatggcgataaatatatatatataagagacttcatgtgaaattgggacagaatcaacttcaattccatccaatttcttccagctgtctgatgaagatcagaagacatgatctcctggggattggacgcatcaggaactcgagccgaaacatggattaaaccaccctaagggacaaccaacgggagtgggtaagccaagctacagctcgtcggagcagcaggtcacccggacacggcgacggctaggatccgacgcaattaggacgccatagatgcgcatctcaccgacatggcactcgtgtgtttttttctcatcgcctatgctcaactcaaccagttctgataataccgtaacgagcttagcatgataggctcgctgatgggatgaagagaaatgggaacaattggctcgtttttgccttgggttagcttttggatgtgcggaaacaagctgaggcaactaattaatggactagaatatagcttgtctcgccttctttgccacggcctatacgacctgctttccgtcattccttgtatgacaaatatcaaagctaaagaatcagttaccgatgccgatattgctaaacatctctccacaattttctttctcaatctcgcacgttttttcagccaatgattttccttgagatccgtgtcatgcccatgataccacactaaattattagtagcttaatcgtatcgatcatccggattagattagagatttcatgcgcaggatttttcacaatttgcttcttttgaaatatttatttcgcaaatatacctctgaaaaaacttaacgtagaaatggtcctttttagacgtcagagtggctggcgccgtcctcctaccgatgtggcggggcggtgctgaggtggcatggggagcgcgccaatgtggttggggcctcccccccccccaccccagcgccaccatttttctcctcccttgtcctctatagtgtagaagagagagatatccaacatttttatatttattttcacacttaggagcacataagaaccaaccatggaaaaaataaactcaaataaacaaaatatgtgacatctagaattttctaaatatctaccgaaaatgggtgtcatttattaaaacaggcgtaactttctcatacggactcggaatcaagcaaataatatatctacggacatctatagaaaaagttactgaatcgagccgaaaaaaagacttgaagctcatccaccctgcgatgaatcacaatcacaatccccaactcccaaatcattcacaatcctcaatccccaatcaaacacatcacagaacaagaaacattgaagaacatcacagagatctgtcactaacacagaaatcattgaagaacattgaagaacagggagggcgccgccactgcctctcgacccgccgtcgggccgccaccacctcccctcccgccgcatgccacctcccgctgctgccacctaattttaggtttaaatctggacatacattatctccagatacaaactcaagattaagtgtttctttaacagagggagaatacagatgacatgaccggcctcatgtgccgcccctccccggatctggcgaaagggagggttcctcccaccgcctctcgtagccactgccgcctcccgccgccaccgccgcagaggcggcagcggcggcggaggggagggcaccgcccgccgcccgtggggagagagagagagaggcgcgggattggatgagagcgagagagagagagaggcggatgtgaagcgatgagaccgagagagaggggctcagcgactcggtcttatcctctccctcggtcttatccgctcctcggctcggctcagtttaaaaggaacctataatttataataggtgctggtttttaatattaaaggttccgtttttaaaaaaaacggtataaaatataatatgtgccggtttttatttagaatcgacacctataattacttaaaggtgtcggttttttgcgattttaacccgtggaggtgggaaaaggcacctatagtggcgacacttatttgatgttttgtagtagtgcatccaatttctttcggtctgctagcaggagaagtgtgtaagctagggagctgacaaggatcatgcagtgatctactgggtattggacgcatcaggaacacgagccgagacatagatcgattaaaccaacctaagggacaaccaggagcgagtgagatcagcaacaactctccggaacaacatgtcgtccgggcacactatctaggatccgaggtggctacgccgtcgtaaagggacatgccttgctagccttgcatggtgatacgagcatctccagtatatgagtaaaatcgaaccatgtttgataaaaaaaaaatacaacacactgtagcaaccgaccaactgtacgtatcagagcaaaaatcgatcacaaaagaagactcaaactcaacaacgaaaaggtggtatgcagccgttggtcccacgatcgatgtcacacattgcagccaacgaatcaaaattttgttcgaccatgctaatcgaaccaggactgcaggttcctacgtatgccagttgatatatgtctcgtcggccgaacagtgtaaagtacggcgagctctatgtggccatgctaggtacgggtgtaaatggtaagccgcaaacccacttatagatcaaaataaacagatttacggcttattttgatttataagtggatttcgtagattagctacttacactcgtaatactaggttatctgtagtgtagcataatgtatgaatttacatgtgtcatcgataagacagccatccgtatcacttctctgggtaatctggtttgggggttcttaagcactgccgaaccaaaatgagatcaggagaggcacaaccttttcattgatcactgcgccatctgcctacaaggctacaacctagttgttgatgagcttttgttgatagagaagtattaaatataaacatttatgtacatacctcttctatttggtgagaaataagcaattgcatcagcggtaatttttgttatgcgttcgcacagttacatggtatgcagtacgttaaccttgccgatattttggttaatttgtaaaatagtcccctcttgtatctaacttaaatccatataatacaccacacgcacaaattgtctcccattcttccctatctttgttttaacaatttagtcactgggttgctaatccaaatggtaataataagtaaacaatgtagcacccacccacccgttcggtaagtaattaaccaacaaaaagggaggattggtgtagcactgaatttttagtcactattagtgagcgtgcacgtgcaaggcacgtcgatactattgaatggagttaattttgaaagagtattcagtcttggtactaacaaaaatatgtgtattcgtaaatatgtgattattccatatagctctaaaaaaggttgagattgttttaaattgctgaaacacgttggaatgttcgatttgaacataattctttgtaaacttgaactccaattcatttacaccgaaacaatgtcaaacatcagttttcaagtatccattcattattttacaaatattacaacttacagaggctaaaaaaaatcagagaccatttatctatcagacgcttattttgtgtgaaaaaaatcaagcgattttcaatggataatagacagtcgcacaccacttctgagttcttacatgcatatcctaatggcatagattggccgatcgccgatggcagtataagcatacacaaggacaaactataactacactaaatgaatggcataacatgaactaattttttgatttaattagattaacattctcattttcagcctgtgcttgctgccgacgctgttggctgactgcttcctcatgctgaagtagccctggtagctctgcaacgccctgctcactgaacacccaacgtcggtgcgtaaagactggattttcttttgttagttcctgagatcttgtcaggtttcagaattaagcatttgctagtaagttcagttgatgccagctactgaagtttctaaattcatcacctttagctcaatctcacctctgatgaaacaaggcatggcttcataagctgcttgccctctgcacgtaaccgctatggaaccacgacagtgtgttccgtcacctgttaatgtgtctcattctggaactgaatctgtcaaggggggtagtactttggtcagatatttgaacctcagacctgcagtgcacatattatgaatttcgatgctgaaacttcttacgcaagcaacaactcattgtaggcccctcagatgttgcttagcaaagtcctcatgtagagatatatatatatacaagttgcaaaatgaaattattttgcttaacagtatatacactactgaaatagtgatagcaaagcactatatgaattggcattaacactccaaatattatgtagtgaatcaggcaacatgatcaatcaaaggtaattagaaggttaacaaatagtatattccttatgaattacgatgtgattcaaatactcttttaaattcctcttatatggtcaatattgttaaccttcgtgtggttgatccaataactgaaggacatgtaatgttgttatatgggtcactcaattaattcccttttctggctattatatatgagaatcgacaatgatttctgacatcaatgcaatatatatgtgttaaagggtccttttaagatcatatgccaccaaaccactactgaatacggcactgaatagaagaatttagtcatttatgcatatttgttgcattttttatccattgagagtatataattcgatatatagctcaagttatttattacctgagaagtttttggacatctgccatttgacattgtaaaacaccatggtgacttgataattcctgccaaacaattgatttaatcagcatctgaatatcatagataagaagcaggaaacaagaaatattgtaagttgttacatcatccttgttgaattgtttcgatgtacctctccaatctgagcccctgcaatatatcggattcaatgtcacgtgcaaaatatgagcaccgtaagaaaattcagcaaacattatagtgtcagcgttaatcgggccatacatgatgcataccttcaaggcaatggcataataataataatcgtgaaagcaacaactctatttggccaacctccaaccaagccgtagtaaacaactaaagataaggccagcagtaggccggccttattgagataatccaatataaagttaaggatatatatcgcctgcttcaatcccagcacttagtaaaaggataatatttccagggtcattttgatgatcaaaagattgttggattacaataagcataggattgaattgataaatagctttgcaagtacttcctgaagcaattctgatgacatcaccttatactaaaagaaccatcttaatttctaaattatgtactacaagcatttttaggattagatagttgtaatgtattacaagcatttttaggactgggtagtttcaaacatagatatagagcctgttttgagtctacattcaataccaaatgtgcaagttttgaagtacatgatgaccaaatgatcaagaaccagatcgtccagtgccaaacccaagtttaaaccatcagaaacaaatgcagagataaaaatgttcagatttcagaagatgagatgacaaagcttaacctgttggaaatcatggcagatcgaagacaccaaggcctctgtggaccatgtgatcgtcaatgacaatgacccatcattgaactaaagtcaagatgttaatcttcatgccttaaataagtacatttatttagtgaagttacaaccagggttttcaagtttctttgagtttgaattccaaaactggtgcattaaagtataattttgctcacctgaacatgcatgttcaggacatcatatcaagctcaagagagtcaacttaggcatgccactcctcatgatctcataactttcctgtaaagaaacaaatataataattaaattttacatgaagcacaggaaaaaaaaactataatcgcttggctgaaatggaactgatcctctttggccatcatcaaagcatagataaacctcaaatgaatctgatggcaaacaagatgaaccaaccaaaaaaattctgaacaatatatgttgtccctagagagcaatagccaatagatagtcaggagataaaaattgacatctctattggacttttcacacagtaaaccctaaaaaacaaatgatcagctctagctggtgtgctctttgcttcagaggtacacatagcttttgttgacgatcactaaagcttatttgacagcacatataagttaataggaaaagcaaactataaatcgtaaccatcaaacttaataaatctatcgctagatgatcttggctagattattcagtttgacatgctattcttcaagaacatcgagcaactaccggtgtcgataaaatatcatatatctagtttttgtgagaggcaagtgttgaaattgacctgctaagtgatcatggaggagacaaccatgtagaatactggcacactcctaagtagttggcagggcaggcacctcactggcggatagaaccgcgtcctgtttccatgcaccatctgacccatcaatacactgagtagaaaaaggttaaaaaataattaaaaaagacaaatctagataggaaatcatgttcctttcacagggtccagatgaaatgaaaggtatgaacttacaatttggcagaagatggagtgattaaaagcataaatacaatctgaaaaaagatgaagtgattaacaaacacacacaaaaaaatttttgcaatggacgaagagaagagacatgtcatgatctgattgtatctcgatgtagtaagaaaagatcagagcagccaggcagtaggaagaattgttagaattaattaaccatatgagcttgcatagaccacatataattgaaatatggatgtatgagaaaacatcaaacaacaatccccatatacatgtacaggattgacctacatgaccttaagtcaccttgctaattcaagtaaataattaagagtaaagttaatgtcagtgcacatctaaccagattgctatataaatgcaatgccatacagctatgagaatttcatgattgatgcatcactactattgtttactttataactctgtaaatagagcacaaatgttgagcgcaatgcactgtttcggtgtatattgccattatcagatccttactatcctcccaacaaatgaaaatattgtacccaacaaagatccgaggcggcggcggggtagggtgagcggcgtggccgcgtggggatggcggagggcggaggttagatgcgctttttttttttggcgttctttttttttatcggcgtttttttttgtgcgtgacgtggtccgcgcggatggtgcggtttgttttgagccggatgacaggtgggtcccacgcgactgtagatccgaaagattgtaggattgtggatgaactcgtactttttatattatagataaatatatatatatgtgacatcgatcgtatcagattgctgggcatgcagaaacacatttaactttcattcaccttagtttgctaagaggagaggatcaaacgaacgttggtctcatatataggaataggacgcatcatgacacaagccatagctcgatctgatggtcaggcacaatatatgtgtgcttcctacgctaggatgaacgctgatgcagcaagttcattcgcttccggttcctagactgaaaggtgagagagagttaactgaaaaagtgtggcctcttcgttgggccaaacgagaaaagaagaagctagcaaccggaaggggagctgccaacctgtatcaccgacctcactaaccaattaacctggtctattttgttcttgcgttgtcaacaaattttattgccagaattttggtaaccaaaaacccaaccagcaaagccaaactggagatttcagttgcatgtcaactacaaacatatactccctccgttcctaaataattgacgtcgttgacttttttaaacatgtttgaccgttcgtcttattcaaaaaattttgtggaatatgtaaaactatatgtatacataaaagtatatttaacaatgaatcatatgataggaaaagaattaataattacttaaattttttgaataagatgaacagtcaaacatgtttaaaaaaagttaacagcgtcaaatattcagagatggagggagtaatagctaccttattaaaaaagttgtatttctacctatgcacctacctagacaacagtgataaaataaagaatcagttatgcacacgcttcttctatttggttagaaataagccgtgttcatcatagtgccatcagcaacgccatgtaactcagctatgccaaaaatatcctttgatatgctttgctttgccattggcattctcatgtgcagcactggatcaggatcctctacagtcaactgtacataccgtgctattgtcactgacatgtaggtccgatgatccctggacccacatattagtaacaaaggcacgatgcattaactgcagaggatctcaattcgtatagcactacctagtgcatcatccgctgggtagcaatagcatacatatttttaagttgttttaattaggctttattaattataatactactattacgtaataattagagtatacataaaaaaatattatatttgctatggttgcctggtatacactatttttaactgtggcgaattttttcattaattagtaaataatctgccttcctcttcaaaaatccacagtgcatcacaacatgcacaaattggctcttaatatatccgtttaacaatatagtcagtggggttttttaaaagcttttaatcagtgtagttgttaatcaaaaccacaagtagataagtactaaacgacatagcactcacttgatgctaagtaattaacctgcaatagaggttggtgtagcactaaatttttagccatcactacgtgcacctatatatatacatcttgccttgacacaacgcataaatacgcgacttcatgaggtttgggggaagaaccaacttctccatcccttcacttcagtttcctaagagaagagagtactgtgtgcaaggaggaagccagtgagaggggtcggattcacgccatgtgtgatctcatcggaataggacgcatcaggaacttgagcaaaagacggtgacaaccccaaagtacgaatagtgaatcgcccgctaagatgaaagctagcgaggacggcttgtctgttctgttccggttcctgttaagtgtgcaagcttgcatggttgagtggggaagccgtgttctctccagtgcatcaaagcgaggaaaacaacaacgagaaaggagaatgaaaaatcgtacagcaacttaccagacatcatcaccttgattacgatggagctcttgaaggcccctctcctttcttatttaagcatagatttattgtcttaggcttcatgtacttggatcgtcagctcgtcgccattgttcgcgaggacgttacaaatccgcgaaaggaagtaccatgctattctcctcttcatcttatcgatgtttggtggaacacgccccaatcagtacttaatccttatctgcgcttccttctaggtatgcgtgtgttgcgtatcgatcaggtgcccgtgtgctagcttcggtgcagcattccagcttactccttctgttccaaaaagattctaagggtttgttttgttcccaaacaaaaacttttcactatgtcacatcgaatgtttagaaacatgcagagtattaaatatagacaaaaaaataataattacacagattgcgtgtaaattacgagacgaatattttaagcctaattgctccatgatttgacaatgtggtgctacagtaaacatttactaatgacatattaattaggcttaataaatccgtctcgtagttttcaggcggaatctgtaatttgttttgctattagtctacgtttaatactttaaatatgtattcaaatatgtgacatgctaaaaattttcgttcgcgaactaaaacatgcctaatcttaggtttaaatctaggcatatacaccgtgtccagattcaaattcagattaagtatttctttaatagagggagtacggatgactggatttttcacattgtgatccttttaaaaaatttatttcgtaaatagacctctagaaaaacttatctcagaaatggtcctttttggggcgccagagtggctagcgccgtcgtccaacgagacggcgtcagcctatttggcgccgtcctccttccatcgtggcacacgcaaaccgatgtggcaggaggagggcgccaacatggctggcaccgccctagggaggagggcaccagcatggctggcgccgcccccctccccccacccctcgcctccattcctatttctctatatagagttgcaacctttttatttttgttttattttttcggatgttttttcgcacttaggatcatgatacaaccaaccactagagaaacaaaaaaaatttaaactcaaacggaatataccacttagctagatatccgaaaatagcataccacttagcctactttgcaccttcatcaaaattagaccataactcctttagtaaaaccctttgatcagcatataaacataatgcactctaccactatatgaaattacttaatctctaattcaaaatataaccacatgaaatgatagccataagttaaacagtacagagagatacagtttttttatttttttgatatttttttcacagttaggagaataaatgaaccaaccatagaaaaaataaactcaaatggacaaaatatgtgacttgtaaaattttccaaagctctaccgaaaagtcattcaggtgtcatttattaaaataggcgtaactttctcatacagactcggaatcaggcaaataatatatccacggacatctacagaaaaagttacatccgattctctcccgctttgccgggttcggcaatattaaaacctccaaattccgcttgcaagattgtgttttcgatgagagaagttt

SEQ ID NO: 60674 - DNA, 4649 bp, Oryza sativa
ggcgccgccagccactctggcatgctccccctagccacctcagcatcgccccgccatgtcggcagggggagggcgccagagtggctggtggcgccgtccaagcctctctggcgccctaaaaaggatcatttctggaataagtttttccatgtgactatttgcgaaataagtttttcaaaaggaccaaaatatgaaaaatccaggtacggatgatatgaccggccaactgtgccgcttctctcagtaacctggtttttgcattgtgaaccaatatgatcatgtatgggctctttttggtactgtagttcatgtgttggtattaccaaaattttggcatctaaatacacagatttttagaatggcaacgaagcgaataggcaaacgttacagatttattttggcaaattgcaaatctaaaaaatcagttattcacgcacttcttatgtttgttgagaaataagaaatatttctccccctttttttccccttctatttgctgctgatcaaggagaaaaaccagcaatgccaggccggagctttcaattgcacgacagtattactgtaaattaaaaaatcagttgcgaacacagttattctatttggtgggaaataaacggtcttatctatacttctttaaaaaaaaaagtagcagtggtgatgtgcggtgagtttgtcacttctatcaccaactccctaccttttcggaaagttaaaaaaaaaagagtatatatatgagatcaattatgaatacccacatcttgcctagagggcagaaccacccagttcaccattcgttcgcttcagtttcctaacatgaaagtatgcaaggaggaagctgatcgatataagaattcacaagaagtacatgatctcatcgatcggatcggaatgggacgcatcaggaagtcgagctgaaccacatcgcaatcacaaggtccaaacagtcaatcatctgcaaagatgaatgctaaattggacggcctgtatgttcagttccggttcccatcccgtgcaaacttgcagttcttgtggccgagcgaggaaggcgtgttctcttcagttcgtccgggcgaagaaacaggcagcagggagggatatgccagcagcaatatatcggagtgaactgtcatctgtggatgcagcatccacaaggtgcttccacaagttccacagcttttccttctcgcgtagtgggggtttggagttagtgagcacttcttttttccaatccctcgagaggacactgctggcgagctgtaccgaccataccagacctcaatccaaattaactcttaagtatgtgacagctcggatcaatatatcaattagaacacctgatacgaacgtcctaacgggtgattgatcgctgggcagaatcggtccccctcccccacatgatttccttgttaacatcattactttcctgttttagtaaatttatacatctaaattttatacacattaagtttacatatctaaagtttatatattaaattttgtacacttaaaaatttatagacctaaaagtttatatatccgatttaaatttgtatttagattcaaatatttttatatagaatatttatatacataaagtttatatgtgggaatttacggtacatatataagtataaagtctatgcacatgaataaaagatattagatttattttctatttttttaatttgttttttttaaagaattatagtgcaataagtagagaataaggggaggagccgtgttaatctagataatctagataataattgctagtatagtatatttacatgtaaagttttaggagttagtgatagcaactttatagcaagataggataatgtcaactactggaccatagcgaatctgcgaaccactggccggtcaattcaatcatctattattgcccatcgagtatgcaacgtttatctgccgcagcttctgcagttctgccggatggccgaagaaagaagttatccaaatattatcgatatagagataaaaaaagggaaatgctgcgcgtcgggcgaccgagcggccgaaaaaaaaaattggacgcctggaaccacgtgttgagtattttaaataactttaaaatgatttttctcctaaactaattatccaatctacgatccgatcatgccgttgtattcgttgaaattaaatctttataacaagaccacacatgattatattttgataaaaaaatattttagcttttttattgatatttttctaaaatgctgcatctggttctttagatgtttcaaccagtagttttacgttgtttcagctagtgtactcgtgatatttcactatatacggatcaaatgttgcagtggattttgatattatagaacgcgtcattgcaacaaatcactcacatattttggaaatcctctattaaggaaatttatttcttttttttgttccatcaaaaatgtttcacctaatgtactcacaatgtttcactatatatagatctaatgttgcaatgaactaaaacattccattgcaacaaaaaacccacatattttagaaaccccctattaagagaattcgtttcattttttgttccacagaaaaatgttgcacctagtgtacttataatgtttcactatgtatcaaatgttgcagtgaactgaaacattctttcgctatttgctgaaacattgtttttatataaggtgaaacaacacccgatttaaacgagtgaaacattttcgatatatttagtgcaacaattccgatatacctggtggaacatcgtgtaacatttaaaaataattcaataattaggtaaaaaaatttcgtcagaatatatcaatgtgtggtcttgttttgaagatttaattgcaacgaatttaatggtgcaatcggatcatgatttagataagtaatttaagagaaaaatcagttaaaaataagtttacacgtaaatcgggcgcaccccctcccgatcgggcgcccgacggggagtcgtgtccagataaaaaggtttcaagaaacattattgtcgctaaaattggttgtgcaatggagcgtacatccaaacaccacgcactataaccacacgaacacagaggacgttgagagtgcagactacaccaaaaatgaccgtcgctatgcgagtccgatcgacgatcgtcaccggttgatttgtccctctcagttgctagtgcgcacgttagttaggagacatgccaattgccaaagttgatgtcccttagccggacggctgctggtttttgcgttcttaagcaatgatcatgtatgcaaattggtatggccaaacttctatgggcatcaaaataatttcatcccgatcttaattttcgctgcaacttattagaaatacttatatttatatagacggatgaagtagccctcactacttaatcctgttgtgcaagtaactaaaatgattaactctacggttcaaaaatttattgtaaaatttagtactatgtatcaagaggtaccaaatttacagtagaaaaggtggtacatcatggtacctcctcaagaaccgtaaaattactcaactaaaataggacaaagtataatagtcctgaatttttcagcccccattttgtgtgcctgctcggccaccgcacacataaatacacgtgcgatgagaactgagtatagctcaagtggcgtgggagcgagggtattcgcgcagcccatctgagttcaaatcctgaacacagcgtgtttctcatagggttccttacaccctcttcctctctatacaaaagaatcaaagatagccagctccttccggttattcccatttttttttctttcaaaaaaactaaatacacgtgtgatagtgatatatatcttgcccagtcacgcccaccgcgtacgtaaatacgtgactgtcgtgtgggattggaggggcaagagctaaaacaagagcgtatatatgatcccttcagtttgctaggagaagagcgtgcgagaggaagccgcgagaatcgtgcaatctcacatcggaataggaagcatcatgaattcgagccgaaacgtgcatcgaatatcctgcacaatcaggtggtatgtacgttctcttctgctccccactccgtgcaaatgttcgaggcgtgttcttttcagttaagaaaagaaaatgaaaacgcaacaggaaagggagacccagcaacaacttgcaggagcaaacctgtctgtcctcccaactctgaggaatgaacatggaagctgtcacgctctgataaatccatcctaaattaaaaatcattctctaaaaggaataataaaattaattaaaattcgaagttaaattggtaaacattaaaatgcgtataagaaaaattttaatgtggcttggagtatttttcttaaattctccatgctctaaattggtccctcaatttttatttgaatattcagagcacaagaaataatttaaatgcaacaaaaaccaagtgcagagttaattaaaaatgaaaagctaaaaataattctctccttctctttgggccattttcggaccaaagtcctcctctccctcagcccgtgggcgaccctctctccctccttcctctcgggccgacctcctcccctcccttgctcggcccaactctctttcctctccctcggacaaagtccattcctagtccccctgc

SEQ ID NO: 60675 - DNA, 2740 bp, Oryza sativa
cagcgacatcctcttccccggcctcctctccgtttcgcccagaaggctgccgggagtgcatcctcatcggcaaccagtgcgccaccaccgtcgttctcctccagtcggccctcaccatcgaatcgagggacgccgcagcgcgccactgcctccaccggcgtcgcagccgcctcctcttcctcggcccaacctctatttctcctggagactgccggaaattcgtcctcaatggtgagcagtgatgacgtcgctttcatcctcgtcctccggcagccctccctcgtcgctagagtgccggctcgctgcaccgtcgctgccgtcggcttcatctcgtcgtcttcgtcgtcggccgcgcctcctcgctgcccgaagacccgtggaacgtcgccacgtcgcagtcgccttcctctggtcgccgttcccgccaagactaagtgctgcccgtcatcatcgtcgtcaagtccgcagcgccaagcccctcgtcgtccgcctcttcgtcaagcccgaggattgccagagccatcccctcgtcttcgacccgttcgtctccgtcgccttcctccgttcgtcgttgctgtgccaaggtcttcgccggtcgccatcgttgttcccttgccgcgtcgtgcccgtggtgagaaccctccccttcctgccctctcctcgtcctccccttgtggtcgccgcgtggattgcccatgtgtgcagctcacgtggtagtcccggctgccagtcgctctatcctttctctctcgagtgatgttacattgcacataatttaatggtataataataataattaaacaactcggaaatatccactttaattgcacttaaaattcggatggtcgtttctcggccatacaagctcctaattcactcgttaaattgtttaatttctgttataacttaaagaacccgtgtttattgtttttatgtgttgttattgtttctttcttagatttgtagccctgttttgttgttcgtgtagctgccgtcgtttcggaagttcccaaagtgcagatcaagtcgtctgaagactttctcttcgagcaaggcaagtcataccatatttcttgaacatattgaatcccattattgcaaaaactatgttgtttcacttctatatgcatcgcttttataaattatatgacgctcaccattgtttatttaatagttaatattccaatgttccttgttatatagccatgttgttgaattgctacccatgctcttgacaaccctagtaaaatgataaaatgactagtatgactccgtatatgatggacttactagttgcactaggttgagcttatctatgcttagatccaacatggaaaccctttttataaattagactgtgggtaataactaaaatattcaagattgatgatcaggtggctagctgagcctggacatgttggaatctcattcaaaactcccaaaacctgtttttggtggggcgcgaggtgcatggttttgttagaagcacctcggccactataaggaccagtcttcgggcctctgttgcgaagcataacagtgcaaccacaagtctaatgggtaaggcctgactagaagtctagatcatctcaaaacaaaggccatcggtatgataggtctggggctaggggaggccgactttgacctggcgcaagagggggcctgtctcgtcccgggggatccggcaacctttaccttatcgaggaccggcgggcggcgaaaccttagcgggtccttctgttttgggttgagctaggtggatagtcttgtcacgatcttgacttttcgggtacctttgaggtatcgcgatgcatggctgacatgaagtcaagtgtgtcttgtgggtaaaaatgtacacctctgatcggagtaaaactattcgaatagccgcgccctcggttatgggcaagcctagcaatgtacccaagttagtgtttttcttctgagtgatggttggaattcatggcactttggacaggtggttaacctggggtttaaggccggtttgcgtggtttcgcaatcgtgataatattggaccgagtttaaactatgctttaaaaacattaaaatattgcaactctggctttacgcaaaaatgaaccctattatgccaactctttgttcccctttgcactataattcatttcccggcatggcttgctgagtacgatggttgtactcattcttgctcaatctttcccccttcagtcagcgaaactatttgaagaatatgtcttaggtggagtcctggcttataccccagttaagtgcctgtgaagatggagccgtaggcccgctagtctgctgctgtttttcttttgttgtcgggcctaatgtgcctttgtaataatgtaaatattatcgtgataattaataaagatgtgtcttttgtatcaagtttgttgtggtgtacccctgcatttcctgcgacggggattaatacattagcgtttgggaaaggtattttccgggcgtgacaagttggtatcagagccatctcgactgtaggataagccaaacgaacaaaccctaaggacttatttgccaaacgaaaactatttgtcaaatttccattttccttcttccctatgctatttacaaagtgttcatctccccctcccttgcttggattcaacacataatagttgtgaagaaggaacctgcctccgaagttccccctctaagcaccaaggagtgaagatcctgaagaatcctataattgaacctaagctaccaaga

SEQ ID NO: 60676 - DNA, 6043 bp, Oryza sativa
gtcggtttcggtttcggggttgtttgtttggatatccgtgattatttcatgattatggcttctagatggatactatacgtatgtaatactgttgtttgctactaatgtgtcaagttggaattagcttggtctcggaatatggtttctttgtttatttcatgtgtaggtgactcgatgcctcgggagagtatttgcggtgatggaccgggagtcggcttggggataagacaacgtctgtggtggtcagagatcatgcgggatacttaggctagagttgatgcacgtggttgatggagattccatatggcatacgatggaggtattgtgtgcatatgggatgcggagtcaaatttggaaggagtccaaatttgatatgattggttatgaaaagtttgtttcttgtactagagagttttctaaggtgtttaggacttctagtatgagtttggttcgtggctttaggctacctacctcgggtataaatagagggggagcgtgaggcttcccggtatcgctttagagagcaattgagttgagttttgagttagggtttcgagtttagtcaaaatttttgtaaggagtgctattggtgcactttgtaaacacagagagaatcaataaagtcgtcatctactttaatagttcttcgatttgtgtttcaccaggtttcggcggtctaaccggcggctcaccggcggtcagaccggtggcatcgcggcggtcagaccggcggcgacaggagtcggcagcagatcatctcggcggttcaaccggagttcgatcgctgtcagatcaacgttcattaggcggtcagaccggcgcattcacttcggtcagaccgcgatccatcgaattcgaggtttacttttttttccgctaaaagttttcagtttttgggtataccaaccattcaccccccctggttggcttagttcttgtgattcgatcctacatatggtactgaattaattaagtcaccattctgggtactacccagcagagtttcccgtacctttggaataggggttgccttcaccctaacaataagcacggttaccgcgctaaccatggcaaacagtaagacaccgtataaaacttatcaaaaattcaaattatttttcaaaatttatttgaatttaatggagttatctcagttttaccttttatcgtacccggcaataaatgtgataaccacgataaccctgcagttatcgccggttttgtaaaccctgcctacccagccgcaacacataaatacgcgcgcgatatatatgtcgcccatgagccatgcccacgcacacataatctcgtgtgggatgattggagaggcagatcaaagagcgtaggatcacttcagtttgctaaattcgatcatgcacatcggaataggacgcatcatgaatccaagccgaagcatcccctttgtatccttcacaagcagcgatcgagaaccacggtaagatgaacgccaacgcaggtggcatatgtatgctggctcatgcttccctgtcagtgcaaacgtgcgaggcgtacgtgctcccttcagttcagcagaatgcagggaaactgcagagcgatggggagagcccagcagcagaaacagcagctagcgtgcctgagcaacctctcctccggacacaataacggcgtgaacgtggactacatcccctgtctactctctctgttttttaaaaaaaatcaatctgaactaatacttgtcccgactctagattctagattcatttttagaattgagtttctttttagactgagagtagcccgcaaggctgtatagtagcaaaagagctgtagcaaccacatctcaacccaaaactagcatgagtggagcgagcttagttccaaaactctatgtaaatccattaaaaattgtatacaaaattttaaaatatactctctccgtcctaaaatataagcatttttagactaatactgtggagattatgggtatcctatatctacacggcgatggtatttgaactgggtacaggatacttaatgtagatagaatatcttatctgtatctcgggtttgtttcttaacttgtgtatcaaggaaacaccctgagaattagtcggttacgactgtattttacctgtatcttcatattccgttaggaatatagattatcttttgtaacccggactccttcccatatataaggggggtccgggcgcctctaggggcatatgttgatttttcccgaatcatacaatcaataatacactcggcggattcatccccggacaggagtagggtattacttctttcataagaaggcctgaacctgtataaatcctttgtctccaaacccatacacttttctagcttgatagccaccccctttattattgccgaaatctagtttcgacagttggcgcgccaggtaggggtagcgtcaagcttttcgccgatcagtgcaatgggtcccttttccggcatcgacgacctcgtcttcccacccgggcaggcgtttcggttcggcagcctcgacttcatcaccaacaacttcggcaagatttctctcctcgactcggaatcagaccagtcgggagagaaccggctttcggtcccgtttggattcccgaacgcggctgaaagctatttcaagaccatctcagccgagtcggcttcaaaccactcggccgagatcgcatcttctccaacgacaccagatcaagatgacggggcttacccaccagtcctgatgaagctccccgacgatttagcggccatcttcaccacgacagcatcttcatcccgtaggcctaggcggaagtcggcttcaacaccgatttcgcctagcttcagggaagtcggcgtcatcctccaaccactcggcacggtttcgacggaccagctggaagactacaacagctctcccaccgtcgactcacgtcctactgacatcgtggagtacgacgagtttagttctcgctacaacgacttcgacgacttcgacgacttcgacggaagcctagatgacaattacacccctctctactttggcgttttcatggccaataatgagacggaggagcagcgccaagcccgggagaccgaagaacgtcgccgactggaggaggagcatcaagcacaagaacaagaacggctacggcgcgagcagcaggaccgtgagcggactgcgaaggaggctgaggatcgacgtcagcgagctttggaagcagggcgccgagcacgtgatctcatcggtcagcaagatgtcgaggggacaccggttttccgcacccctcaacagaatgcggttgccgcgatcacccttctcgacaccctcctcaaccaaaacgagctcaatcgttccgaccacgtcgtcaacatcttgaaccagacgaagaccatgattgcggcgacggtcccagttaactccgaaagcgtccacacgccgactggcagccgggtccctcacttccgatctcatgactaccgtcatccaagcctcagcatcactggagcaggatccaatcgcaggagcaggggccacgacgagcggtctgttcactcgcctcccgaacttcatagggagcgccgagtggaacggcctcgctcaccacctcgtcgccgccccatcgatcttcgcgacacaatcacacagcgccgagcagctcgaggctaccatcactcgccggatcgccgcgacgacgaccttgacggagttgctgccttcaccgacgacctgcgtcgagtggattggccagccggcttcaaaccgactggaatagagaagtacgacggtaccactaatccagaatcgtggcttaccgtctacggtctcgcaatccgcgcagcaggaggtgataacaaggctatggcgaactatctaccagtggctttagcggattccgcccgatcttggctccatggattgccccgtggtaccattggatcttgggccgaactacgcgaccacttcatcgccaacttccaaggcaccttcgagcgtcccggcacacaatatgatctttacaacgtcattcagaagtccggagaatcccttcgagattacatccggcgattttctgaacaacgtaacaagatctccgacatcaccgacgacgtcatcatcgccgcattcaccaaagggattcgccacgaagaattggtcggcaaatttgggcgcaaacctcccagaacagtcaagctcatgtttgaaaaagccaacgagtacgccaaagccgaagacgccgtcaccgcatcgaagcagtcgggtcccagttggaagccgaaaaacacgccggctacgggaggaggtggaagtaacaatcataaggaccgcaagcgtaagcctgaggaacttgttgcaaccgctgctcactcttctcgacagcgttcgcgcgtcaacaccttcgacaagatcatgaactcccaatgcccgcatcatccaaactccaaccacgtggccaaagaatgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatatcttcggcggccccctggcttatgagtctaaacggaagcagaagttgactgaacgggagatcaatgctgttcagcccgacacgccccagtatcttcgatggtcagagattgcaatcaagtttgaccgctcggatcatcctgaccgagtggtccacccggggcggtaccccctggtactagacccagtggtccgtaatgtcaagcttcgcagaaccctcattgatggtggcagtgcactcaatatcctcttcgccaagactttggatgatatgcagatccctcgctccgagttaaaaccaagcaatgcgccttttcacggagtaattccaggattatccgcaactccactcggccagatcactctcccggtcacttttggcactcgggaaaacttccgcacagagaatatcagctttgaagttgccgatttcgagacagcataccatgccatactcggacgcccggcgttagccaagttcatggccgtcccgcactacacttacatgatgatgaagatgcctggtccccgtggagtcctatccctacggagcgatatcaagcaagctgtcacatgcgacaaggagagttgcgacatggcccaaacccgcgagatggcgtctgcccgagaggaaatctgactggctgcaaccacggtgagcgaaggagaagtgcccgctgccaagatttcaaaaagtggggaaaccgaagcccagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagctgttagcagcaggcttcatcaaagaagtccttcatcccgactggctggcaaacccggttctagttcggaagaaaacagggcaatggcgcatgtgtgttgattataccgacctcaacaaatcttgccctaaagatcctttcgggttgcctcgcattgactaggtagttgattcaaccgccggctgcgagcttctcagttttttggattgctactcggggtatcatcagatccgactgaaggaatccgactgcttgaagacttcattcatcacgccctttggggcatattgctacgtcaccatgccgttcggactaaaaaacgcaggagcaacttatcaacgcatgattcagagatgcttctcaacacagatcggccgcaacgttgaagcctatgtggatgatgtagtcgtcaagaccaagcaaaagaatgatttaattttggattcggaagaacccttcgcgagcatccgcgcttac

SEQ ID NO: 60677 - DNA, 11186 bp, Oryza sativa
tgaggttattgaaatcaccgttgtatgagaagacaactaacctgaagatgtacttagctgagcgtgaggtgatctttgttccttgcctggagatccagctatcgagtcattaccagcttctggcccttgggaagctgtcgtctgcgcttctacttcagggatttcttgatcagggcctgcgtccgactggtttccagtcgggggctcttgagttgttgctgcttcagttgttgccgactggtttccagtcggcggctggtcactcggattggcctggtcacccgaagcatgggcgccggtcggctggcttttggcagtcggctggctttcggcagtgggctcggggtctttggatatattttgctctgccatggctggatcggggtcttttccagatggatctatatcagatggtttcctgcaaagtattctttcagaatttagcatcattttcatgagagagcttaccaaagtgaaatcataccgagaggtcttatacctggaagatgttctaatttttagcattgcgcggccggccagtttttttctgggcatggtgcgctttgggggtttattaggcgagcccttatccccagatttatcatcgtcgccttcatcgtcatcaagcaccagtttcctcttgcgaggacccgtctgaccagttgatttggaggtctgaggctgcggatctggtctgatcgttggccctccacctccctgagcagtgtgttggcgaggagaccggcgctgagtgactggtggatctgacttcatcagtgcatattcctgaacaagatgcttccatagttagtcaattcagcatgaagacgaaattatgttctgatcatagtttgaagatttccgatacatacctgcggaggcggattgaatgcattatatggcacgactggcagctggtgtgagtagctgacgacgattgcatttgagaagattttatacatcctctccttcatgattctgaaatccagagagtctgattcttcacggttaggatcatacttgccgtcgaactcgaatgccgtgcgagatctttccttgattggcgctagtcggcatttgatgaaatgccgagtgatctgttctccctgtaagccttgttctttaagatttaacatacgatccaacaactccaaggcttgtactgcttcatctccgattggaagagagttccaagtatcttggtacactggaggaagacaagagtacccgggaagagcaggctcgggattctggacatagaaccagtttgcatgccatcctttgttcgaagtcttgaagggcatcgagaaatatttttgactcagagttccccttagttggaatcctgcccccccgactacacacggtttgttcttgtttggttggggcttgaggaagaagatccggcggaatagggcaaagtgaggtttgatccccaaaaaggcttcacaagcatggacaaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaggcctcaccgtgcgctggtcgccacccgatgatctccttggcagggagaacgccgtgcgccaccatctccttaagattctcctccgttacatcggatgacgcccattggccttcgaagctttctctctcttccgccatcaatttcactcaaatgtgctgatttgatttgagggatggcttgggagaggtgagggattgaggcagtggatcacgggaaggattttgatgcacttttcggaggtggatttggccggagttgtgaaccctagttcgccggcgcagctttgcactgtagcaaggaatggggaaaatggcgagcgttccggcggggaagacgaggcgtcgcttggatttcgggttttattgttaagggtatcggaagtgctaatgggcctaggcctgaacagtacttcagcccaatacttttaacagcgtggcccattgtgttccttagggacttaggcatattttgctttggcaatattatgcgcacaacagtgttgcccaatgctgatcaaatcctttttatgcggtcatataattctttggaattattgcaatgcaaattaaaaaggtgcccgacagaaaggcgttatgctgtttttgcaagctcttttaggctacaaaagctgtttgggttaactagggatgacttgtttttattatagtcatttccttggcatgttatatgcctgttttcatggtaaatagtcatggcctaggctattcgacttatttattaccataatctttataatacttgatgggtaatctttagagtttttatattcggatgcctgtcgagtgtgttcattcgtgaaccttttagagtgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttgggggctacacctaattaggtgcatctattcgatgcaccatattctttatcttttcgccctttacagtccactcggcagattttggcttgaagagtttgaagtacttggattatcatctttgagaaggctatgatggtcgactgcaaaggactcgggggctactgtggagattatgggtatcctatatctacacggcgatggtatttgaactgggtacaggatacttaatgtagatagaatatcttatctgtatctcgggtttgtttcttaacttgtgtatcaaggaaacaccctgagaattagtcggttacgactgtattttacctgtatcttcatattccgttaggaatatagattatcttttgtaacccggactccttcccatatataaggggggtccgggcgcctctaggggcatatgttgatttttcccgaatcatacaatcaataatacactcggcggattcatccccggacaggagtagggtattacttctttcataagaaggcctgaacctgtataaatcctttgtctccaaacccatacacttttctagcttgatagccaccccctttattattgccgaaatctagtttcgacaaataccaagtcaatttttttaaattttaactactgatagcaaaaaatttaaaaaatcaatcatgtaatttgatgtactagttttatcattaaacaaactatcataacatatcatttaactatttttattaaaacatcttacttttgctgatattattggtcaaagtagtatctcgaaaaccgtcttgaagtctaaaaatacttatattttgggacggaggaagtactttagtttctaactagaatcaccaaattcagtcctagacttataatttactacctccgtcccaaaatatagcaacgtctagatacattgtcttaggatggatcttattccatactagactgctatattctgagacggagggagtatgtttttctccgccgctgcacactgggaagtaatcatgtggtagatcatcggttgatcctcctcaaaccgtacattctagagaacgtctcgaatatgtgaaagcaagaactgtcatcctcctctttgattggtcactcacggcaggtcaattcaatcatctttcgttcggaattcggaattgatcccgtactccctccgttccaaaaaaaaaacttaatctagtacacgttccaaccaatactagattaagtttttttttggacggagagagtatgcaactcttatcaaaaatatatactctaaacagcaaatttcagaatggcaaccaaatgaacagcaaaattttagcaaacattgtttcttttcttgaggaatattgtaatcacatatttgtagtcgaataaagtactagcagtgttcaccctcaaaattttagcaaattactacaagtctgaaaaaaaaatatcaatttttcacacttcttatgtttgttgagaaattagcaacattttcccttttcttctgtgcctgctgatcaataagcaatgctaagctggcttcttcacacttcactcatacagcaacatgtttcttttcttttgtattctttttcttgctgctcctcggttacttcaaaaaaatagcacccctgcaacaaaagaagtaaaaaaaggaaaagcaccacgcagagacacacacaaacacaagccgaccatacttctcccagttagctttagtttccctgcttctctcatttcctgctcctcttttgctttcccctatcgcttcagatgattcatgcgtcataccatgcagtgcagatttttttttctcttttttttttgttgaggaatttcacttttgatgaatagtaacatttgatgcagtgaaattgcaaaacaacaatgaattgttcacacacacacacacacgaactgagttgaatatacatcatcgaacagcttgtcaggttggccgctctgaagtctgaacctatactgacaataagaacagaagggactcttggcaagagaatgatggccaattcggcatctctggcttcttaattacacacaagaaaaaagggaaagaaagaaagaaaaaagaggaatcaccatagattcaaatcaaatcatggaagaatatgcgaaagattggtcaaaaaaatggcagatttcttgagagggaagattgcaacttttgtacatacccccactaccaaaatcctcttcagtaaaggagaagctagctacctctttgcacaaagccaatgatcctccatcttatgcattgccggtagagctggctagtgcacatcatatagctccttcagtctcatccagatgctcactggaagaagggctttcttcttcttctccggctagtctctccgccgcggcgcaaccgtcgtcttcccggcacgcctgaaaagccacatttctgtcagccatggagctttggtaaccaacctagcagaaggtgagttgaaagcttttcatgtaagtttgaacctaatgtgcttaatatttgaaaattttaattgttgatgttcagaaccatggccctcttacttactgacctgtgagacccactgacaaatgctgatatgctgttcttttgttttgttatatatgtggtgacaatagtactgtgttgccaatcatttgtctgagatgcttatcttagttggtttcagataaactaaacaaaagcagggagcagagatgatgaggacatattgttccagtagtggaagcttagatgcctcaaatactaataacataaatgggctgctattgattatgtgtaaataaataaatcatcaccctacttgctaaaactaatatttgttatttattataggtgtaaatcattttgtgttttactttgatttcttatgcattttgttagtttgtttctgaacaaacatatgcaatgtacattgcatgcctgaactgacaacgagcagagcagagtagtcgtcagacagcatgagcagagtatcaaggaatgttcatgcatggcacagtcgtccattccaagccattttggtccatgtttctactcgaatttagtactcgaaatgccataaaatttctgaagaaaaaagaaaatgcagggtatgagtcgtatgactgaacagcaatgcatgcatgatgcatcaacgaacctgttgtgaatagggtcaggccccttggggatcctcctcttgctgcctctgaactcgtctgcaccggccgagtacctcgccggcgaccccgccgtcaactccgtccacctcccgccgccgccgccgccagcggccgcagcactcgtacccttcacagcatccatcgtcgttgtcgtcgccaccaagacgcagacgcagaagaagaagaagaagaagaagaagacaagaactatcctgcagcacgccattgcccttagcaacctctctgaccgccgcctgattcccatatagaaacaagaggagacaagacccttcttcttcttcttcttatcgacttatctcaattctctcctcgatctcaaggaagaaggaatggcatgtcgtgtcgttgagctgtaggagaagcagagagccaagagccaagccaaggtgtatgaagctaccagacagtgttcagagaagagaagagaagttcagagagaggatgtatgatgatgatgacaacgacaatgacaacaacactgacaaatgccaaggaatgtaaggaagcatgacacgatcttaattaggagaggagtacagtgcaacactgataaattgctcagctaatgcggcttttcatgggggtggatttgaggtgatgggaatctgtgattcttatcccctctcctgctgcaacgcatggatggatgcttgcttcggtttttcttcgcttctttcttttttttctctcttctcattcgctttgcgtctctttgcgtgatatgctttgctttgggtggtgatggttgctttctttctctcgctgctgctgctgctgctgctgctgctcgcgtcttccccagctagctatagctttgctctttgttctttgcctttgcgagagagggggttcaaagcaaatctgccgcgcttttgtaggaccaagcatgggggatagtgagctgagcaacgtgagttgagtgagtgtttgaatctcctgaagatgaagataaagatgaagattaagattaagattaagtgttttacgcaaaacaaggtgataataacgtgtgattaattgagtttcaattattacaaacttgaaaaatggattagtatagaaagttttcgcacgaaacgcaccgtttagcagtttgaaaagcgtgccacgagtatccaaaatttaatcttgcttgcagaagaaacgaacagggctgagtgttgcttcagttttgagctctcctctctttggaactttgtgggtcctctctccatctttttgcattgctagcttcttcttcttcttccggcctcctttcacactctctgcccacacacccacggaatctctcctaagcttcttgatttcctttcttttctttgtttctttctttctagttcgagattttttcttgagcaattttacggtccttgaggaggtactatgaggtaccactttttctattgtaaatttaatatctcttagtacctaggtactatgaggtaccaaattttacactaaatttttggtacctcatggtacctcgtaaaggaccgtagaattgctcttttttctttatacggacggactttgtttatggatggttcttgcttgtggccatggatcccacatgtcgtggtttcttggtgccatcggcttggatgtgcgtcgatattcgtgcgcaatttcgaatgaggtcattaattgatactccctccatcccataatacgagataattttagagggatatgacacatgacaatactcggtagaatatatcgcatcccttcaaaatctcttatatatgggacgtagagagtagattattgttgtctatataatcttctctttcatctttctcttcccttcccttccaccataaaattctactagtatatatgacacctgctcttagatgtaacattacaatattattgatgccctgatatggtaggattaaaatggccgaaaatgatattatttttacggaaatggtatagctaggattatttttatatttttaaatgtaactcgatattttttttcttttttattaatgtaggattttcaacttttgataggacgttgtggctaccttttctattaatttaagataatgatgtatagataaattttgattgtgcctcccaactcatcatgtgctagttcttacaaccggatatattacccatataaaatgccggaaatttggccatgttgttttctatctctaaataaattaacagagttgttgtaggatccatgttctatctgaaaaatataatatgaagtattcctacgacctctcacaaaacacgcgaacgggtccttgtaaaatttgagcataatttatttaaggggcaagtgagactaacatcaattttgtcagtgacccactaactgcagaacacaagacaaggacaaggagcacaagctctgtagaggaacactaaaaaaacgagatttctccaaacatttttttctaaattgtgagtatgttgagaattgaacacggtatttttgaggttgaaaccacacgctccatatcactgtactaaggatatctctgaaagggaaacacttaaaaaaaataagcattaatatggcccatatatatgaagtgtccaaagaaggaagaacaaagcagttagcagataacaggtaggcccaagtacatgagttcaaaacaaggtattgtccaaaatttgaaggaataattgtacttgcacacaatcatttcgcttcttccgctcacttttactttcttttttttattcccctttcgacagtcacctctttggcttactgacaaaggatcgaattatgagagagattatgccaaattaagaataaatgcctttttaatccaaaactggtagaaaagagattgcccacttcactggcattttgtccttaaatggctcatcaaccaaaccaaatcaataaagtacaagaacattcaattgacagagcttgagaggttgtaaaaaaacaattcatttcaagtcactcagcttgtaacagtcctcatcaaatcaacctttcttacgacataaagactctcattgccaaaaattccttccaactattgtatatgagttagacaaagttctaaactaactattatctctgttctcaaattaattatgttttgcatatttgtaataaaaaattaataagatttattatggaaaactggcataaaaaaatttccatggaaaatactactatacgttacattgattaaaaaattgttacagtcaaagatgaagatgcaggaacgtggaagtaaataaaacaaaaaagttagaatcacggccaatctattccggcctcatctttttcgcttatgcttatactctctccgtacttataaaggaagtcgtttaggacaatgtttaagtcaaaccttgggaatataaatcatgaataactctcaagttattgagtttgaaaatgtaaaaattatatgaatagattggtcttgaaaaatattttcataaaagtatacacacatcactttttaataaatatttttatataaataagaagtcaaaattatgttttggagaccgtgtcgctgtcctaaacgatttcctttacgagtacggagggagtacttatcagacaaaatttaaattttcaaccttaaatttggagttgtttttgactttttcatcgaagtttatttttcagcctttgtttttagaacgctaagaacatgtgtataaaagttttattcacaaattacttttcgtttgtaaatatgccgtttgacttattccacaaataagcgaaacgatgaagccgttcatatcttttacacttttactgagattttgagattttgtgtgatcacatagatgagcgtgcgtatgtatgaacaccagtatttgtacagtattcaaaataaacctacatcaaaacactttatatatagtgcatttaagcatgcatccacccactttaattagcctttagctaagccatcaaacgtgcaggttggcagcagagagggcttttttatttttttctcttgctccgagagatttttccgaaagagcccctgcactttcctcctttcccagacgacgacggaaagtccccagtcaaatacggccgtctttagcttcactcaactcgatcgctacctcgtgtaatctactcattgctaccattcatccatgtttttttgttgagatagatttagagatcctttagtaaaaagagcgtatatcctgcaggcagatgcatgtgatccatctatacgaatcaggtgtctttttttttctttcaatctacgtactttgagatgaagacgatgatgatgatgaatgaatgaatctagcctggttattccaatcttttgttaaaagagtagatggccgtatatacccttgatctggcatctctgcacgtatgtgtacctcgatccgggagcgtatagatgctctgtaaaaacatgcccttttttcttgatgcaaagtttatgacagattatgggatggaattaattaatttctttgaagtatatgagagcaaattttatagaagattaggtggtcgtcgcctctaattttatccatctaaacttgtgcattaatacattatctctaaattagctctaccacgccaatctcaatagtttattttatttgtttgcctaattcactcttcatttttctccttttttttcgagtttgtgcagaggcttgcattctctttttttttctctccttcactttattatattagtttatgtgatattttagggcaagtgtacagtaggttatacacttgtggtacttgctctgagattcgccgtttgatcttcggcacaacttcttcaaagtgcaaagcattgttgaacgatgtgcgtttgcgtgattggttggttaggaattttgtgtcgtgtctcaaagtgagagacgaatgatcaggtcacaggctcaagcacagtagtccaccttggtgtcttcgcatccggtttttgtaccgtccatccaatttgcttcagcctgattcatagtagtactcctaaccaaaacccagctacttatgctatactgatcagtgattggattaagttatcaccgagtggagaacattgtagcacaatacaaaattacagttaatactgctagtgcatgttcagatttatagtcaagaccccttacatttaaggacaaagggagtagtaatgtgatggaatcaaaccactctatagaaatgtttatgaaaaaatctgtatatatttagatgagatcgcattgacagaagatttatcctactcaaacgagcatatgaagatggcaactataaatctggaaaaaaaaattgaaagattgttataaaattattataagagttcaagattagagaaatgaaacaaactaatctcctgaaacagattttctatggatattaaggagagttgaaattcaatgaaagact

SEQ ID NO: 60678 - DNA, 1761 bp, Oryza sativa
tcgcttatcatgggtgcaaattgctaggactcataaccttcctgacgagcaactattttctagtggatggatatgtgtgccgccaactgttctatgagaagccaattctcgttatcgaagccatggtcggctagaaatgctctaccttagcggcaaaggcaattgtttccaatgaaggtgactagctgctgagaggaaattgcagatgaaacaacaaaggacaaggggatactcgcaaaggagacatgatgtctatgaccaaatccgaccctagcctgcacgaaggagggagacaaggtagggggagatagggaagagaacgaatgtcggacgagataaatgatgataggagataatgatgtggagcacagagccgtagaccggctagaactcatcgggtgtcatcggcaagctacgtcgcctaagcaccttcaagccctctcctagcaccagttttaaggtccaggtgatagcaaatgtgaaaaaatgttaaggcaaggaagaaagagaaagggagaaagaggactaagaagatggatagagaggaccttacaggaggtggggctgccgtcagctatggcaaagggtaggtattagggttaagactcaggagggtcctcgcttctcaggtcattcggaggagcaagataccatgaacaattgctatgattggttgatataaataaatatgcaaaatctaaatcgagagcactctcgatttagtcataacgagcgacccccatcagcattatctagatatgtgttaacttaaagaatcttactttactatagtactaatccattaagtaagtagggaaaatattcctatcatctatgcttcaaataaattttctcttaaattactcatccgatttacaatccaattacaccgttgtgttcgtaacaattaaatctttacaacaagatcttacatgattatattttgataaaaaatcacaaattacttttatgatatgtctaaattacttttagacttcactaagttacttcttaaacatataaaagtaaattcagtaaaatctaaaagtaatttacatatattatagaagtaacttagaacaaaaaaaagtaactttggcatgtcatttgaaataaatccgttgtagagataaaaatatgactctatctagaaattaatttaatcagcacaaattatgaaattaagtaaaaacaataataaaaataatcacctcagagcattatgaatgtataggaagtattttaataaaatctaaaagtaacttttatatatatatatatatatgataattcgtttaatgaaaaagacattaattaaagttaccttcgttttgttctaagttacttatataatatatgtaaattatttttactctttattgaatttacttttatatgtctaataagtaatttagtgaaatctaaaagtaatttagatatattataaagtaaattattatttttcataaaaatataatcatgtgagatcttgttataaagatttaattgttacgaacacaacggcgtaatcggatcgtagatcagataagtagtttaagagaaaattgtattcgaagtatatgtagatagtgtctctcatggatggagtggtagctaccgccagtgtgtagtcatgtccaaataaatatggtaaaccgtgaaaatttactataatataaaatcttaaatgttagaattaccaaagttttacaaaagaaagcaatattacctctaaactaatgcacgtcaagggctgcagga

SEQ ID NO: 60679 - DNA, 3273 bp, Oryza sativa
aaaaagttcataaaacttgcacctctggaggagtgcaagaccaggactaactccatgtctctgttgccgggggggaggtcgaggcgaccgggaacagccccggcggcggcgcggcgcacctcctgcggcagacgacgaagtcctcccggcgcgcctcctcctccagccgccggcgcagcgccgcgaggctctgctccttgaacgtgaagtacctccacgtcccctggtcgaagtcgtccacgcggccgtcgtctctcgccgtgttgtagaagatcgtccgcgccaccagcgcgcccggcgccgcctcgctcggcggctcctcctcctcctccccctcctccggcggcggcggcggcttcaccaccttcaattcctagagaaagagagatcccatttgcaattcaattattcaagaattcaagattatgcacatctcagcttaagaattcaagatggaagaaagccaagcaccttggcggaatagaatctgacgaaagcagtagtgaacgccgtgtcgggctccgacgtggcggcctcgaggcgggcgtcgcaggacagggcgcggcagcgcggcggcggcgcctccgattccgggacgacctcgacgacccaggagctctcctcgggggcggcgtcgcggtcgacggtgacggcgttctcccgcggcgtgagcccgaacctggcgcggaggaggcggccgtagagccccgtgagcgtgaggtgttccccctcgcggcgcggcgtccacaggaaggcgccgtcgttggggctgggcggcgagcccgcctggatgacccagcagcacgccgcggagccgcggcagccgccgtcgagcgcggcggggagctcggtggcgcagaggtagaggccccggtgtccctgcagcctgacgtagtcgtcgccggaggtctccacggcccagacggtgccccggcagttgcggcggtagccgtgggtgacggcctccccgccgccgccgccgccgtcgtccgccgcgcagaggtacgtgcccaggtggctcctgagccgcaccgacctcgcgttctcgaagacctccattgctgccgcggggccaagaaaccaagaaccgcttcttgatttggagagacgggtttgggcgggaggaggaagacgaggctagttgggggggtattattgtccttggcaattccaaccttaacggcttccgattgtggtaaaccgactacgtggcactttatggggcgttgggatctaggatcaacggctcagattcggcacaatttaggtatctcacgcttcagtgcttcaccgccatcatcatttatcagcaagtacatgagaccatttcctgttacttgtgactgcacgctaaggttttgttcggtttggaaggggttaaaggggattgaaggggtttaagggaaaataattccacaccacaatagatgtggaataaatcccctacaatccctctctcttgggattaaccgaatatagcctaaggaggattactcgtgccactttgttttcgaactctccattcctacatttcaggggaaatttgccaaatacttcgatattaaatttatttatttatagtaagtactcaaagtgctcaatttctcttcgtgtttggggtgtattttaggcccatttatagcagtggagtaagttccactttaactccctcaaatatacatctaatctaattcatatccatcaatagtaatactagatatcttgaactcctaacaaataaaatcggtacaaaatgatttcctcggtggttttaagggtggtttccactagcgtggctcgtttactagtccaaacatcgagtcagcatgtgatgcccgtcaatgggctgtaaccaaataggatatttgtagagtatgagaatcattggtgccagggtatacgcgagtttgaggtaaaagagataggaggcatggatttttatacatgttcaacctccttacctgatagacaatagccctactcccgttggctaaatctagtgttttatatatcagtaccatatatagtacaatatctgggatgacctaatctagtcgctgctgacctaaatagtccttgtagcatccgagtagaactatatttctcctttcttatccggaatatcttccgtatacgaggcatgattccgtataagactataatagttggtgtatggtgagcctcactttgcttaatacaaaagtattgggtatgccttatctataacactgacaacgcccacctgtcatcatctctctcttattcccttcctcctccctctctctctcccattccctttctccttctcgacagtggcggtaggatgagaggagcgccagaggagttgttttacaccagttttaatagttagagaatgtcaagatacccggttttatgaatcagattcgacctatacattaagggactcatagtggaccttttcctctagcaagcttccttccagcacttgatcggcccaacccaatcacacgtgggccccacccccgcagctgcccttgcgccgcttaccagtcccactcattcacatccctacccaaactgtaattacagacaactcgaggggggcatctgcaaaataccactactctccgtctcctccttggtccaagggttaaaaatccctcgtcctcgaggtagtcgcgacctctctctcctccgtctctccattccccactcgctctcgcctctcccccctcctccccaccatggcggtgaaggggaagggcaaggcggtggcctccgcgtccgcatccggcggcggggtcaagcggcggaagggccccggcgacgcggcggggccctcttcctcctcctcggcggccgcggaggccgccaagcgccgccgccggtctggggtcctccagttcttcgacgacgccgccttcgtcggggacgaggaggaggatgaggatgaggaggaggaggaggaggaggagatgttcgcgtccgacggcgacgacgacggtacggatcgcctcccggttccctggacgacgacgagttggggctgctctcgcgggcgggttgggttggtttggggtttggggggtatatgagcaatgcggcttctattgggtcagtcgcttgttggggatttgatttactacatgtgttgttgtattggttggttggatttgtggtgcttgggggtttcagtgctgtgtcccaaaatctcgcatgttgaaactagggtttggatgagcacttaagaggttgagaggtgttgatgcatatggaagtgtttgggtgagg

SEQ ID NO: 60680 - DNA, 3210 bp, Oryza sativa
gttttgaatggagacacagcttacaggtttcttagtaagtggctcggtgagtgagccactttctctggagcgattcgatggtcagtggtagagtagagtctgggaggacttcgtcctgttgcttctcctttcgtttgaatccatcttgttagaagtttttgttggccttagaccagacagaatattgggcaaaaaacaatttgtttgtgcctgtgaacttgccattgttctactgtaagagcaaatgttttttttttatctgaaggattaaagaaccaaggaatctataatgtccacaattgttttcattttttgccattttggtgcatggtgaggtaagttaatgcttcccttttctgttctttttttttccttcaatcattggtatggtgctgcattttcatacttaggatgacagtgtcaatctttaattttttaccatttgatcttttgcctatgttaggactgattattctggctacttggctagaagatattgctgtattttacacttaatgttcatagtaattaccaggacgatgcatgttattgcacttgaaatggcactagtgagcaatttatcctgcagcttttggccattggcatcttaaaatgttattattgcctgattattctttgaatcttctgttgatgcaatcttgttcattaactgcaggtttcttcaccgagggaaaggcagaaaatgttaacttaaaaagaactgaaaggtccaccctcttccgtttcttgggatagttaaggaagaggagctgagtggtgatgaacttgaagaatttatcaaggatcgttattcaagtcgagtgaaacacaccccttttgatggctccaccaatgtacaggatgacgagtttaccgaggatggtctattgaaagagccagtaatttggaggatcaaatgcatggtttgtgatttactagtctttgaccttacattgttaatctagtatttggctgcaaggttctgatttgtttggctgcatttcaggttgggcgtgagcgccaaattgctttctgcctcatgcaaaagtatgttgatctgcaaaagtttggtaccaaagttccaattatctcagcatttgcacttgatcatgtgagaggatttgtttttgttgaagctgagaaggcctgtgatgttacagaggtacatgatttgtggcttccattgtaaaaagatacccacattgaggagagcaagtcaaatacagtagatgtaatcatttattcattgcattatgtggtttgatatcatgctctgtgaagggttgagaacttattcttttatctgctactcctacttaaattagcactgtcttctttttgccatttctcacacacttcaattcaattcactcttttgtgtaacataataatttgaggtttggaactgaaataggctttacatgtgtagttctgttactaaaatcatagtttctatgataatctaggaaaaagttgtttgctcaaagatttcttcctgtcctgcttgtaatctgacctactgaacatttgcatttcttactacaggcatgcaaaggattttgcagtgtttacataagcagaattaattctgttcctgtagctgaagttcctagcttgctatcaagccgcgcaaaaccatttgcaatatctccaggtacatgggtgcgcatgaagactggaatttataaaggagatctagcacaggtatgtttaactcagcttcttacttttctgggcccccaacccttttacatatcgtcacatttttttgttcttacatcactacacccctgtgaatttgtaggttgttagtgcagatgaggggcgaaaacgggtgatgatcaagcttatacccagagttgatctccgggctatttcaaaaaaaattgtaattctcttatgccctctttctgtattatatttatttttggcagtaaatgatgcctctcatttttagttggtttcatttaagttgtactgacttatctatatcaatgtataataccccaagtagctttgtgaaagtcttgtgaaactctaactaagctaattacattatatattgcctgtacctgttgaaattcttacatttccaatgatgggtatgtacctcgtcctttttccccctggtggtggggtggttaggttggagcttcatctttgtcagagaaacttcacatgtcattgttgttttttggtacactggataatgtgacattccagtgaaaccatgtggtgtctattgcgtatttccattttgctcaactgtagtatcatggcttgggtggcttatattatactgttgtttttatctttgattgtactattgtcttgttcatctgtttttcttgttaacaaccatttctttttatttttttcttccattggtcttgtccttctaatagtttgagtttgctaccacattatttatattagccttcaccttgcagggtggtgctattccactaaaagaagctgcaattcctgctccacgtctaatcagttcacaagaattagagtaaatacttcctttctgtttccagtgtctctcttcatgcactcagtatccttctcatatcatttgtttctacctaggcttttgacactgttgccacgatctcattgatattaggttcttcggatctcatattgaaaggaaacatgatcgccagacaaatgatttttatgaagtgcttgatggtctcatgttcaaagatggtttcctgtataaaagggttgcacttagttctttgatttactgggggatacaaccaacagaaactgaacttctcaagttctcttccactccaactattacaagttcaactgatgacttggattgggtctccagcatgtatggtcctaagaaaagaaacgttccaaaagaaccggatatggagccttcctcttcgaaagcttcatcttctaaaggaaaatactccaaggcatcttctaaggcatccacttctactgaagattacgaggataaaggatttaatctccatgatcttgtactctttgggtcagtctctgttatgcaatccttactaattgtcacaaaagtttagcagatgtcatccttatttttgtttcatataaacaggcgaagagattttggtgtggtcattgcttttgagaaaaaaggtcttagggtaagattttttatagcacactattgtaccacatccatgatttttgtctgagaatata

SEQ ID NO: 60681 - DNA, 3716 bp, Oryza sativa
  unsure (1)..(3716): unsure at all n locations
ttccctttagcaagaattggtgtaaagttctttttgcccgtaatccgggaaaatatgcatcttttttcgttcttttcaagaaaacattcacctgaaagaattctaaaggcaaaattggttccattccacttgaaaggtcactagtttagatatataccattgaaagattgtggtgcactttaataccatcgaaaggtacatctgttttaatttttctttttaccattccatcctttgccagtttggttttttgctatttttccttttatttccacaccaaaagggtgtgcgtcagtacatgtttgccctctactgcagtgctgtttggtttcagccaagcacgaagcagtttaatcaaccaagcaaactgacccccaaattcatgagaaaaccatccatgcctacctcagtaaccttgctagttgatatacctccatcccaacaaaatcccctgctctatgccctctgttgcaccatcctttgatatcaatcaaacacagcagcacacagaagtgacaagtggtgactggtgaggtggtggggccatgtgtggaggttgttgtttacgaggatgagtagctggacacctcatccttgctgggaagcgagacggtgccatggggaagcagccagggatggctttggagaatcttcacaggagcaaaagggatgtgagaagaggattgagggagagatggggtgatggaatggaaattgaagtgagcagagtgccaaaatcgtcaacagtaacagttttaaggacagggcatgatggagaagtaagaaaactgaagatcttaaagtgtgcccatgaacttcgatggtatagacctaaaacagtgatatttcaatgccacgaaaccaatatttccaattctaaccccggtcaaaaaaaatatttccaattctaacataccaaatactaacatacctgatatggttattgtcttctctcaacttctggtaaagtcgtaatttaccatattttaggaaatattttggactccctcttcttattaactgttagttagaacatcaacatagtttgtgtatgcacttgttttatcattacattttctaatcacatactatatttatgaaaaatacttaactacatccaagaatatttcatgacaaatatactaatatcatttttacatattatctattaattttggtatatatttgtgatttaagatttcttggtttgactgcacgcatcttaaaatgacgtctatctgtgaactgagggtgccttttaaaatgaatgtaacgcattattctcataataaaatgatttacagcactagtctatgcttctacatttctttaattatgagaatttgattcctcccatttggcacccttactgattcatttaatatttttacagggtaagcaaggagttgttaaacacttgtacatgggcatactgtttatccataatgaaagtgaaagtgagaacagcggatttttctgcgcccagtgcagttcatgtgaaaatgtcaagaagcggaaggaactggcaagtttcacttttggaaattcggtatgtagaattgcagatacaatgcatgcactgttctacttcctctattccatattgtaagacggtttaattttgtcctaagtcaaacttctctaacttcgaccaagtttattgtaaaatgtaccatatctacaacatcaaattagtttcattaaatccaccataaaatgtcttgattgtgtatttatttggtactataggtaattatttttctataaacttggtcaaagctaaaatttgacttataggacataactaagataccttacaatatggaacggagggagtacttactaaagaaggtttgatattttctgtgacactttgtttttgatgtaccaggacgataatcctattcccatgttttcatatgaacaaaatgagcaacgggacagtaagtgttcctggagattgatgattttgtcagcataaaatagtttttttccctgattcccttgatcctacagatgaaaggccttacaggagcactagagaacaacttttctcaattggggagatgctgcgtattcgaaagggtcctatgaagggctatctctgtcgagtagttcgaatatttcgcaatgatgtaactgttaagctagattcactgctgaagattgtcacaggttggttacttgagtatccttgcagctgttttttgacagtgattgactacttctgtgtaatgtttgcagtgcaagctgagtttctttcagtcccagctaaaagagggtaagcagcttaccatgcttctcttctcttttcattttggggcctgctttagtaacgctgatttttgtaaccatcatattgttgcttaatgccacttacatctgtgcaccttattgcattaccagggataactcttctggtgctccatctggtccttttggtaagtgcaagtttcatgcacactgcaactattgccaatntactcgctgctggcttgctgccatggagtttgttacctatgctgattgtaatgtaggttcagaagccgataaaccctcatgggacaatggattaccatcttttggaaggttctttcttgctttccagcttcctactttgtgaatgttttaataaattgttggacttcagatttcctaatcaaccacctttatccgaccccttcccaccaatcaaaatgaacctatgcggttgacttggtgtatatcattggttggttaaataaaaatcctcgactgttatttatatttgcactattcactgaattgttcaatcttgtgcagtgattcctggcaacccttttcaagtgctgcattaccagttcagaatgcaggtatattcagtcgtaggcctttctatttggtggtatagtttggctttgttaatttttagtattgtgaagtcatgatgttgcaacatttaacctgttcaaaattgcttgctcaagtataactaggggtggaaacgagcctggctcggctcggcttgcaatggctcgcaacaagctagggttggcttggctcggctcggttagagaaatgagctaaaacatgagctcggctcggctcgtttcctggctcgagccagctcgagctggcttgcgagccttccgttgaagctatataatttgtaatcattaagaaaagcaataacaaatcatcaacatgtaaaattaaaataactttatatattcaattcatcaaaatctagacgataaattacatattgacaaataataactccactaaaaaataaagtcatccatacaaatacatgatggcttaggctcgcgagccaaatcaggcggctcgcgagctagctcgggctcggctcgtttcagaaacgagctgaaaatgaggcttgggcttggctcgtttggcattcaagccgagccgagctaagcgagctcgagccaagcctgagctgagctcacgagcccaagctttttttccacccctaagtataacacactcaaccagttatccattccatgtctcatagaagtccttgaatttttgtaagaataggcgcaacaggggatcaagtgggctctctaggattggtagagcagataactcaaatccgtttaatttggtgtgggggtgaagtcacaggtggaatggttttttattgggttaatgggacaactttttctacaaaattgacaagtcttaaacgtgaacagaaaggggtgcag

SEQ ID NO: 60682 - DNA, 2518 bp, Oryza sativa
gatccatggtgtaagaaaacttcatcttctgccaatgattctgatccatggggtacgaaaacaaaatctgcatctgttgatgtatggaacaccagtaccacacaagtagagaactccagtgacaatgcatgggataaacaacctggaggtagtggacctaatattggtggaagctcttgggacagaccagcaactgataaggaaagtgaaaaaagtgacaactggggtgaggcatgcaaggagacagagaaaactggtagtgatacagatccctggggaagcaaggtcaaagagatagatctgaaagaaacggatagctggggaaaggcttcaatgcaaccagagaagaagttggaggatgatagtcaaggatggggccaacctgttggcaagtcaaaccaagaccaagaaaaaggtgcagacaaatgtggggcttgggatactgttattgctgggtcatcttcgtctgttcctggcagaggggatgatgactcctggattaaaactgatactttgcctgttgctcaagatgatgcctggggcaactcaaaagattgtagtgatggggcagctgggtggaatgaaactagaacatctaaacaaagccacagcactggaggatgggatgctgctgctgccaacctgaatgaatcatctgatgtggatgcacataaggactcatggggcaaagcaaaagatacaacagctaatgctgaagaaaaaaataatgaaagtggaaactggaacaaagctggaccactagacaaagtttgtggcagtgattggggtagtccaaagttttccagtggtgatggtccatccagctggaacaagggagacaaaattggaggagattctcaaaacggcagctggagcagacctggtggaaactttgaaggtggtcgtgggtttgggcgaggacggggcagaggcaggggccgagaatctggggatttcggtggcagaaatgaccaaggaagctggaagaactcagggactagtgacagttctggaaggccctcttggaggtctgatagtcaagttgagaaggaagtgggagattctggtggatatcgggggagaggaagaggaagaggccagtatggaggacagggaagaggagacaatggttggagaaatggaggtcaaagcaattttgagtttggaaggagtgatgctgatgcaccaaactggggaaataaaggtgtatccaataaaggttcttgggatagtggtgacaattggaatgccccaaagtcatctgatgaaaatcaaacttccgcttggaacagttcagaagataaaaggccatctggaggtgagcggtctgtttgaaattgataccttgtattagatttgcatggtcaatatacttttgtctacatgtgcatgtgttttcttctttatgttttggatcccatatttatttgaatagtgctattgagatttgaataaacttttttttaacttcaacaggagcatgctacttgaatttcttgctttgattgctattgtggttacttaggtttagtaatatggtttctacttagatttaaacttgataatgctctttttgggtattggtaaacaaaatgatccttaggtttagcaagatggtgctactctgggtgctggagggtatcaaaactatttgctcgaagttttatcaatacaagctaatgcacgcgctttgctacgggtaaaggaaaaaaatatcataatattgtctaaaattgataaaatcatacttcccatgtgatagggaagactcaccttaatttaattttatatgttgctatccatttagacttagtagttatgtaatattaagaagttcaaaatatgtaaaaaaaactgcaatgagagtaggtagggtggctgattcactgcaaccaccatgaaattctttttaaaggagtatagatgttgaagggctttatttctgttctgttgcataggtcataggtgaacaaagtgattgttgataagttctaaaggtgaagataattaaatttagccatatctattattctacttgatgttttaagctatagttgtgcgctgacttgtatatcttgtaggccaagagcaacaaagtggtgcttgggctagcaagatgacttctactgctggcgctgaggataaaagtgatgcctggggcaccaaggcggaaggcaattctggtagcactgggggaaagtgggagaatgcttcatctggtaattctgatgccaagtaaatttcttgttctgttcaatggtggatatactacagagcttatggtttcctatcatgttcaggggaagagcagcaaagcgacccttggggaagcaagatctgttctaatgaaggtgcttagaggatattaaattgtctctctttgttgtatgcttgatttttgagctaaataattgattttgtccatgtatttacatgttgccttgcaatgcttatattatactactaacttgtaggcaaagaacaagaaactgacccttggacaagcaaggtgacatcc

SEQ ID NO: 60683 - DNA, 1185 bp, Oryza sativa
gaaggtcgcgtcctaaaacctcatctatttaagcacacagagggaatgaacccttgtgatctttgtcaacgccatttatatatttattttccagatggattgcaaactgtattgactattgagcaagcaacaacttagccacctcgttgacaaagggtagttaaggagtactccctccgttacaaaatataaggcacaaccactcttaacccaaagatcaagaaataattattattatctcatagtttggatcaccttaataaatataatgcatgcatccaatagaattagagatcttgagggtggaggacttaaaaaagcaataatctaatggagaagaggtcctaattaattgtgtgcatgtatacatgccttatattatggaacataaaaaaaagtagttgtgccttatattatggaatggaggaagtactaatttaagtattaaacaatgggttatttttcatctgtcatgtcttacggttataaatagctagaaggtcctctctacttgtgctgtgtctttgtttttctttcacatttctagcaggcagagagagcatcatggagctcaaacttgtattcccattgccttcctcttctgtctctctcgtgtgagctctacctcgcagtttttcacctcgatgttttctcttggagactcgtacatcgacaccggcaacttcgtcatcatggccagtccggttgtgcccgtgtggaatgacaagcttccttacggcatgaccttctttgaccatcctacagccgcatgagtgatgggagagtcatcatcgatttcattggtaagttaagcaacaccctaaataggtattcccttcgtcccaaaataaaccaatctcgtactaggatgtgatacattctagtacaacgaatctggtattttaccgtgagaattaaaaaataggatttccactatgaacttgcatgatcagtttggtactatagttctaactttgtgttgacatggtttctagccgaggaatttgggctcctttccttccagcctccctggcgaatagctcaagtgtctcccatggcgtaaacttcgcagtcggcggcgcgccggcgactggcgttgaatacttcgagaataacaatattgtgccgtttaagcttctgaacaattctttggacgtgcagttgggttggtttgaggagctcaag

SEQ ID NO: 60684 - DNA, 4367 bp, Oryza sativa
gtcctccagaatcccagccatttcggtatgtaatgttattggcttattgagttatctgcactaactagtttataatttttattttattttttccacacaatcttacggtgtggaaatacttcccatcataacttgtgaattattaaattatttgcgcgttggtatcgaatataactattatgctactctctctgtcccaaagtatattaagttttagcctttagcacaggtattaagaagagggtacaaaagacctagttgacttcttgggataagtgaaatatactccctccataaaaaaattattggattatttttagggatagagggagtaggatcggactagttatgggttataataaagtcaagggcagagataatacaggtagtttagtggtaaagtcatattttatactgtaagcattatgtttctatattttatgatggagaaatagtatattcggaaacactacatataaattgttacattttgaacggagggagcattgctcaataacacagtgacttttgtctgacatttgctgtacttatgcaggagtcgccgccgatggcgttctcaaggcttgctgcggcaccggcggcgcctacaactggaacgccagtgccatctgcgccatgcccggagtggtcgcctgtcaggatccatctgccgccgtctcctgggacggtgtccactacacggaggccatcaacagctacatcgcccaggggtggctccatggcccttacgctgatcccccaattttggctgctatcccccactgatttgctgaaaggattgatcaaaaccatggaagaataataatccaggcagattgtgtggcaagtctgtataccgtgtgcaatcgatcgatctgtggtttgacaattgacattcagattatgctcaagaaataaataagtgtaatacagtgtgtgcacaccacagtttgtaaaagagaagaaaatcattttctaattaaccatcctggttctgagtgctatcctgatcctctgttggaaccttaactgattgtgagaggatgtatttccatgctaaactgtctcactgttactagtagattttaactctttcgtgtgatttgtcaacttggaattccaagaagctatctgtagttctgtacaacctgataattaacaagaaagttgtttcaataaattgttgtcatctatatagaaccatcaagcagtaatcttcacgtgttactatcattaaggatcaactcgtagtacggtttttttctttctaaagagccgtctatcaaattgcgaaaccagataaaacgtgtaagctttgatatccacggcgccccccgtgggcggccatggtggatttcggactaaatattgacttagactgcaagttgtaatcgttatcacatttcttatgtcctgcaatcataaccttaacctttctcaacctttatgctctttatcaatacagatctacattttcaaacctttgactgcaagctctaccgaacaagcaactgcttatctcactttttggcacatatttaaagttttaaacaatctactattttacacttcatctgatcataaatatttcacataatggactttgaaatgaaatttaccattcatattattcaaatttagtgtaaatttttttaaaaaatataagtcatgttttaaatacctttgataataaaacaagttaaatacctttgataataaaacaagtcataataaaataaatagtaattaaaattctttaaaaaaagacatatagtcagaagtcatttccaaagtcacctgcaacaaaaacttatgaccggagggagtagtattgaattgtacctccatataacccaagcagttagctagcactcagctctgctcttcacatttctagtaggttaggtagcatcatggagctcaaacttgtattttctatcaccttcctctactgtctctctggtgtgagctcaacctcacactatttcacctcgatgttttcctttggaaactcctacatcgacaccggtaacttcgttatcatggcaactccggttatgcccgtgtggatcgacaagcctccttacggcatgacattctttggccaccccacgggccgtgtctgcaatgggagagtcatcgtcgatttcatcggtaagttcagcaatatttcgattcggagaacaatacaaatagttcaatttcctgaaaattacaatgacactggaagaataatcggtttgtttgtagccgaggagtttggtctccctttccttccagccttcatggcgaacagctcaagcatctctcatggcgtgaacttccccgtcggcaccgcgccggcgatcgactctgcattcttcaagagaaatacattgcagataagcttctgaacaattcgctggatgtgcagcttggttggctcgagcatctcaagccgtcgatttgcaacagcacagatgaagccaatggtgcgtcggctggaattggtaacaattctctgaatcgaagacagcatcgtactgcactcttctccacgagcctaaattgacttcaagagaccgattggtctctacagggttcaagaactatttcagcaaatccctcttcatcgttggagagttcggggtgaatgactacaacttcatgtggacggccaagaagaccgaaaaagaggtcaaatcgttggtgcctcaagtcgtggaaaaaatcaccacggccgtggaggtaaacttcgatctgcattagtatcaatttgcagttttactttgttactatattcgttccaaaatataagggattttggttcccatcctagtactacgaaatctgaatagacgtagcactatatacatatattttagaacgaagagagtactatatacatattaattcacttgtattcttgtttacattgcttcaactttgggtattgcagaggctgatcaaccaaggcgcggtttactaggtcgtgccgggaaacccgccaatgggggtgctcgccaattgtcctcacgctcttcatgagcccgaacacgacagactacgatggcctcggttgcctgcgtgctgtcaaccgcatgtccaagcgccacaacgcaatgctccgtgcggctctcgacgggctcaggggcaagtaccctcatgccaagatcatcttcgccgacttctaccgacccatcatccaagttctctaagaccccgtccgttttggtatgtatattttctagtctcaaaaacgagtctcctctaacgtactactctttgatatacgtcactaacatgtgagcttattgactgtgggatccacatgtcagccactcaaaattagagggcagtatattagacgatccgtttgcctagctgcttactaatcaagtacagtgtcccgttgcaagatttggttcgttcagttttccataaggaaaaaagaaagcaatgaccagtactacgaaatctgaatagacgtagtattaagatgtgtcacatccagtacatggtatatccatctacaatatatggttaagtgatttgtacatttgtgatgtgcaggattcgccgccggtggcatcctcaaggcttgctgcggcggcggcgggccgtacaactggaacggcaacgccatctgcggcatggcgggcgcggtcgcgtgcgaggacccgtcggcgtccgtgcactgggacggtggtcactacacggaggccatctaccgctacatcgccaaggggtggctctctacggcccttacgctgatccgccaattttgacagctattcgatcgatcgctactgatctgattgcaaaggaaaccatggatgggagcaaagcttgctaatgtgcaaattatcctgtactgcaatgaatgaattttgagatggttcgcgcttgttaggaaaggttctctgtcttgtctccgtccgaacaggagtagaagtataatggttgggtttattcttacatcggtaattgatgatatgtgagcatgacttaaaagatagggacagttctcacccttcagactagtcttttgaattgtctatacttataatctaaagttggatctgtggtggagcagacccaattaatctggatggaccgggctgcacactcgcagtaggactgtacaagaaggatttgttcttcctgtctatcaggtggttcaggtcaagcagttgcttttgcaatctacctgctcggctaaaactctttctctctttttttccccttctaaaactcgtatggacgacaggacgatgacgatgccttgggtggtgggtatgcttctttgttctgaaagatggttattttggtaacagaatttctcattgtatccttgcacattaattatggctctttcccttagctta

SEQ ID NO: 60685 - DNA, 1910 bp, Oryza sativa
taattgttaattaagtaattaatcactgatcaaatggagcgacagtgtcgatgatcgcttgagcggtctagctctttcataccgcggccgctttcattgcatgcgcgagaccgcgcggtcttttactgtgtgataccgcccgcgacgtcattcccacgtcattttcgtgcaacggttatacgagaccgacggtatatttctgtaaaaaaaatttgcatcccaaatattcctgaaaaaaattgaatgaatagtatattttcaaatttaattcaaataccatctaccacgggagtagaacatacatagcgaggatttgtgagctagtctctgacgaatgggcccgctcgtaaaagaagcacaacttcgacttccagttcggctcagacacggatagttcgccggccttcgtcgattccgatcccaacttcaacttatataataattctataagctgagctagacatcagacgacctcgattgattagctaggttaggtctaaccatggcggtggcggccgaggaggcttgccacggcggcggcgccggttttgacctcgccgagcacctgcagtaacagccgctactgaccagtgacgatcgccccaaggcgccgacgatgatcgacgacgacgacgatggttggtgtggcctatctacttcatcatttctgtttcttctcttgattcttatcaaactttgcggcttttttttttcaaaaagcacttaacctcctaaacaatttctcggttcattttagacctcaaatggttggaaatggttcaacttactctcctacggtgtttgtcttttttgtttccctcttggttggttatatttttgcaatgaaattttgtgggattgatatatgcattataacttatctctaaacttttttggaattttttaatcgttgtttacataggtttggaagcgcttggactaatttaaacatagaggcttcaaatttcaagtgaatagtcatgaaaattttttaaactattttagaactttgataatagtatcatatacggctttaaaatattgactcgaataaatagaaacaatgaagagaaatgtaatttaccaattaagtgaagcatttttaatagtttaggaaataaaatgaatcgaaaaatatttaggggctaagtgcttcaatgaaatagtacgggacagtaaattgaacttttttttttctcttcacgatcgaactacagaaatcaatgcaaaatacgacgagtgcaacgcggaagttgaggaatgcatgagaaaaactgaagagctgaactctgcactgcccgaggaggaacactactactgtgtccagttcctacctcgctctcttccggaaccactcttctataccgttcaccgcatgtactttatgcatgacaccaatccaagtaagatttttttttctttttcatgggtatttaaattatttttgttcagagttcaattataacaactgtagttttaattgttcatctatttttcctttttgcaaaaaccaccaccccgtttctagcttacatacttcctccgtccaaaaaaaaacttaatatcatactagaataatactagaatatgacatattctagtacaacaaatccaaacatatatactctatgtccagattcgttatactagaatatgtaacaaatccgaacatatatactctatgtacagattcgttatactagaatgtgtagtatgaggttagtttttttttaacggaggtagtagcattattcatgagatgatgatgatgatcgaaaccatgatgaatacttgggttcaattttgttttctcagcttctctaggtaacaaattatacacgaaccttgaggacagagactacccgatcactatgatccagattttttcaatgcggtttgccggcgacggg

SEQ ID NO: 60686 - DNA, 2179 bp, Oryza sativa
ccgccatcaccgggtcacgggcgccgtcgtctcaacgccgccgcgctgacgagcgggtacgaggacgagatcgtcctcttcgatggaccactctcctcctccccttcttcttcgtcgtcgtcgtcgttgtcgtcgccggcgaaactggcattctctgccgtggtggccgtcgctcaggatgacgagttgagccttcgtctcgaagctgtcaccggcggcgagggtggcctatccatggccgtttctcggagctatctgtcgtttgaagcgcagaagcatgggagcagcctagccgagctggtgatggcgaaagacttggagctagttgtacgtgtcacctggtcaacaatgggcttataaattttgatgacaattaattacacaagttttagcgcgatgggtaggctaataatacagccgatttattggctataaggttctttgtagcattctcttagcccacatatataatactccctccgtattttaatgtatgacgtcgttgattttttaataaatgtttgacctttcgtcttattaaaaaaagttatgtaattatcatttattttattgtgacttgatttatcatcaaatgttctttaagcatgacataagtatttttgtatttgcataaaaaatttgaataaaacgaatagtcaaacgttggttaaaaagtcaacggcggcatacattaaaatacggagggagtagttagcaatttaacaattaatacatggtccacttatctctctcataaaatttttttcttcttacatccaaaccggctaagagtttacaacacacttctcctctcttctctcctctgcctcaacctttagccgacttacggcctcctattatacttgctcttactgtgctatgagaagagtaattaataatagtaaatttgactttgaaccaccttttaattaattactattgcatcgccctttaatgaatattttcacttttgaatcgtgtaaatttatctttgtgatattttagaccacccttaattatttattccatatgcattaacttaatcatatgtcaaagcaatagtctaaatatagttgctggcgttcaactgtgagtagaagctggcttatttgaaattgtttatatacttgataagagagcaggtcagcaggggtgatctaaagtgaaacaaaggtaagattacatggctcaaagtaaatgaaaaatattagttaaaaagtgattcaaagtgaaacgtaagtaataaaatgtgtctcaaattgaaatttaccctagttcatggcatataacaatataccataattgatccaaagctatcaaaacggacgccaaaaccataattgctccataactataagtttccatttctttattatgtaataatgtttttcgtgctagtgcgctcaacccgttacttgtggggcactagatacttttgtaggcatatacgtgcctacctaagaaggacaaggataatagagtatacatttattggtctcatacgccgtttcccgaacccacagtaatgcgagtcaggataagccacatacggaaaggaataagcccactgtaactcccttaactagtagctgaatctaattcgtatccctcaaccacaaaattagatatgacaagtcccccaactattacaaccgtctaaaacgactccaccgtcaattttgaaggcagtttcactgacgtgacatgcatgtgccaacctagtcattaaataaataaataaataaataaataaataaataaataaataaataaataaataaataaataaataaataaataaataaataaataaataagtagaacccacttgtcatcccctctctctctcccctttcttcttcttggctcaacggtgcaagaaggcggctgacagcagcagggtgtcgggacaacaacagggagtggtgaaggcggtggcaggatgacgacggggctttcctctctctctctctctcatcctggcccattcagcaccggtgctggcagtggagtggccagttgagcggggatacgaggcgacggtgtggcgcgggaggagggacgatagacgagagaagagatatagaagtgaaacggtggctgtgaccgtggtgacaccgctgactagctgttgatcgcagtagcagcaacaacatgtccttaatgtgggcttcttctt

SEQ ID NO: 60687 - DNA, 1278 bp, Oryza sativa
agggtccaataagagcagactatagattttggtgataattaattacattaattataagagcaggtataatagcatactataaaccatgtataaacacatattgaggagataaataaggagagataaaagcagcggactacatatttaaagccagctgcagcagactacaaaacataatgtgtatgtgactagagataatttagagctagtagttggctatactattaaactcactctaaaacttactctaagccttagcgatgtgtttactgtgctatggcatataataatataatataccataattgatccaaaattatcaaaacggatgctaaaaccataacaggggattatcaacgttacaggaacaaagcaggggtctgcggataacaaagtaattgcattgttattgtcctatgtatatcctacagcagtaacataagttacataacccttgtgaagcgcacgcaaccatggagaaacggtgtttgagagcttcatcattatgcccagaggcgcatccatcaaactaacacaaaatatcacatcgtcaaaacaaaaggagcataaaaacacctgggaatcgtagagatggtgatacaaagctaccttaataaccgtcagcaatagataatgttctgctggaattaaggtaagttcgtagtttagagtagcatggcgacgttattactaataatagcgttctaagtctagaaagagtagaaatatacagcaagttcaagctgcatggcaaccattatatacatgcactaatggattgcagctgatcctggatcgagcttaccacccaccattgccggagctcccacccttgctgctgctgttccatccgccatctgccttgtcccaggagctgccgccaccacctccttgggtgcccttgttactgttcccgccatccgccttgtcccaggagctaccgccgccacctccttgggtgccctcgcacttgctgctgttccatcctccatccggcttgtcccaggagctgcctccaccgacttgtctcccgctcccctcgcttttcccccatgatccttctttcttttggccatcttctgatccaccccaagaagattttcctggggtcgtacctgaatcccttgttcctccagacgaattccaggtatcctcagtcttatttttccaagaccctcctccaccggatccaccaccagtcatgctgtcagcaggagcaccccacggattgtttccattgtgtttttcctgcctggtcatctccaccagaaggttttg

SEQ ID NO: 60688 - DNA, 1193 bp, Oryza sativa
tattaccaaccgggactaaagatcccggtgatctttagccccggttggtggtaccaaccgggactaaagatcttaactttatgccccggtggtgattcccacccggacttatggtccccgggatcctttgcccacgatggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcaca

SEQ ID NO: 60689 - DNA, 1625 bp, Oryza sativa
ctagtcttttaaacaactaataatagaaatacaaactttttactcataatttatttaatggcttcattcatttttccatgacttatcaaccatacctcaatagatcataggaaaatgaccaaaatggtttaatgaggttctgtttgacatgctctaactccatgagcgtggtagaattaaaccaagctgactgttgaacacatcgtggcagaccactatttctttttttccttaacgagcaaaaaaatcagaccgaaatacgttgcatataaggtgggtcttctaattcttttggctagataacagataaaatctgatcttttcttcaatagaagctaccacaccacttattacgtaattcttggctcgaaaccaagtatagcggtgtctaacaaaggataaaaagatgacacattcaaaaacacaaacatcaatgaagagatacaacttattcaaagagcacgatcctattgataatatcttcatccaaagttgataaaaatttacatgacagttgtctccaactttcgaatacattgtaagtacgcagccttcaaatttgcttgatggtaatcactaattaacttccgaatgcagtgtaaatagtctccatgacaacatggattcactacttatacaacctagttttgtttggctacgataggagtaccaaccatgacaataatgctcgccaaattaaattcctaatgcatctcattcttaggacatcttaatcatcatgtatcgaaccgccaatatatatgctcaactgttgtcaacccctgcattcacccatcaaacaattaaaggagatacatgatcaaggttcagatctttgtagcattggttatttgtgggcatacactaaacaaggtgtagccatgttggtatacatggagcatttcagtgagacactagtcagttgaactggatgcaaatgatgaaaattttgggctgcccctggaaggctagaacgacaagagttgggctccgccttggtcctcatcgcaggcagcgaggggcaagaggtacctgggccggcccatgagccgagccgatttattgatctttatttgggccaacatgtgggccaacccgtcagatctagtactaccatacaccgaccaattcataacttgtgtcaactgaaactgcatgcaacatatacaaccttgtttgtagatttctttgctgcatagggaaacgacaccgacaccagactccatgtacttagaaaatatatccgtgccttgctataaaaaattaaaattattataaataattgagcagagttcaactttaatgattcaagcgctttaagaaagggcaaattagatccgtgccattgaaaatgtgtctacttagatatatatgttattacaattcgtatattcgtagtcgtatcattgaaattttacaaaatggaaccgtgccactgccatcacgattttcatcctcgatgaatagatgttcgaccagctagtgtctttgacttggattcgatgttcaagtcttggcttcaagtcttctggatcctctcaatctgcctcgacttgagctcctgatgcatccaattcccaggagatcccctttaggtctcatgagtcgtgatcctcaaccggttg

SEQ ID NO: 60690 - DNA, 7260 bp, Oryza sativa
gtggggcggccgccgcctccgtagcaccgctggatgcacatggggggtgcccgccgccgccggatccgcgcgtggggcggccgccgtcgccggatccgtggggccgagggccgccgccactgtcgcgtcgccagatccgtgcggggggcggccgctgccgccatcacgcagccggatccgcgcgggggtggccgccgctgccggatccgcgcgtggggtggccgccgctggatccggcgcaatcgtcgcgcgccacctcgtggtagccgccgcccaccatatcccgtgcttccacggccgccgtgcactgccgacgctgtcgccgtgggccgtcgtcgtcgcctacacccgccgcacgctgccgtcgctgtcaccgagggaggagaggataggaggcgtgacgcgtgagagaataaaggagagggagggtaccgaggaaatttcgaagtggataggagggaaaagaggatagaaccgaacgggaaatcagtttattttcccgtgcgggcgatagcctggcgccggttttctatttttccatacggtttcacttacgaaccgtatagaaccaaaagggggcagcgtccaggaaaatcaatcgtgtactagtgttacatatgtaaatacttacactaggtttatattataattacatttgatatacttttacctaaaaatatgtcgctatatttttagattaacccgtacttatatactaatcgtgaatacgcctcctaatataactcaaaaaggtaaagttcaggtatgatcatgatatacaagtgacctaatatttcgtagataccatgatataaacccataaatcctttcgactatgaaaaccaacataaatagttaaccggtactaattcaacaatagcttacttattagtgatgttcctattattatggcttggagcgtttggctcataaattaacaaatcatatggcttgaagcatttctcaatagaaggatttagaactgagttttgccttttttatgcatagagcaaaagatttttataaactgcatatccaacaatggctagaaaacattacacaagcaattttgctatatatttgttaacattttttctcctaaaaagttgatatacatggattgtaccgcagtataattatactataatttgcatgtaactttcatgtaattttgaatcgttagatttgtttcaaaatttgtgcaagtgaggaaggaaaagattcacagcgcgcgcacatgtgagatgattcattcccacgacctcagcttcaccgaaatagcatcttatggagatatttttgaaagttacattatagttacagtataatcatatcacgattgtactataattgtatctgtcaaatttttgaaaaaaaaaattatcgacaaatgtataagtgatcccttacacaagtatatactttacagttattatattgaatctagaatgagtttggagggagttctttctcttcaaaccctctactattaattcttcctcttcgtacgtcttattccccctcccctctgtttcttttcatggggatccaaggaggatgctcgagcccccgatacaaacgttggatccgcctctgctgttcgattctttcatactaccatgcataattttctaaaagaacaacttcgtgcaacggtgcacttaatcaaattaagtaattagtacccttggtgactaacagtttaattagtactaccgcgctatataaaatagagattacactctcatacgtgcactacacgtcggtcacgtacgaacccatagagttcgctggccttagtaccaacgcatgccccgcgcatgacgtcggcgatgacgattgcgaaacgagcgccgcgcgcgtacccccgacgtgaagatcccgaacaattcctattctaatatccaagctatctcctctaccccctggtggtatattcggcgcgatatgtctcgtgccgccagccgagaaaggaaaacgggatcacgcattcaacggctcgcgttcacattacgtatgtgcaaatccggccaagtggaacggacgcgcgtcgcgcatatgcacatgcaacaggttcagcgtatctcgcgttttcgcgtggtttgcacacgccatgcctgcctgcccctccaccgaggcgtatcatatatggatgtgttgaacaaactacaaatttcaaattcttatcttgtcggtcaagtattaattcaaggaagacattgctttctctaactagctaggtcaagagaggtgcagagcacatggccatgtatagtttccaatggcgcagtcaacctagcttgttgttatagatataaatatagtcaatataggagtatatgctggtgttacaacggtatatatgaataaccattggcagtgatgtcaaaggggttgatgtggccaccactcttcccgccttgaactgctaaatttgtttccaagagctagcatgctttacatgcacgttagttttaatatgtcaattagcttgtggaggtgtttgtatgggactatttttttagatccggcaaaattttttactatgtcacattaaatgtttgaatacatgtatgaattattaaatataaataaaaaaataactaattacacagattgtgtgtaaattgcgagatgaatcttttaagcctaactgctccatgatttgacaatgtggtgctatagtaaatatttgctaatgacagattaattgggcttaataaattcgtctcgcagtttacatacggaatatgtaatttgttttattattagtctacgtttaatacttcaaatgtgtgtccgtatatccgatgtgacacgccaaaacctttcacccctcgatctaaacacaacctatgttttcaaagacacacaatctcgcttgttcggtccatccatactttatgttttctcatccttatcgaacattcttcctttttatctagagcatgtactctattttatatgcgcacaattgctctgtaatatggtatttcgtgatgagaatggaatagctagaccaattctatctcggccactactttgttgacttggcagtaactgagtaatctatgggcgtaagctcttggtctcccttaatgcttttttgtcacttttttgcgagttgtatgaagtagtttatcaattctaagtttttgttaggtcagttagtttggtctcaaaatctttgagcaagttatataattcttgcaacatttaatactcccaacgtcatataatattgtccagaggccggagtacctacttaattaaaccccatcgaacaacacatacagtgaattactaccaagaaaaccttgatttgtaataacatatattgtgatttactttatatctgtttataataatcaattcaaattcaattatgttcaacaaaaaaattccaagacaattgttcagagagacttcaataaaatttttaattgcttttatcaacatgacatagcatgtattttaaggctaaaaattcttttgaatttaaatatgtaaatgacttaaaaaatatcatttatcccatatggtatgtaaaacatctaatacattttgtaagcaataaaaacaatatttggtgcacggaaaatagtattataatttgtatgaatacatttttttttcttggaacatcctccgttttacaatggctccaattgatttaggttaaataatgctaatatgcaactgaaagttttttatagattcttttgaagtaaaatataaatttggaaaatacaaattaaattgcatccatggtttatgtacttgaattttaaaaattagtaacataattagaaaattcataaagaaatacttgttacaaattggaaaaaaataatttacataaatttgatccaaccaaaataatgtttaattctctcttaaattttgattttattcagattcaagcactatttttaagtagtcaaattatattttatgttcctttcaaaaaaaaatttgtttttaatgatccataagagaggtgataagtttttgattattttttatggggacatgtactaatatttgttgaaataatatatgtactcgggactaaataacattgccacatcagcaccttgtcattaatactacttcaaatttagtcaaaagatgaaaaataaacattatagaaagtttaggaatatacatagcatccaattaaagtttatgggtggattttttaccttaagggatacaaaatggaccatttgcttaaaacaatatgttactgatcagaaagttctttcctcgtgtcctagatgcacatgaacatgtagggaaatggaaacagtccactctgccttcattaaccataagcatagtttgattcacgtacttcaaccataaaaccaggtataaagaccccctcaattgttaaaccgaatcaatttacctcgctggatagttttaatgatgattggtcttatatcgcatttacatggcgcttatattgatatttcttaacgacattagtataaatataaatttccagcaatggcgctagaaatggtcctggtatatatatggttacaaaagaaatccgcaagcacacggatataccattaattataccatttcactcgagagtattccaagatatcgtatttatttaatcccaaggaagattgtaagagagaactgtgctaataatatatacatgccacttgtataatcaaagtctaagcatgggttaaaatagttataccggtagggtgacacaaagctaagcactcatatatctcatttaatcattcctaaactaagtgaaagaagaaatagaaaagcaatcaatttatataattctaatatacgctcaactttagtccacatctggtagtatacaaccatataaccaataccccgtaacaatgccctcctggtgcttcgagagaccactccgggttaccgagtttcttacgaaaacctgtcatggccgtccaaccgggggctaaatatggaggagtaccctccctaggaaagttttttaggaatatatactatcatagaggaatacccgtactgagctgtcactatcagcggcccacctcgactgacccgtagcatatatgcccagataatgctacttaataatctagacaccatgtccacattattaaatactactctacatccctcgagatgacatagagtaaccgagtaatcggacattaaacccacaccactgcactggtaggctaactatacgactgtaccgatacagatataaaacaaagttaatacttagatatactaaagtaccgagagcatatagagaatagtatttcattaattccgaaagtcttacaaaagaaagaaggaaaactactgtcataccgaaattcctccgaagattccgaggactccgagagctattctattctacttcacttagcactagaatactaaactaaagtgtagaagagatatttgagcttgcttgagtgtgttgtgaagtgaaatgagctcctccttttatagggtcggtatgacggttgtagaaaaggcgaaatgaccattctaccccgcaaccatcattgagagtgcatccggagtgtacatgtggaggtccaggctgattgggcgccgctagggttcggccgaacctaggctggcccaacaggcctccagcttcggcagggtcactgataggttggtccttataacggttgtggcaattaatgcagtttccaggacggttacacctgtcttgtgggcctatcttatccatatgcttgcttaggagtgacttttcctcatttctctttattttatttgctcaattcctgcaacaaattattctccaagcacaagtggaactatattattctaaaacaaatatgcattataagcatagctaattctcctttattggtctataacgaccgtcaacagcttacactaggttttttttatgtgacatggtgacggagtcccttcaacatttcccgagtgggcctctacgcttgctcgatgtgcactgttgccacatgcttgatccatcggaccagaccactcatgggggaagcgaggacggtgccaatctctctttctcgctccttcctcctccacctccttgctaggccacctcctccctcttgcttcctcaacttagtggctagcacaagctcgagcacgcagaagagctcaaaactctcccgcttgatgacctcgccgaccaccatgagcattgcatgtgcccctcccttcatcccctcccaggcttgattgtctgataggagagaggagattgagctcgagctctcctacacctagctgcagtggtcagtattggcggcacggtgtttaggggaatagtggagcccaatggcactagggttgggttgcaaaaggtgcatgtaccttcttcactgcgaccgatactgagttctttgatagcgagccctcgagctttttcatcgcgaccctccaagtcctcccagttcagttaatctctcccagtacctccgcttccactggtggcgaggttgccgctgcctctggctcttcttccatcgagcatcgcccttgaaggtcgccaagagagaggggagaagtgtagagagatggggaagagatgagagagaagggagggcagaagaaaaatatagcggtcacttactgacatctgggtccactattatatttatttatttgctaatcaactttaggtcaacttgtcacgtaggataaaaccaacgtccaaactgtttggaaaagtaaaggggcaattatgtttctacccttgctttacaattcaattgtgattttacccctactttttagggtttatgattttgcccctgctttttaaaaatgaagcagccgtctacctctgattttgacagaagtttggtgggcccataatttcctaattaaatgaagaaagataatattattatcatttgtgaatgaccattctacccttggttcaatgagcaaaatccccaatcccttttactgtcccggttgcaagtggcggcggcggcgcacgcgacaagcggcggcggcgacgcgcggccagcacgcggcagggaggagcggtggcgcgggccagcacacggcggagtcgggcgcgggcagggaggcgcggcgggcgctcgcgcagggaggcacggcggccccgcggctgcatgcgaagggacggcctctggaggcgccgcgacgaggatgacggtgaggaagacgactttgccgtcgacgagagggactcgctcgggctgccgtcgccagtggtgagca

SEQ ID NO: 60691 - DNA, 5148 bp, Oryza sativa
catgcaactgttcggttatcaagtctaaatctctatcacgagcaaaaatgcaaatatctgtcactttttacctccttttttctaatcatcagacattagtgttcgttttgctctagaaattatcattgaatggcaaaacatgtccaggggtatatttgtccattcaccacaaatttaacaccgttaccattagttaacagagtaggggcacgtggctgcttcgtttttaaaaagcaggggcaaaatcacaaaccctaaaaagtaggagtaaaatcacaattgaatcgtaaagcaagagtagaaacacaattactccaaaaataaaacgaacctttttatagttaagagttactccctccttctcaaattgtttatcatataacaaaaaccaaaatttctcaacttgatcatcatataaccgcatggacacggattttatcagagtacaattaatgcagcacaggagaatttttgcatgtcaagagtgcaattgtgcattatgttttaatagatgcatgcattgtgggagaatgtgtgcataatattgtgcatgacgtcttgatccatgcagtttaaattatccttggtcttggtatataaatattatatgatgattaatttgagatggagggagtatttggttttgtggttgagtgcacaaaatgagactggggtcgtagttgagggaagacaaaagaacatctcctagggaaattgtgtttcttgtgaaaattttgggcccaaggcctcattttgcaggaaggggtggaaccgtaaaatcatctcatttcttctgctggttccctactctagctcgctagtgtcaatcaatgaatcaagcggccaccaacctacctaccccgaccatctcccaccatcggaggagacgctcaaactaccgagctgcccaatccatggcggcggcggaggcggaggcggccggtcctctccggcgggctctcttcgtcctcgccgtgctcgccttgctgctggtagcggccccggcggccgaggcgtggacgggggagatccgcggccacgtcgtctgcgacgtctgcggggacgccgccatcggccccgaggaccacgtcctcgaaggtatccttccttatccgacagccttgcgtgctcgtagctcggtccttgatgtcgatttcgtgcgtgcggttcctagagtggatctcgagttaagagtcggctgccccgcttcccctgttctggatcttgccttgcgttggcgctcatgattgacctagtggaggaattggagccgttcggtagagctggaggttgcgttgcatttgagaggggcggggcgcggttcgtcgatggagagcgtagttgcttgctgccgttctaacgaattcgaagttttactttgaactggtagaaggaactgtaatttgtattcccagtattagaaggacataggttggggatggatttgatatctgatcacgtgaagcacggtgaatcgacccttttcatttgtcttgaaatgaaatgaattgctgccttgatggtgaaatttgcaatcttggccttttgcccaattcaccaatttgtgttcccatttcccaaatttgtttatgtactctacccacgtcctgttctgggaatttggaaaagtttaaccatattgccagattcacccatacatgacagttgattcagagaaataaaaactgaaaaacggttgtcaatgttttatttccctgttatatattcttctttgaggggtcaaataggggttatgtcctactcgaccttgcaacttgcaggaacttgtttttactaagatggaagaactgaagtcgaattggccgatcatatgttcaaggagtttaccctgtaaaattgttgggtccatttttggtgtccagtacttccattctcttgcttttgactttcgctccccagtaataatcacataagcatggtactatagtatttggctcctgagctaatcaaagtagcaaaaatattgagtattgctcgtgatgatgcctgtggtttgatataattagataataccaaatgctaactgcaaagaaatgcagtgaagccatagatccttcatttggatggtaggattaaatgttgaaacatcaatatcaataaggttaaaaagtccatggatattgttagtggtctgcaggtcgatagctttcagatcaagtcaggtgtgtgttctgctcgttgtctggacctagccttttctttatacctggtcactattaagtattaagtagccggtttctatcctttgcctacaatattacccttggcactagagtctggcaagtggcaaggcggtagtctggcgcttagtacctaaccacagacaaggaaggctaaggtttggtgcgttgaggcttgcactgagtacctatgcactcctaggaggacttggtgattgccaaggagtgtactgcttgcacattgtaaactctcgaaattatcttctgtttgttagccgattcattctgctatggtttgaattgttcattgaaaaaagaaactctcagcaatgttgggatgctaaatgaaaacctatagatcattaatgttgttgtgcttgtgggttgctaaaaacttattaggtctggcagaaccattggtagcaatgacaaaaacaaagcgttggcaaagggcaagcaaaatggtcgaagcatgatgtggcgacaacccatttagccatttctttctttaggtctgaatatccagaatcggtctgatgggttttcacaattcgttcattcatatttcaataaaagagggttatcagtttgtttatactcatatattccagttttcaatgaacaatggaatcttatcccttgatctatttttagagtacattcacaaatgacaactgtaaaagtctataatgaaaccatacttttaagttatagtttcagcaaagcaaacttccatttgcactacgaatctacacttttacacattgccatcatcttcggcaggcctagtaggttagggtgacttcttggtctcaggatatgtttctgtttccatttatgtcatatggaggttgttgcaataccaaattaactcataggcgctctattgcttggtggggtgggattgggactacaactactaaaaatccctcctattcaaccccagatgccaagcaatcatgatgacatgctagcacttatccagtgttgcaagaacctccatgttagcaaaatttttgatgagtttgtgaaccgacgagtggagccagccagtaggatattacggcaatagaaaggctcatgtggttcagagattttgtgtaaaagtgtgattttgtgattcttttttccccaatggtagtgcagttttgtgaaatttacttcttcaataataaaagctgtaatggaggggcaagtgcaatggggcttgcttttggcgatagctagaaacctgttggtttgagtataaagtctgccggttgaacagatagacctgctagggtttttccttgtttccactttccacctagtcagcaaacactagtacaagtacaatggtagactggtagctgccttaccacaagctagctttgtttttttttggggggtgcgcaggcatatacatgtggtcctattgtttagtacttccactttgtgcatttcattttgttttcctcacttttcattcctcacttatgtttacctgtacactgtaatcaaagtactaaaagcttattactctcccattcctcttgcttgtctttgtaccttgtataggtgccgaggttgccgtcctctgcatcacgagatctggtgaagttatcaactaccaggccttcacaaactccaagggtgtctacattgttgcggagacgatgccagagagtgaccgttgggagtcatgcttggcaaggcccatcagcagctttcaccagcattgcactaagaggggtgatacacactctggggtcaagttcacatacagcaagccttcaggaaactctcacaccgtcaagacgttcctctacaagcctgccaacgcccctttgtactgtagctaaacgtgttttcatttgtttgcgaaagaaagaaaagaaatatatagaattgatatggcttcctgcctggacatggtacaaacaaactgtaaacaaggtgtaaccgtgtaaagtatggatagctggggtgcttgtaattctcatatggagctcttaccgaacatcagtaactggaagaaaggggattttgcatgtttttgtaactatggatctataagtatgtttatactttataatcttggaccatgttgcgtccgttcaaatcatttcgagcaaagacttgaattctgttaatacaaatgagccacaaggcccaagggaccaggccttgccttgaccaagtagctgatgttaataaaaatgtccagttgacccctagctgatgttctggtaataataataccttctatgtttggccgcaaaatgagaaggcaaacattactgagtctactatatgtgcatataattgttttttaataataaaaatatattatatccttggcctctgtttgtagcgcatttcgtttaagaaaacaacccccgctcagatgcgtctatttcgcaggtgtgaggtagtcgctttatgattctaccttacttttaaacagggtcgtagtgtcttctatcgagcgatataacagcggtaacctgttttagaacacacaaattgtgctacccttaagagtttatcagtaaaatcaagaactttatttatgccctgcaagttgcctcataaaaagtagatgttagtacccgactaaaaggagggaatcaaataaaaggtaaagctctcgttttaaaaagtaaagctatcgattaaaaggtaaagctatcatttaatttgttaaaggtatattgcccgtagcgaggttaaggtaaacctttgaccgagtgaagacgagctcgataaaagcacggcacaaccaataatggaaatgtgcatataactgttaagggcttgcgtggattaatgcccaaataaaccttagctaaatcctaaacgatagcaatactattggatttcagccatcatttaagttcgttaccaaaatattttatcgcgtacttgagaaaaggcgcccaaaacacagtcaattcagagttttggc

SEQ ID NO: 60692 - DNA, 24658 bp, Oryza sativa
cactactggcaggatcaaaccacttacccatcaaccggtagaagcgtagaaggaatcgctccttggttggctttgtccagttgtttccccctaatgtactcctcctatggtcctaccacttggttattcaaataaagtcagtttacttacgatgctcgatgatgctcttcttgtgtctagcatattgtgtcatcaccttgatttagcacatttggcccagaagccagattgcggtccaccatctacattctagtagctccataaaatccatcttgcagcctccgagctgcattgtatagaacaacaggcgagtaatcaaaatggcctctccttgtatcgaattagagatgcaaagcttttacctgtccagatatttgctataccgattgtgttgtgctccgactcgggctagccattgccccgccgctgccaaacctctttcttcaacccagtcgccgaacctcgctcagcctcaccgcaccatgtctacacctccctgcaacctcgttgactcgttgtaatggtgctgcaaccctagtcgcgacacctcgctgcgatttgggagaaaagagggcgacggaagcgagcggtggaggaagagagcaaatgagaaagaagataggggcctaaaagaaaaggttcacaatgcaggtggtgtcacacatgacacatggtgcacgcgagcgagaccgccagtctggatgtccacatgtcgtgttgcggtcaaatggtgctttggaccggggattgtacatttagcaagttcagtagtctaaatgtgtgatttacaagtttgtgaacttagaaacacttgtttacaagtttaagcgttgctagtatattttactcttaaccaacacacatccaatctgtattattataaaaattgaaagtgtcttcaccagtggtttgctatgtcgagtgtcatgattacatcggggtccgattcacatttcagtcgcgcggggtaatcgtgttcaattcagcagccatgcggggtgattacgcctgcgacgactgtggcacacgttttctgttgtccgactctcttccatcatgcgcgttgtgcatccatgtcccgtgtcataagtgaagtccaaatcggtcgctcccacgtgcgtgtttactgcatgaagatccacacccagatcgctaagacatgcagtcccacgcgcggtgaagtccttctcccgactcctcttccacgtgcgcgagacggtctcatgattgacttctaataatatgttcgttgagtaatttgcgatggccctggcaacctctttccaatttgtttccgtcctgttacttcatctttgttatggtaatcctcgtgtgcagtcatgcatgacaatagcaactagtaagcataacactggttgatgcgattgccgctatgggtaagtaaggtcagcttggaaggatcaattatcactagttaaggggagagcttgtgatgcctaaagtggtggtgcaggcatggaagaggttagcagcaacgtgaccgtagacaatatgatttagcaagaccatcactgtgtctccacgctccagcctcactgtctaaacttaggttctttattttgttccatgatcttattggtgtcagtttagcaagataattcacatatccttgcaaataatggaaggatatgtgaattgtttgcttggtagaatcaaacaattcgagcaactaaaatagaactatagtttaattttgctatcttaacatccaatatgctagacaacacgagatattgatccctgaagtcaaatgaccaccctctctcttcttctaagtgccacctctctatctaccgactatgatgttttagttttttttcttgtaatgtattagcatcttgctagtaatgttctattaaaatttgtaacgtgaaaataaaaaaaatagtaatattgtaaagttgtggtgtatacaatgttttaaatagcgggctaagacatttagcgttagcttctcaaacagctatagtgatagttatagcgggctaaatagagttatagcggttaatcgtatatgagagcaaatagtaagaacccttctcaaacagctatagcgggagatagtgcagctatagtgggagatttaaaaccttgggtgtatatgctcgcatattccaatagtgtcatataccgagacccggtaggattccttcggatagacagggttgtgttcttttggaggggttaggaacctctcccctccgcacgtaaaacggagcggtaaattaactcatgattaattactacactgtaaaaaaaaaaccaactctagctatgaacctcattggtaggattaggttttttataggacggaggggtaagcattacctaaaataaacttgaaaaatagattaatatggttttttaaaacaattttcatatgtgcgtgtgtgtgtgtgtgtgtgtatatatatatatatatatatctttatttttatctttatctttatctttacctatatctttacctattataaaagtttaagatgtttttgcccaaagttccgtacgtcacccacatatggaaatagcacccggtttttttcacacggtttttttaacgcccgttttttttgtctgagcggtttttttatccgactcccaaaaaatccgctcatcaccggtttttttaaagcccggtttttttgtccgaataccaaaaaaaatcgcccggttttttcacacggtttttttaacgcccggtttttttgtctgagcggtttttttatccaactcccagaaaatccgctcgtcaccggttttttttaagcccggtttgttttgtccgactaccaaaaaaaatcgctcgtcgcaacaattggaaataggacgcacagtttttttttcgcatgtttttttttccgactcccaatagcatacggtttttttagcgcaggtttttttctcgcaaagtttttttttctcagatcgcatccgtagcgattttgttttccaactccgattcccacccagatcgctcttccccgcacggtttttttctctttctcagatcgcatccgtagcaattttttttccgactccgattcccacccaaatcgctctccgaacaccaaaagaacccccaattttacatccgaacaccacaagaacgctgcatacatcctatcctcctatatatacaaacaaaactggtaccacaaataaaattcgttcttgtggtgtgatcaaaagacattctaagagctctgctccatcaccaaagaagccatcgtgccaagagcagctccgtgaacaacttcaattgtattgaggatcacaaattcacaatgcctgaacatacaaaatgcatttgtaagtattctcagggccataagttcatcagcaaccatcaacaaagacacaacatattttgatgcatttgtgtaatgatttggaaggacaatatcaaatattctaagcagttttcataaactcccaacaaaaaatatttagaggaatgcggcattactaaccattctagacatcttgatctcctgtcttggtagttgaagtttctgagttcctatcacaatataaatgcactacaacagaataagatattttcagtgttcaaaacaatgttagcgattcagtgctaaagaccgactcaatcaagaaaaaaaaatgcaataattcagtggctgatgtcataatttcgttttcagtttgaaaaataaatatggaagcaggttgaaaactttctgttcctagcatttttcatcctaatctctacagaaacttcagcaacctaaagcaaaacagtaataagtataaagtatgtgataagagaagatttgctatatgttttcttatgaaaataatataacacagacaagtctttaccaaacaatagcagattctcagatctatatttctcccaactcatgcatgttatgtgatagacaaattttgctatgccctaccttttatagcagtcaatgtcagattctcataccaatattttgtaattcttatacactttttattcttaccagctccatcacacatgcttgatgctggtaccacgccatctgcatcaccatccccactcttggatcctaatgtaagaagaagacagagataaggagcggtatgcgcggatgacagacaaagaaaagcaggaaactctagcaaagcgtcgtgaagcctataagctcaaaaaggagtcaatggcccgtgcaaatgctgatgaactacattgcatcacttttcggggtgatcaaccagggtcattgcatactgcacattccgaacaagaagacccagcagtagacccaaaagttatccaagaaaaacacacacgtgaaaggatgagatatagaaatatggaactgaacaaaaaacaagttgtgatagaacggatcaaagataagcgtgcatcacggcgcaacaatccaagtaaatattccatagcaatggagaaccctgggtatatcacgacggatatgtcaccccctgtcccaacaagatcaccaaaaaaaatgtgtaacgcatggagaaagacatgcattgatggcacgtcgcaacgaaagcttcatggttagacgagacaaaagtacttctgccttgttagaattagaagatccttccataagcgcccaaccagtcagtggcgtagacccttctaatcaaccaagcgtaatgaacattggtgaggatcctagctatatacacttactttatgttgtactgcaatgtatcctggtgtactactaaccatcttctttcaatagacaataacatgtctacaatatctaaaggaaccaatggtgtagagcctccatcacagtcacatcaatgatgatggtaacattgtcatctctatttgattttattttgatttgatacagttagggccttaatctacatatgcacgtactgattttttatgcagccgatggtgaggtcatatttgacgatgatactgatgaggaaagcgacatgcttgatgatcaaggtaattttgtcgctgttcgccaccatcatgtcaaacgtaaacttatatcttggcactaaaactttccaggttgggaggaagatcaggacatacaaatcatagatgttgtcgatgccatcactgagagccctagcatccctgatctagacaagatcgtgtacagcaacttaccacaaagcactcatatgctgaaacccgtagaaaattgtggattttgtggtgcaaaaagaagtttgagtatgagtcaaagggcttctgttgccgaagtggacaaatcaaactagccaatcaagacacacctcctgaactcacgagactgtggacgagcgaagattcagatgcccaacatttccgcaacaacataagatttttcaatggacatttctcattcacatctctttactgtcaccttgacagagagataactgacatcaggaatagtggtatttacacgttttgagctcatggccagatgtatcacaatatacgttcattcggtactgatggttcaaaccctaagcgtctggaattgtacttttacgatgatgatcctaccctagagcatcggtaccgtcattgtcggccagatctatacgaacaagatcaaaaagtaatcagcactataactaacattctacgtggtaatccatactctgagcagtttaggagtttggggcaagccgagaatctcgaggactaccgtgtgatattgaaccttgaccaatggttggatcagaggacgtataacgcgccaataacttcagaggtggctgcagtttgggtcgagggaaatgagcgacgaaagacatttgacaagagtgtaatcctacaagggaacaacaatgaaacaatgaaatagaaggcatccggtcgtactatggatgctatgatccattgtcttatccactattctttcctagaggtgaattgggttggcataccgatataccaaagtttggtgttaacctggaagatgtgctgaaggctcgtcgtaatcgcaaaaacaacgacaacaatgacaataacccaggttagtatttcatatatttttgccttcaacatcatgttttgttaccatacatgtttacatatgtcgctctcttctaatgtgatgttattcacagattcatgtatacgacgacatccaaatggtgaaaaagataaagggaacaatatcaaaacactatctagacatgcaattttgggtatgtttttacaatcacgtgtattattccgttttgcaattttgagtatgcctttataatcacatgtattatcccctttgtctcatgttgtatatcatttttgcacaattatatacaaagatgactaccaattttggacaacacccaaactttcgtcaaaagctcgacactgaacggctagcaaagtcagtttgtaattggcctgggattgactacaatatttcaaaatgcagattggtaagttctcttccatttgctcatcatggccatgatttttttctatcctaacagttagcttttacagattcttatgccaatagaattctataaatttttcattttgatcgtattggaccaagataccagaatcgtctatatattagacccgactccgcttgaaccaatttatgagaacaacccaaatgcaagatatgtcaaaaaactactatggattgccaaacacttgccaaaagcaatggcaaaagcatgccttgggtcaagatggaacgaggatatcaacctatggcgtcaaataattctaccaaatgttccaattaacaacgggtaaactttcttttaaactccattgtacaaccagttaatttatttccctaaaacaaaattaattaacaattaaatttttcttagcgaactatctggttatcttgtgtccctcttcatgcgcaaatggaatgatgaagaattgcagttaccaattataaaggcaagtatcgtgacacttagcattgactatttaaatgctactacctttttacacatacagtgctaaccttgttcgcttacataaataaatgcatatacaggatggatatgagctaaggaagcatttcttagtagaactattggcgtaccaagagaatgaatgtgagagcagtatgcctcaaggtgtaagagacatgcttctatgtatcacctcaaagaaatagataattgactacctgattaatcagacatgtatcttttcatgattatctaaataacttatagtagttcaagagtccgtagagcttaccaatttcgcgcggtgaaaacacataatcagcttctggtccacgcccactatccacaacacaaagcaccccacagcaggcctacaaaaggatgtggttcagtaccttgacagaatacattgtgtcaattcaaaagtctacagggaaaaacaagttgcttcttctgctcacaaaaagttccatcgctgtgcatgctttacatgagcttaattagttaatgtgttttataagcagaataagaattgagttcaagtattctcaattaagtagtggaaaggacgaccttaattagttcgaacttaatttgacaagattactaatagttagtacaaacttacaacgaacaccacgaagctgccgtagctgaaccccaacactgtgcaccctccatgccgagacgccgcgatgcatgttgcctggaaccccgtggaccggtcgggcgatggggacgagtcagcagacgaggggtgattattctcaaacacacctccatcctcgctccaaaactcccatcaaccgaatccaggcgcagaggccccagatctggtgattgccaccgcaacgacgaagcaggagagggcatccagccgcggagaccccagatccagtgattaccgctgcaaggccctagatccggacgagaggcttgtcggaagtagatccggacgagagactgaccggaagtataccaccgtcgccgagtccaatccgtgccgctgccgaggccactccaccccgtcgactgctcgagctgcgctgtggccgaggtgcatgaccagatgccgccacgaggtgaagatggggagccagcagggagagaaagagcttggagatggggggttgggggaccagcaggcatggcatggaaggaccaggcgatacgctagaggtggccggtggtgggaaggaattgggggaaacaggagtacatgagtacaggacattgggggagaggtggtggggaaagtgaaggagaaagtgcttttgggacttatctggtggtgccgtggtgctctggttttctttctctttcttttttcctctcggtactctctgccttgtctgtttttttttctcactcaatttgagatgaaaagtagtactatttgtagaacggtgtgttcgccgattccacttgggaaccatgtgtcatgcatgacggaacagtctattagaatgtgaataattaaatattattaaaaaataaaaaatagattaatttgatttttaaatcaactttcatatatttttttttgcaaaaaaacgcaccgtttagcagtttaaaatgtgtgcacgtggaaaacgagaaaggggagtagagaacatggggaaataacacagcctaactaatagtagatttaacttatatacttattggaagtgatgaatcgatgagaacatttttgaaggtttcacttaaaaacccatttacctgtctaaatttatatacttctttgtcttcttccttctctctttgcatcatcttgctttgctatggcggtgatagcagtcagagcaccgctggtgctgcagaggaggtcagggtgcgatgatgtcgacggtgggcggtcctgctagccaccccctccttccctgtgccctaccttgcgatgcggttgtgtcggtgtaatcaatgacactctccacgaaccgtcgagacctcggcaatgcacgcgagcgtctccattgcatccactccgacgctccattggagctggtgcgacgcaggctagcggcttgatgcgatgctctactatcctttttaattatttattttaaaaattctctagttcaaatatgctaccatcatcaaatggccgatattcaactattttttctcaacaacaaaaattttaaataatcagaaaaatatcaacaaaattttttttctcaataacaaatatttaaattaacggtgtcactcttagatggtgtcaggacaaggcgtgtgacaagttagccctcaaccgctatggtgatgtgcagtttaccatcatcccacaaaggataaaaaaatatgtactgttgaggacaaatgcattttccctttttcccattacaagaattaaaattgtgttcacccgttgtaacacacgggtatttttgctagtatacatatacatatacatatacatatatatatatatatatatatatatatatatatatatatatatatatatatatatatatatatatatatatatatatatatattacaaaatacgtaacgtttagtagattgggaagtgtacgtgtggaaaaaatacggaaaggctaaaaaactgtcgacgcatttttctttagaaatatgtcgatttctgatccattagatcaactgtaagattcgtgctattttggttgacgaaaataaaattgtactgcaaagaatcgaacctatgatctccggtggcttatccagcggtcctaaccaactgatcgagcaaagatgttggcttaaattgaaattacatactaattacacttaaattatatactatttacatatgtaatttaaagacttacattgtaaatacactaaaattacatatgtaatttataaacttacaatataaatacatgctgtagctcctcctaaaaattatgagtcgggaaaggtggtgtaagattgtaagaacactagcagtcatcaaacggacgaaaaccatcggacgtcgtcatcggacgggtcttgactcttgacccttcacatttcggtcagctcgtgtcccaacaacgttcaacgcgttctgccacaacccacaaagccacaagtgaagcggccgcaccgatctctccgtgagagggacgcgtagcaccctccgcctccgcgcctaaacggcttcgctctctctctctctctctctcggcgtccccgcctttacgcgagaataaccctcccgaaaccctccttccccgatcgatgccgccgccgccgcctcctccgccggagtgggccgacctcccggtggacgcggtcctggcggtgttcgagcggctgggcgcggcggaagtgctgatgggcgccggggtggtgtgccgcacctggctccgcgcggccacccgcgagccgcggctctggcgccgggtggacctcaccgcctgcttcgaccccaccgtcgacatggaggccatggcgcgcgcggccgtcgaccgcgccggcggacgcctcgagcacttcgccgccgagcgctttgtcaccgatgagctcctcctctacgtcgccaagaggttatggtctttcattttttaccccttctttttctttttgtttctataaagcctggggtttggaatctggacgatattgggttgtgaaaattcgggagatttagggtttaatctacagtgttatttggtcgctctgattgtgtttttcttattagagattagcggggttttgtatgattttacggtatgatgatttaagtagagcaaggagtatatatagattggagtttttatgcatactgcatcattataaagttgcagcaaaacgctgcaatgtgccacaacgacacaaacaaagcataagaaaatatactgtagtggattagtggctctaagtacacatgttgttgatgccttatgggttggccatgttaagggttagcagggatttgagcatacataacaccttgcagacttttttgaagcacggttctgtctccccaggtattgatgctgggttgatttgtttttgttttcggcgtcaccagtccattttattaaatttggatcttgtgttgcattcatgctcgacaactgcattgtcgtcttctccattgatactacatataccagttaggtttctgtttcactagttctggactgaaccgaggccatcatattgctatcaaatttattccaggcacaaaagaataatcaaacattgttatatgatcaattaatagtaataataaaagaagttttatgcctttatgcaaatcattagatgtctcgatgctaattcttttaacctttcgatagcttgattgtttggttatttcttcttttctttttgggtttcatttccttaatgaacattttttgtcaccttattatcaatacttctggctaactttttttagaatgcctgaactattgcattatatgcctcagatctctatattgtactcagtcaaacaaagtaaagtataattgaaaagcaaataccagtttcttagatgattatattgatatgacatgacttagatttggtagttgtcttgtaaagattacagatatggagctgtggagtcttttattggtatagagccagaaaatttccggaatgcacactcctgtctcacaaaagtgaccactaataatcccatggtgtatatgatacttgctacgaaaattctctcttgagatctctagtataattccatggctaaccctaactttgagctaacatctctggcaaatattatgggtgatgaaacttgagattgatcctgatatctataatttataatttaccccactgaacagaaaatattatttaactatgctagctttttatatgacctgatattatgttgtctgtaatcatttccaatggaccccaatttgtagggtcctgcttgatatcatcagttgtttttatatttcatttgtttatttttaaatcatttttttatgaacttcctttcttccaaggtgccatggcatcaaggttttcactttcggtttgaaccggaatttcagtgcaaccaaaattttcggatgatttggaacttcttttcccgaaattatttgaagatttaacaaaatgactgaacttgaagaaattttgaccaaattcacaaaaatttggaaaaagaaaaacaatttgggtgagatatttgcttgccggagggaagtgaaattaccaaaatttaggaaatttcgaacagaaattggaatccctgcatggcatatgcataagatgagaattgatggcgaaattcctcctaggccattgaatgctatctagttcccttgtttgccataaaaagtttgtaattcttccgtttctcaattagttcatttttatctttcctttcttgcctatatcttggttttaacctaggtcagatggcaagacatcttttctcttctcctttctccactcctttctcctctcttcctctttctgttcaatgcacagtagactatttctgttcgttcgcagcctgtcaagtcagttaaggccaaccctggcagggaagctgacaatcctgctgcttctgtgccagcactggtaccttgatgaccgacttcaagtccatcagagctggacaatgcggacgaagcagtatttggagttagctgtggctgtccttgcatcctcatcttctggcgacatgatgattccaatgtgaaaaggttgggcatgacacgggatgtcttctaatggtacctagagctaatggtgttgacttgagtggcaaataagggaacaacgttggaaatgtttagcataggatgggcacaatttttgtagtgccatataagggaagctaattcaatgggataggaggaattctctttcagataaagacttttatgcaaatttgactatattgtttcagtggaaaacataagtggaatttatttcttctagtaagactcagctaggctgtcatagagtgtaaggccaaaggaagaatctaaactattcagcataggtgtgtgcaatccttcagataaaatgtatgtactttaaccttatgggggttagaggtgatatcgtatatgtaagcaggtctttaacatgagttttgtgtaactaggcttttttggtgtcaaagaagagaggttagtctgcatatattcagacttaacgaccagcttagtgtactgatcaaagtgtgcattgggaatctgtagaatcaactagattgtttttctccaacccagcccttatgtttctaaatattctctaggagccttgcttgctgtttttcttccaaaaaaaaacttaatacttggtttcagatgttgtttacaattttcaacactgatttactattatttattggatctaacctgccaattgcgttgctcatagatagatgccaatcgtttcatgatcatacatggatttaggatagagggaactcgagcattatattgaactaatgaacatgcttgagttcatgagttctgttagcaatttagcattactgaatgcttctatatttgacataggatcactttgttctgtgattttatttcacaaccacaaatattgacagtctctacttacaagttgtgcctttatttttttgttagggaactagcctattgttcttactgtcaggttgttgattaatgtcgatttctctaacttatgttttaatatgtgcagaactagctgcttgaaaagtcttcggctacgtgattgcataaaaatctcagagaaaggcttggttgctgttggcaagacatctccctgtcttgaggaacttgagctcactacctgcaccatcagtattttgctgaaggctgttggcgaagcatttccgaacctgaagtgtctgcgactgaaccatcgttggtttgatgttcagtttgatgagttcagagataacttccatgcccttggaatagcctgcagcatgcacaggctacgccatcttcagatctttgccaatcggctccgcaacaatgcacttgctgccatccttgacaactgcccgcaccttgagtcccttgacttgcgtcagtgcttcaacgtcgatgtggatgcagaagtgagagcaaagtgtgcaaggctgaaggatgtgaggttcccaaacgactcaaccaaggactatgagtatgagacttttattgagacaccatcactagattcgctcccacttccatttcccgcagcagttcctcaatggcccttccatgggaatgacgaggatgacgacaatgatggtgatcaggacgatgacgatgatggtgatcaggacgatgatgacttgggcggtcacagggtgacagagtatggttttatcatcggtgactaccatgtccgcggtcggatcatccaccatgagtaactcgacatctacatgccgtaattagcaggttttgatgtcccagcgtctgagtctcaggaaatggaaggtaggtgttcagaagtaaggtaattcgctgagcgctgtaagttatttctgttgtagtagcttactacaacagaagggcgcatttagaacggttctgtatccaactgcaagtctgcaaccggtctagtgacctcatgtgtagtggtaaaacctttgttcctattctgcgtgttgccatagcgcttgtggaagtttcttggtttgtgtacgattgtgatggtgaaatatgtttatgtcagcggaaaggctcccgcgaactggtttccagcccacgtgcgtggtgcgtcgggctcatcgcttgctttctttcctttattatccggcgtccagcgacaagcttaattgcaagttgcaaaccttccggcgttttgcgcacttgtggacttgcgatgaatgaattacatcgtatgtcagattttcgttgtgaaaactttgtacaattaaacttcctttgtagagatcttcaacattggaacccttgaaactttgtacaattaaacttcctttgtagagatcttcaacattggaaccctttcaatataggtactttccgcactgaaaattttggtggaaactcaaaacgagttcaaaaaataagttgaaaaaggaaatggtatcctaaatactctctgttagtgaattttaaggaacacaaatgttagcctatttttctgtgaactttgttaaagtcagaaatttgacatacgacagaactaaaacaccagacaatataaatatagaacggagggaatacaaaccattctactcttcattttctactccctccgtcccgaaaaaaaacgaatctaagacaggatgtgacacattctagtataatgaatctggacaaaggtatatctagattcgtaatagtaagatgtgttacatctagtactaggacggagggagggagtataacacttggggagaaattgcaacgcagaagcaatcatggaaactatcattagcacttgatgagataaatctgagtacaagtattatatcatattcaactattttttccgtcacaattacactttattatgagtaaaaggtaacaattacatgcttcaacgtacactcgcccaatcctcaacgcagagaagttttaaggagtcaaaagataaatgatttacttgagcagagatcttgcaaggtgctccctagcagtggctaaagcctgagatatcgtctgcagagaataggccatgaaaattaatgagattatggaactagaaaagcaaattttctccgaatgataaagaaatacctgctcagagaagggggcagaaccatcaacagcattggttgcaaccttcccggcaatggtatttgcatctgtttccagaattatgctgcaggaggactaatggtttcagtttatatttacaaacaggatggcatgtgaaactacagcttcacaagagagctgcggccttaatacatgaaattggcagcgatcatgctttttcccaacaccccatgtatgcttttaaacggttttgtccacaagagtaagttgtgaaagaacttcagggaatgtacagcagtacaaggatgagaaagtagttgtttctactgtcctccacatcagaagacaatttatgagagatgagagactactcatacaaagagttctgtctataagcaataggtacaaaataaatactacggcgtcctctcattcgtggatggaggtagtactcagtgctcaaaattttacatgtttttggcactagtttcctcgaagcaatacaagctctcgctctgatatcatatcttttgccccaagtcgtttgtttagtaaatagatgatcttaatctctctcctccacatcagcaaaaaatctatgtggcagtgctaatcatttactactcctattaaatatccaactttcttatatgcatttattgaatataatgcaatatttttttatctctccttagtctagaagtatgttcttggaagacaaaaggattatactgcaacgatgctcacagaacatttaaagttatcaccatgaactagttaagcataaaatggtttttcgggcagaaacttcccaatagcttcagacatcagcgtttgtcattatgcaaaaggttgtcaacttgacatcaaatgacaacacctatctaaaatattatgcttctcttgtatctgcccacatttgtcaagagttacagttccatcggttattctgacctaatagctacaaccatagtacattcatgtgcaatttaggcttactaatggcatgtcaaactaagtctctacagacaatctgttgtgctgtttttatgcatcaaaagaacacaatgaacagtttcttccttcttttccatcttaaaaaaattgatattacacaacagatattgatgtttgcctttatgagcataacatattttatgacagtatatttacatgtttaaaaaaagttcaaacaaataaataaaatggaatatcagatactacttaattaaaaaacatgcaacagcgtgtgtacgaaaaaaaaaagtataatagtcaggaatgcttgcatgtgattttttagaagaaacaggtggtacaaatgtagcatagatcacaagaaaccattacccgccatctacaatttcatcgatgcagagaagtatcaagtccagattctcgagtgcagtcctcttctcaacatcacccctaaagcacagtaagctgactttaaagaaacagccttaccaacattaacaaaatacaagttcatgtggaatactggaagaagtacaatacctgagtaaaagaccaacagaatcagagaagccctgtagtacatttgctataatgagctcattctcatcatcaccagcggtgacaaaaaaatgaaggtcttgtacaaacttataaacgacaatatagccatcaaacaatgttatctcagctggagagaaccaaaaacaggtatcaaaggaaaattccaaattcaactaaagaataaagatcagaaaagtggatatatcgagacataattataacattgagcataaatatgaagatttttgttcataaaaatgagttgctagcaacagcaaactaacataatcataacagactgctggatgatttcaaaccattgaaacagtatcattttatatgaaggatatctttccttgaaagcttggaaagggaatccaaggtattttgctttagttatccttgggagtaaatgctaggtgtgttttttttttaacaagcatggctgagtagtctatattttgctctttgtatattctttcttctcccttgtacatacatccttttattaatatattttcagtagggaagggatcttccctcctgtttatgtcgaaagacagaaaactgacatgtatcttgtactacatttggttaacctgaccgatccattacattcaacggataaaacaatttgagtttcctactaaaatgttttggagtgagacttaaagcacatccagttctaatgaacatccaaggagatgcaagcgtcttacagagtaatataagcagtataatgattgatgggctcaacttaagactggatctagatgtgtgtgaaatttcagttaaaggtgtcaaatatgaatccactctatataatgacagtacgacatattaggctatattcatgaagcagaatgtgtgatgtgccaaattgtcaaagtggcaaaagcatgtgccatggtatggagggataacacatgcaacaaagctaagaatgaaataccttctgagcgtgcatttgtcttcagagttttagtaaagacagacttttcaaaggccaactttgacgcattactagaccaatcatccgagaagtatttcacggcaacacgtttcccttcagaatccagaagcaaaatgttcttcacagaagggcaagattcctgtgtaacgaaaatggacaatcatgaatcattacatgagcttgtgcaaaggacagaaaaagttacttaatgctgcatttcatgttcatcaacaaaagcatcattgcatggaaaaacaaagttaaacattgatagaatgaatcaaataagaatgctgattcagtaaagagtacaaaaataaaaataaatgatatgtattttttttttaaaaaaaacaataaactggatcgataagggccacttgaacacccaagcaaatggattgaatatatcatatctaatagcaatcctactgggttccatttctcatataatagtgtttcttaacaaaaagcttcgattaccacattttagtttcgacatgtaaatatgtaatacaggattaacgagcattctaacatgtactcaagctccttagctccatacaagagagatttaacattgccattcaatattaaggttgatcttcacacaaaacattacaaccatactctggcatgtttggcattgccgcagtaataatagtttcactcattcatgatgaccagatctccaccgctagtaattaacacccagtacattttgcaaaaaccggttaccaagcaactacatattaacaaatgataatccacttaccttggagaattctcccatggcctcctctagatccccggtgccttccttcctgtggaggagacacggccaccgaaagcagtaagatcaaccacttgtttggcaagatccaggctcaaaactgcaaccagcaaaatattttttttaatttcttggaaacaaactgctgctgctagtcagggtcgatctagagaaggttaaggcgaattaagagaaaaactgccagatccaggggagaagacaaggtgaaggcaaagagaaaatggtatgggcagagagggttgagagaggatgcgtgtcgggggctgatccaacatttgggttgaacaaacagactgttacttgtattaaggttaacacaagcaaattcgagacaaaagtacttccggttggggagagcgatggatcagaaagaggatgtggatgctcaccaggatgcagcgggacgatggcgcacctcctccgctctgctctgctcgccggatggagatgggcgcccctaccaaccctgctctgctcgcgagtcgcgagatggagatcggcgcaggcgctggagcggaacgggacgggagattttcaatgacgcagaggggacgggggaaatactccagtactccagatttatgtgtttttcaatttttatcatttgaaacatatttttcaaatatacctcaataaaacttattttaaaaatggatcccctagcctcctgggatatttaaccttttacctttttaagatgtagcaattaattatttgctactcactatctatgatatgtggggcctcatgtgtttatgatatgtgggtccagtggtaaaatcttttatcaccactcataagattagcaaataattaattattccttgggtagatcttattttgcacatcttcgtgataaaacttatttcaaaaatggatcccatggcatcccctagcctcccatgaaagccaagatcttgtttggcacggcttcggatctcatatccacgatagatttgaagtttatatattaaattacaatggtttaaaattttaaacttcatctgaaatgtgcgcaaaataatttatctaaatattatcaacataattgtagatcttttgtggagctagaaatacccagctctaagaaatcttggatccagaattgtcccaaagagagcctaagccacgccaatatcattagcgctgatgacctatttgtaaaaaaaaaatacttatttgtgataaaaaatatatttataaataggtcatcgatgtaagtgtcagtgacactgataaaagaacctatttgtaataaaagtattaacaaataggtcatcggtactaatgtccaacgatattggcaaagtccccctccatataagtgacttagcatccatggggaagccgggggattgcgccaatgtcattggcgttgtcatgttggaccacgacgccaatgatgttggtgctataaaaatgatctattgttggaataaatttttttagtttgtttgtaaaataagtttttaaagatctaaaatgtacggcctaagatttcccttctctctcgcttaattaaccaagtgttactttgaaccgccttgttcacttaaagccaactatattatacattatttacgatgacggctgacccacatgtcaatagtacttgggaagaaaaatataaggaactaagttagggatgttggcaacaacgggacatttaactccttgccacttttaagatgtggcaattaattatttgccactcgttgtctatgacatgtgggccctcatatgtctatgacatgtgggtccagtggcaaataatttagcaccattcgtaagagtggcaaatagttaattattcccaacaacaaactcaagccatcggcaaccactaacttaacattgtttaggaacagcgttaaaagtgatagctccccggagatggtccgctttatgattctcatgtcgccgaaccatgccaccatgctggatgtcagatccacgtcgatctgcgccagcttgacggcgttgttgggccgcaacaatgagatgcagtcgtcataccagtacagaagacataagacatgaagaattaaaatgcaaagccaccaagcattattatgcatgctggaattaaaggaaataactcaatattccatgtcaaagtgtcatatacttgagcatctccattgcgggactacaacacgtcaccacctcttactctgtcgtctccgtggaccatagagcggatgcgctgtgccaaaatgggggcgaattgggtaaaggcagaaggggaaagtgaaaaagagaggggtcgctacaggtggaaaagtgaaaaagagggagcttgaggtggacaatacatatggctacaggtaggtctcattgtattctaggtgatcgtctagaaatagacaatacattcgatattcgttgatatacttttgggctaattacttgtaggcatgaatcttggagtgatctaaacttttctaaacctaggtgtgcctgcacctaggtttagaaaagactttctcagctgcccatcctcgtaggcctcgagagaaccagtggatcttcatgctctaccccgatgacgacgatgaactggtcagcctctacagcttggtcatcctctctctcatagtctcatcgcttgcaaagtttcacgatgttcttctgggatgccatggccgacacgtactcctattgcgtcagctatggtggtagcaagtattgttgctcacaaattaagtgtgcataggttttactcctaggtcgatggttttagtttgttaagttgttaggaaggattatccattaaatctagggagtcatttatctagagaagtagttaatccccctttgagttataaagggggcactcgattgtattcttcggcaagcaagattaatccagtcaagttattcgcacgttattaagagcctctcactggccaggaagagccctgctttcggccatagggtgattgtgagcattgtcgctatcccctctgaaaccgtccactcgagcacttgttgcttcggcagccgctacaatatgatcttcaccgtgcgcgtatcacttttattcagacctaggcaacatctaaatagaaaacatacctactagattttgtaaaatgatatctggacaccacattcagaggccacatattaattcttgtagaatacaagaccatatctaatcctttatattgggttaaacataccataactgatgtcttacacaccgaaatttttagaagatgagtggaaacaaaaaggaataaagcagcaacatattgtcctgtcattcctcctgcatcctgagatactgagcaatatacctgacctctgcatcttccacatgtgcgttttgttgacctctacatggtgatacatgtgtaaacagagggcgatgacggaaccatagaggcagagtgaccatagcaagccatcaaagaggcattcggagggacatggaaacaacatggtagtgaatagcccctgccagacagcaaacatctgttagaaattttcgattagagaaccaacataattcactgaaatgtccaaatgtaaattcattttaatattccaatggttttaataccttagaatggtccatattattggattgaagccgtaacacaatggatctgaattacctatcctcattcatgtttttttgctcagagatccatctctctagttcatcacctagggcgaagacatgtttgccaacttgtttagtcagcctaagggtgttgccacaaatttggctctgcttggtgctaagatcaatatagagggcgtggtctcccaggcttgcttctagcctgatgcctttatacactccgcctagctccataagctcgaccgcttcgtcgttgctctgtcacaaatggtgttgcacccggatctagagaagatatgagagaaggagaaggagaaaaaacatgtgcagattgcactaaatctatcaaactcacaaattgatatatgaccatataaatgggtaaaaaaaatcacatcaaatacggagtactgcaagggaaacgagaaccaattaccatcatcctccatggccatgcggggtgcttgatgagcactccacgtttgccatcaccacctctcctgagaaggtccctaactaactcgatggtgctctccctctcgctgcggttgcgactaccttctcgacaaggctgaaccctgggcggaggacaacacagtccatctccctgttctcgacgggttgctaggtctagtcacaggtgtgatagaggccatgagttccatggtctcaccgtcgatatagtagacatgacaaagccaagattccaagcacaagtcggtgatgagacaggcacatggattgatggtgatttggtaggagaggttccgcgaggcaacacggcacgtggtgggggcgatggttagggtttgattgggtagggggcacgagcgaagctgttggcgggttgaggggccgatggcagggagaagccgatggtagggtgcggtggagggagagccaatgtaggggagatctcgacgacaggttgggaagggagagcagctggtagcactctgctgttttgtgggagcagaagaggaacacaaggatttacgcatgtcttttcacggtggtaagacatggggcactcaagagagatggggtggatcatgggatgaatctcagttgctggatctaagatcctgagaaggatgtcagtgtttgaagggagaatcaccatcattattacggtctttttagagcaaggtcgataagagagccaactgatagctgcactggcttgctacgtcatctatagtaagcactatagcaagtctattcaatagaggttctgtatcacaaatattatttttactattttcatgggatccactatcttctctcattctttctctttcttcctcccacctcttctctttcgttcttccttgtcttctttgccttcggtgggtgctagttcaaaagacggtgatgtcgccgacggttgcgtcacggtgtatgatgacgggggcggcaggacatgatggacaagtgcaacgatggtagtgtatggaggtgacaagagcagttgaagcggacgagaacaaggatgacggcgacgcggcaaacaagggcgatggcctgtggaacacaatggtgatgactaggggcggcccctcgtccttgagccaagagtgcagctcgtccggttatctctatcatagatatcatttattattatacctacttttataataataaagattgtttttattttagaacctgaaataagtggcaatatttgggtgactaccaaacgggatttctgcacgtgactgtgatgtttttttttcccgaaactgttgatcattgccagaatgtcaccgcgcgagataggtgtgagtgtgaccgtgtgcgggtctgacgagagtgaacgaatgatttcttccaccacctaacccccaccgtctctccccctcccccccaatctcacaaaccctagcccccatgtcatcgccgccgccgccgccgccgacggaaatggcggagggcgaggtcgagagccgcgactgggcggagatgccgtcggacgcgctcgcggcggtgttcgggaagctggacgtgaccgacctcctggtcggggccggggtggtgtgccgcgcgtggcgccggctcgcggcgatcgaccccacgctgtggcgccgcgtggatatgagccaccagggagacatcatggaggtcgacgaggcggtggccatggcgcgcgccgcggtggaccgagc

SEQ ID NO: 60693 - DNA, 8401 bp, Oryza sativa
aacaccttaggaaaccctctagtacaagaaagaaactctacataaccaatcgtaccaaatttggactccttccaaattcgactccatatcccatacgcacacaatacctccatcatatgccatatggaatctccatcaaccacatgcatcaactctagcataagtatcccgcatgatctctgaccaccacggacgtcgtcttatccccaagccgactcccggtccatcaccgcaaatactctcccgaggcatcaagtcacctacacatgaaaaaaacaaagaaaccatattccaagaccaagctatctccaacttgactcattagtagcaaacaacaatattacacacgtatagtatccatctagaagccataatcatgaaataaactcagatatccaaacaaacaacccgaaaccaaaaccgatatagtgtcggccggtcagaccacgggctggccggtccgacggcacgatcaccgccggtctgaccggcacacactgcccgatctgaccggtcacataaactaacaaacctgcgattcacctgtaaatccaatcatctccaaaaccacttcgtgaataaattccaaataacaaaaccaataatctccgatgccaattgttcatcccagaataataatcaaaaacacctttgattttacagatggcatgcctcttgtctcacggcacttgaggaagctagatttatctagtctagaattaaaggagtgtttccttaacttctcgagctgccctgcattgaaatggctatctttctctgatcattgctgctttgattctgtaaagaagatcgtgttccaatcaatagaatatctttgcttctacttctgccagttcagtgagtatcaccacactcacatttatgcaccaagcctcgttggactccatcttgaaggtttctagggcaggacaccttttctggaaagcatgccatcattagttgcagcaattgttacacctcaccagaattgtgatgatcgttgtagtaatacttactctggttattgtgaggatgaaaactgtcatggttgtcatggtatgctaggtgagactggcaatgatagtgccaatgtgtgctcctgggaggattatcaaaagctaagagtttgaagttggtagctggacctgaaatggtaagcctacgttaacatcttatctcctttatgttatttgctgcgccttatttctgttcccttaactatattcatcattttgacattttaacaatctctcttttttaatgcattgctactatcttgacattcaaattgttgtattcacataaaaaaatagttgatcttctcgcctgcactttagctagcgaattttcagaagtggtttaagatggtgccctttgttaagcaggttgaaaactttgatacccaatgaggggtgtgttgccctgattggtggcctctaccttgtattctcaaacaatgtccagttctaaataagctcactcttcgaaattccaaggtatacgtttttacaattgctgcactagtgcccaggcaaagttattgtacatgattggttgaaagggaaaatgtttcccccttttcagaaagcttaatgtatgatagaaacataatgcattggtgaaatcagctgcaatatctgaacacctcaaggtgggaaaatcgtctgtaaagaagctgatgatggggtttacaaaattgtgaagtgctttaggacatggaagttattatcaaaaggaggaatcagtcggcaaaacgttaactattgaacctcttcattctttcattttttttctaaaatttagatttttttaatctgggaatggaagaaagaaataactaaaacaaaaatacagatagggaaaggagattaaagatccaatgtattttgttttctactatgattcatgaaagtatacagaatttattttcctgttgaacttaataatataaacagatgacagtatgcggacttctaaaatggatgagagtagttctagacaataacacaacatgttgatttcggaatatctcttaattgtacatgttatatgacctcatacggctacttaatctttgaaaattaataattgctccttctctttaaaagatctttcggtacctgatatttggatgccatgtaaaatttattgtgctctacatattggcgcgcaaaatctatttcgagaggcatctcgatttagacttaacgagcgatgcagacaattacctgagaagtaccagtagcggtatagacatgcatgcaagtagtttttctattaggttgtgtgttttttttttcttcttatgaaattttctcttaaactactcatccgatctatgatccgattacaccgttgtgttcgtaataattaaatctttacaacaagatctcacatgattatattttgatgaaaaatcacaaattacttttatgatatgtctaaattacttttatatttcactaagttacttcttagacatataaaagtaaattcagtaaaacctaaaagtaatttacatatattatagaagtaacttagaacaaaaagaaggtaacttcggcatgccatttgaagtaaatccgttgtagagataaaaacatgactctatctaaaaattaaattaatcagcacaaattatagaattaactaaaaacaataataaaagtaatcacctcagagcattataaatgtataggaagtattttaatcaaatctaaaagtaacttatatatatatgataattatatatatgataatttgttcaatgaaaaaaagtattaattaaagttactttctttttctttttgttataagttacttctataatatatgtaaattacttttaagctttactgaatttacttttgtatgtctaagaagtaacttagtgaaatctaaaaataatttagacatatcataaaagtaatttgtgatttttcattaaaatataatcatgtgagatcttgttgtaaagatttaattattacgaacacaacagtgtaatcggatcgtagattggatgagtagtttaagagaaaattgtatttgaagtataggtggatggtatcttttatagatgaagtggtagctgatttagataaaccagctaccactagctgtgtagtcacgtagatattggcgcagtcttcaggttcggggaagggaatttgggttggagtcttgatgatataacttttagatgaagtaactgtttcgactgtctgtgcacttcggtaatgtgataggaacatactgtaactgcgttgtatatgtcacttttactaattggacacctttcataccatggtgtccttttatttgaaagcaactgcagctgagcattttcttctcttttgttatggaactagtatggtagttggtgtagattacgcagctagcattgctgtatatatatatttataatagcatatatactttcatgttttattattaaaataatactaaaaacaacaatatgattttaaactgctgcataacttgaccaatatgattttatatgtctgatatctatggtaagtcttatgtccatcaagcaacgtgatggatcctctagtactgtctagtactgccttagtaatacaatatacttataaaccatggtagctggatgattatcgttaaatgctatagaaaaggtcattcttcttccctccatcttataaagttttaaattattagtgccatcttttcactatctgtagtgatatccttgtacctactaaagatgatatattgtatcttatgttcataatattttataaaccgtttcagataagtaaatgaacactttttcatttcattgtcacgttagtttagggttggaggatccaatctcatctgttagttagttgtaattttatacaacttagacaatcaagccatttttgcttctcttattaacatgtgaattcaaagaattttcaattaaaatgaaaacttctatgtatttttaccttctagaattaatgtgtcactcctagtaaatcctccaattaatataaataaaaatatagactctactcccaatattatttattattttcctagatttaaaatatttctaagttgtcctcatacatgaactcttttccttaatattacttgtttcaaatatgaattagatgaacttatttctccactttatttattagagtgaatttattttataattccaattttagatatttccaaattgtatttctatgtggactcttttccttaatactatatatttttaaactaaacttcagatataaatttgtacttatacactgattcttgtctcagtatcaattattttttagtttttaatacaaattttgtattttccataaattgtatttctacatggactcttatgtcaatatttattattatttgatccgaagtttaaatttttctaaattgtgtttctgcttgatttggctttctcaatacacacaatctgaatgaattattccatctgcccctatcaccacaagcagcacttgagtggcaagatcctcattacattccttaaaacacaactataacaaatctccatgatcaatggattggaacagtgtatgctacgaaacaaaaaaggtttattccctctttttcgctcatttccctcttggaagagcaaatgcacaatgaaactcaaggtcttccattggatactcttgatggaccgttcaaacacgagaccttctgcaaagaaagaatctccactctaaataaggaactaattgggtaatatgcaactcttttcatacagaagatgtgctgcacttattctttaattgtcctttggcagttcaatgctgaaattacgtcggaatacagtgggctacaaactggaattcatgaacatggtggtaacagcaaagcaaaattttagacatccgttcttcattgaagtttttgctatcgcgttatggaacacatggaaaagaaggaatgacctgattttcaacaatatcacaccttctttcaatctttgtaaactactttttggggatgattttactcttcttttgtttagagtaaaggatcaagaccgtcaaacctggcaaacatagattggcaatttgtaattttgattccttcccctttcccctgtacagtctcttgtaattaacattctttaatctaatttacagtagaagcctctcctactgtttcctcataaaaaaaactgatatagttcaggtggttggttgggcctgttcaacgtggtgtagctttattcagtggaaatttactgttttaaactacaactgtttacaaccgcctttatgcaaatagtcacaaacctccttttgtctccccttgcatgaatgcattattggtgtggtttgtggtttgctgagtacgctggttatactcagccttgctataattcctctctttcaaaagtttagtgtttctgttctgaagatggtgttagaggatcaaggattatacccagttgagttctgcttgtggagtggagctaaagcctgctaggtgtcgtgccccgaaaatacttttcccgaacgctacacttcaacaaccatgatacaaaagacacatctttattatatggttgagttttgcagtaaaacaatattttaaatcacttagttgcccaaggtaaatttgtaaatctaaccataagagtaattaagattattaattaaggccgtgaacccacacgaacctgccttaacccaagggcctacgatgagttagaccgaactggcagccttatagccaggccccagctcgtcccaagtcaacctaggccaaccattccaggtttttagttgattaaccaagttttaagagggaaaccactaacttgggtacattgctagccttggccatagccgagggcgcaactatttgaatagattatactctgattagatgtgtacatcttttacacagaagaaacacctttactctgcattctattgcaattggaacccatcataaaaacgtggcataacccttcacccatcctagttgtgaacaaaagtaccgacgcaactccgcctacggccggtatcccgggacaggtaggttagggttgagccccacaacatcagaacatccctcaggagtggccaccgagatgcccgtcctatgccacgacaccttgattatcgaaatactcgcccgataaccttcatttgtctcagagatatccatcacccgactttagccatctctattcgtgtccttttgttcatgactagactgagcaccgagttaagccttacccattttagacatgtggttagtatgatagtgctttgcaacagaggctcgagcttaatccttatagcacccaaggtacggctatcaaaaccaagccacgcacctcgagcccagcctaaaccattttgggagttttgaaaggggaagagtgtgtccagagcttgtcattaaacctcagtccaatgtatccaatgatgtttgtgaaacaactcccaaagtctaatgctgtaaaacatctaagggtttctaattaagcagggctaaacaaaagtctagcaagtactagtgagtgccgatctatagagttctcactagtagggttttatttacctaggattgtcaaagtgataatcttaacaataacgagtaataaggtcataacaaggaataataggcatggataagtaaaacaattatttgtaagaatttaataaagaaaaatgcaataatttaaatcaaaataattttataaactgggaatcaatatgctcaaagatgatacgacttgccttgcttagagggaacggtcttccgaacacgaaccgcgcttcggaacctctagaatgacaggagctacgtgaagcacccaagcaaagctaaaccctataaagaagcaataataatacataaaaataaaagcacagggttctttagattatagcaaaaattaagagacttgaacggattgattcggagttcgtatgaccaagatatgatcatccgaagtttaatgctgttatatggagcttaattaagttttgtaactataaaacatgtgtaactccagcccggaaaagaaaggaaggttgcgctattgacctgtggaccccacatgtcaatctaaaggaacacggtggactgagtacacagagacggtccacgggccaacggaagcggaccctgtgtgtcaaccgaagcgagtggtcgataaacagaacccactagacaccacacgggctgcacacgtggacaacacgtggctaccgagcgggcacacaaacacggtcatcacacgtgcatgcgaaggctgtgcgaatgattgccgataatggtacccaggtatcgatttggagttcgtatgaccaagatatgatcatccaaagtttaatgctattatatggagatttacgggctattgtaattaagttttgtgactataaaacatgtgtaactctagtccagaaaagaaaggaaaggttgcactgttgacctatggaccccacatatcaacctaaaggaccatggtggactgattacacagagacggtccattggccgacgaaagcggaccacgtgtcaaccgaagcgagtagccgataaacggaccccactagacactatgcgggctgcacacgtgaacaccacgcagctatcgagcgggcacacggacacggtcaccacacatgcacgcgaagcttgtgcaaacgattgctgatactggtaccccagtaccgggaccgacaactgcatgacgggcacgggggtgacaccgaggggatgaggacgggtgagtgaaggagggatcctcaccacaattggaagaggcgtagaacgaggacgacgaacgggcacagcggatgcggctcagggtagactgacgacgatgaggagacgactctgggcggcgaccctaggacgaaggtgagacgagaccggcacaacgcggagccaaggacgaagacgacaacggggctgcagcacccttgacggaacgaggacgacgaacgggatttgcttgacggagggatgccacgacgataaggacgacaaccgggaatgacttggaggaggacaatgttagccgtaggcgaggccaaggtggaatgtgttgcggcgatgctgacgatgatggcggcacagcggggggacgagccggtgagaagaaacggccggccgatgggacgtgggcgaggacgaacgttgacgacgacaatggctagcaagattcgtcccatgtggaggcgaggttggggatggccttgccactgcgatgataggggtggtgatggtgtggtcgatcggcacacgggcaaggaggaagggccgatcgaagaagctcaagtgaggaggatggaccaggcacgtggcggtctctgggccaaaccgacggcagggtctggggagaggaaag

SEQ ID NO: 60694 - DNA, 29156 bp, Oryza sativa
atcaaaaaatacccttaagtttttaaaccgggactaaagatgctttttagtcccggattttattggaaccgggactattgtggaattggaccgaccgaccaaagatggtttctccaccagtggcgggtgaccacccaggcagggttgcctacttgcgtgcggagctgctggtgcctgcttccttgtcatcgaaaaggaatactccaagtgttccgaatcttttcaccttgttgaggacgttccaagtgttccgacgttgtgcttagaattgtcatcactgacgtcagcaatatattcaagagtttcgatatatccaagcttatggagcatgttgtgtagttacacacgtgctacgtactacatgcatgcatgtatccgatattagtatatctgaacatttttttctatttatggccacagagaaaaaccacatcataaaacatatcgttcagaacaatcgcatcgagaatacatgtatgtacacttgtagacaaattgtcttaattttgaaaataatacattttctcgatcggtgcatagtttcgtgctttcgatatagaaatggagatggctcaaaaaataataactaattgtgaagacgacttgttcgttcaaaaaataaaattgtgagatgacccgcgttgaatttctatgatattcatccattttaaatttctctgactatttatatttcataggaaaatgtgtacacacagtagctaggtatagaccataataattaatattacacatgatttgaattctctgggtccatccggaaacggaaagctttcttttccaacaaggattcgtgctggtaattaactcatcgttcgtaaggaatgcaacactgtcattcctatgggcgcaatgttcccgaccggaataacacagtaattcttgacagttgaaatacgagaaattcgataatatctacatgcatctctcaatcaactaagtgtacgttgatgtacgctacctgtatatatgaagaccacttctatagttaatatagcatcagataaacattttttacttaacacataaaataaacatttatatatgcagtccataatccatttacacaggtattttttccaagctgccctataaaagtgcccgtatataaatcaaggatttgtgcgggcggattccacaaccgctgactcccttaaggaactggccataaaaataaattttcagtttaattttgtaggcgcaaaaagaatcctaaaaaatattttatattttagtagacatgtagtggaaatgttcatttgacgaggtaaataatctgaaaagaaactaatccttagctggtgagaaaatcttagtggaaatgttcatgagattatctggcatagcttcaactactgtgctgtgaggaaacaaaagtatagacactactgtgaattcgtgatcacaattcacaataaggttagggtccttccactttccaattcccagttgccaacttgttggcaaattacacagacagagcgaagcacggaaagatgcaacttgccctctaactacacaacgtctgtctccacctatatataaacccttccatctctcccccacacatgcatagcagtgctagagagagaaacaaattaaccaagaaatcctcttaagaaggatactgacagtgcacgccagctagctaatcactccaccagtttcggggaaaaaatatcaaggatttcgagatcctagctcgctagcaggtgatcgatcgatcgatcaatggccctggtgcagtcggcgcggcgtgccgcggggccggcggcgagccggctcttctcgacagcgtcggtggcggcggccgggcgctcccccgtggctggcctgccgaaggcgctgccgcggccggccatatcgtcgctgtggatggtcggcgccgccgctccgccccgccgctttgccggcacggcggcggtgggcggtgtcgacgtgaccgcgccgacggcgacgccaccgccggcgaaaaagaggaatcggagaaggaggcggcgagctactggggcgtggcgccgaggaggctcgtcaaggaagacggcacggtgtggaagtggtcctgcttccgggtacgcatgcactggcacagcacgttgattaattaattaatcagttaacaaagctccgttaatcaccgtcgttaaagctcgctggttaactcactctactgttgaacagccgtgggacacgtacgaagctgacgtggcgatcgatctgacgaaacaccacaacccggcgacgctcggtgacaaggttgccaggtggacggtcaaatcgttgcgctggccggttgacctcttcttccaggtaacccttcgctttcctcatttctgtatcgtttctgaaatgaaatgatgtagtacaatctaatacaaatcacatgcaattcctgaatctttaactatgctgctgcctactctacatgcttgcgagtcgtctacatatgcttggaattttttttcttagcatagagatcattgatttgtttaactgaaaaattaatcaaggatcattttcgaatcggcgaactttacagccgaagatctggaccgtccagtgaattcagttcagctggatgagttcggaccatacggctgagcagcttcgaaagaattgaatttgaatgaactctcatacactcgatcttcggaacagtgatctccgggcccattgatccactacaagcccaagctcaaatacggtcctgttggacttgggccgaaccgtgaataccggtgaactcttttgggtaatcctgttgttgggttctatgggccctggcacgaaacaatggccgggccgggccgggcttggtagtcttggactgggcttcgggttccatttgatatttttcaacctgcaagaaagaacatgcttgactgactgacagacaggtaaccatactctgttttcccctgttctttcgagctagtactaactgctatcgtcatgacccgggtgagattgtaaatggaacgaacgattactctaatgagattttatcgtgacgaagcgattaattcgtatcgagagttgataattgatcagattgctaatcaactagtagcagcaatgatgaatgaattctgatggtcaatttggttcgcagaggaagtacgggtgcccggcgatgatgctggagaccgtggccgcagctgccgggaatgtggccggcgcggtgctgcatctgcgttcgctgcggcggttccagcacagcggcgggtggatccgggcgctgctggaggaggccgagaacgagcggatgcacctgatgacgttcatggaggtgtcgcagccgcggtggtacgagcgggcgctggtggtcgccgtccagggcgccttcttcaacgcctacctcgcctcctacctcctctcccctcgcttcgcccaccgcatcgtcggctacctcgaggaggaggccgtccactcctacaccgagttcctccgcgacctcgacgccggcaagatcgacgacgtccccgcccccgccatcgccatcgactactggcgcctccccgccgacgccaccctcagggacgtcgtcatggtcgtccgcgccgacgaggcccaccaccgcgacgtcaaccactacgcctccgtacgcttccctcactccctcaccttgtgttggacgatgcatcatgtctcgcaatttcgaagcaaaacaaaaaggagaagaaatttgaacgaattttgctaactttgtccatggctgtggatgtgcaggacatacattaccagggtcacgcgctgagggaggtggccgcgccgctcggctaccactgatcggacggacggacacgatctatcgccattaagggatcaataaatatccggagacaataattgtagtattatttggacgcatgcaatgatcgttgcagttcctctcaacacttttgtgatatttcagaattcagaattttttactccttgtgctgtgttcgttgtggttgtatatacagctggtttgttagtttactgtggtgtcggtctcaattaagggatgtgaaaattgattggaactgtgaaccaatttattttacatatatgatactatatgtcttcttgttggtttcgttagcactgatgcaattgcagtctggtcgtttttcggaatttcttcccgcttatggtggtatccgtgtataatggatatttagggtgtgtttgaggagaagggattggggagattgggaagatacgcaaaacgaggtgagccattagcacatgattaattgagtattaactattttaaacttcaaaaatggattaatatgattttttaaagcaacttttctatagaaattttttttaaaaaaacgcactgttcagtagtttgggaagcgtgcgcgcggaaaacgagatgattttctctctcaattccccagattgcccaggaacgaacgaagccttagaaattttagaaattgggatttgagatacagatgatgccttctatgaacggcatattttttttcaaatcaaaacaaatggatgaggtattttcggcgcgtcccacttcagcatcagcgtccagtagttcatgcatgggcgccagaacgcgatgttgggcttgccagacactatggcggcggcgcaatacgggtttctgttttattcttttacaacattatacagctctacaatgtactgctgccccacatttctcaacacttgtacagttcactgatttgaaagattcagaacaggaatgttccatcttctttttttttttcgaataaggaatgttccatcttttttttttcgaacaagaaggaatgttccatacttccatctacatttccatggtatatcagtacaccctgtcactgcttctgatggtataaacaggaatttgagatgcaaataatggcttatgctgtcatgcaacagatgaacgaaaatttttgtctccagaaatggatgacatatactgaaactatctaagaatagtttaaagaccgatgggaacaatgagaagcataacatggacatattcagacggttttaggtagcctgacaagagaggcgtccggtccaacaaggttcaggtttacacaagttaataagagataccaactttaataagagaaatcaacttcttcctgggcacggtagcacgtcgtcgatgttagacaatctcaatgtttcatcactcaatggtcattcatgtctcaaattagacatttctaacctgacacttatgactcacactatgagttgaaagctccaaatttttcacacagaaaatgtcagtataaagcatccgaattcagaaggaccatgacatccacagtttatacctaacaaactgttcaaaacaaatccatcgttgtccagaacaacctgaactgctgatttatgtttcattttagcactgcaaatacgaaccagcttcacatttctagttcataaaaacattggaaacaatctttgagaaaagaagaaaaatcagaatgaacatggaagtcttaagttattaatcagctgtcagaagtgagctagaaaacttacagggtgcatcattcagtaactaagctacgcagagatcagacgttctcaaagaatgttaaaatgattaacgtcacaacaaaggaatcaagcattgaaacagaggcatcatgcatcaatagaagaaatagtaacagaggtcacaaactcagtaatcagcacgattgccatgggtcaggaaaacttttaccaaaacctcctaaccgcgagtctgaaatattgccagagataagcatcagtaccaaaattttcattcatgtcatgatgtagtaacaatgattcatgtctcatttcaccagagtactgaaaaatctgcacaatattgctgtgtcataagaacatgtgaaacagtcgtgcagaaatgatgaaagaatcaacatgaaaatagcagtattaagttactaatcaattttcagaagtgaactaggaaattgtagcaaggcatcattcagtaattagaaaaatgcagagatcaaagtttctcacagtagaatgataaaatgatttaacagcacagctgaggcatcaggcatcatatcaatggaagaaacagcaagacagatcacaaccttactgcatcatcactcatcagtatctaatcattcatgtctcaaacctcactcaaaacacattgcaaatttttgaaggattaccagatctgaattaccagaataccgaaccaacctgcacaaaattctacccatcctgatgttcctgcagtctcagctgttccccttgtttgattagttgctccataaaccacttacgactaagggcctcgtatgggggcagatagaaccaagtccacggcgaggagtctgatggcggctctcgcggcaggcagcggactatgccctgctcgcagcatctgccggtgtcgccgcaggggaacgggccctcaacctgctgcacctgcgaggtcgagctccctgcgccgttgaacctcgcggagtcatccaggaagtagatgttgggagggcactggctagatttcctcatctcgacggcgcaggagcagcctcgcacgaggaagatcgtccggtctgcgagggtgtccaaggtgagtttcttccaggacggtggcttcagctccagcttgaagacgtcgaacgccaccgtggccttctccgtggagacgaacctgacgaccatgagcagctgcccgcgggattccacgaggtagcggccgagcacctcccctggccctggcatggtgggtcggggatttcggcggagctggtacttgttcacggatgacatcgtgagctcgccgtgcctgtcgttggccttgggggtgtacaccaggaggtcctccttgttgttgagaacatagaatcccccaccgagcgggccgaagaagatgtagttggcgtcctcgattgggtccttggatagctgcttctgccacattttgaaccccgagtcccacttcagcatcggcggcacccaatcgctcatgccggggcgccagaacatgatattgggcttgccggaaactatggcggcggcgtagtacggatgagcctgacatggggtataggagaggatgacggcttggatgtggttgatgaaggtggtatcagggttgttgttgcggagggatctcgggaggaggacgcgctcgccggtgcagaggttgagcagagcgggggcacgattccccgggacagagcggtcatcatgcggaatctcggcggcggcgacccaaccttcaaggtgggcgccgcagaagcgcgcgccgcgggcgttgtccggcaggcagggcccctggtgggtgcgctcgcaggcgacgcagaagaaggaggtcgcgttggtggacggcatgaacaaccacggttgcataggcggcagatgccgcatggcgatggtgcgccaccttgtgcagacaccggagaacatggagtggtcagggaggcaaaggaggtggtggaggatgccggcgacgcactcttcggggagctccgcccacgccatgtttgcgtcggccatgggagggggaggaggaggaggaggatgagtttctggaaacttttggatgggattgggaatggtgggaagaagaagaagagggcaagtgggaagattcgttgggaagggaattgctgtgattttataggctcctcgtctgaagccacgcgaatgctaatcattttcttcttgcttgccaagttttcctattgttctgcatttccattgttctacactgatctccaagcattactctgttacggtatctgcttgttctgcattaatttcagtttattgtagaagattatctttgtttatactatagtgctttctatattcaaagtaaaaaaaattcttctgttctgatctttcacaaaatttacacagctctaagatgcgttgctgtgttacgaacccactccatgtgatttagtgaatttatgcacaagcaaacaattcttcctccaacacttgatacatgagtatttggggatacaaatagaggaaatggaatcaagactgggaatcagctgtaggttgaagaagaagacatagatagagattggagaagagaagagaggtacagaggttgaagaagagagagcattagaaggaagaagtcaagttttatctgttctattctgtactgttttggctctgctccttttgtagtggctggagtggtcggcttagcgcagcggattgggcctagccagccctgagctcaatatgcataccaatccgacccaattacataacattctccccgccttgaaaatcagcttgtccccaagctgatgcaattgaagctcaagatcagtgcctccaggatcccagggtagctgcaagtgatcatcaagagctaatccgtaagcaccagctgatccataaaatgcaaccacaagagacgactccatgccaatagaagtgacaaaacttgcactctggtggatgcattgcacctccatttgtccagaattatagttagggatcttgatactagtcccaagctttctatatggaaggacaacaaatatggtcaatgatagagaaatgctagatactgtgcccacttggatactatcatgagcattcttgtacttgcaaactgagctgagatcaagagtatcactccctcccttcttcacttctgtagaaatttggcaagctattatagtaactaaattgacaatacctggatcccaagatcttattcttgtcatctcagcaatcttgacatgcacaagcttcactgccaattgcacagtcccagcatctaggaaatttatcagggcaaaagcagataatagccatgtcctcccaactgctacaacatggatccatttgcttggcatgacaggagtccctgtcacatcatacactatattttcagaaacactgcaatatacaatgctgatttgatgacagtatagcaacatcttatcaacaccatcaatttgttgctttatcattccttgaaaaggaaacccttggtaagctggagcatccaccatatattttctccattgataaggcttgctcaagaaataattagctgagaatttgaaccgacaccaactcataacttgttgaaccagtaaattttcattctcaaatcgagttagattgtagcttgaaactagctgtcccaatgactgcataggcagagcagtatcaatcatatctccaactaaaagatttgaaaaactgtaccaactggacttgacaacctcacacttcagttgctcttccagtaacatccgttcacccaacaattgtagaccttctatggtagccttggggaccgaatagactgttacgataatctgaatctttagtttctgaccatgtagattcagtttttccactttagctttaacttctgcttgaataggtggtggccagggctgtaagagcttcaccaccacgcctccgctgccttgattaaatatatctggccatggcaagaatcgaaaatccagtgggactgccagtctccagggaggtactacttgcggtctagctgtgaaatctgcccctgagacaaaatcatcgcagcagacctcacattcagaagagacaacaggaaggttggtgacaacaatgtgattgctccggcacaaagtcaaacacacatctgtaaatggtctgaacacaaaaatgagcttggtatccaccttggtaaacttgacacaattatcagtgaccataccaccgacatcaccatcaaccttttcctttttgctttttgtcaaacccttggttggtttcactgtcaccatactaagcttgttagtgttgacaagatgagttgagttagcctcattactgacctctgataagatgggtactggatcaatgttaacgcttagtgccgtggcatctccattgcaatccacactcacggtataatcctccttggtgttacggcatgtctccaacattttattgatcatggccatcatcttagtgttcaagtcctgagtggttttctctgatttcaacacctccttgtccatgccagccccaacatccttggtctcggtggaaggtgccggagtcgtcatggttgttgatgaagttgaggatgccaatgaagctttagtggctgggaacacgcgttctgttgcagctggtatgctcttggcccctgacgtggtggtggcataacttggtcccaacgtcgaacacttggtgggcatcacgttagcaccatttccagggaaagacgcgtgtgctggacatcaagcaggcaacacccatcgtaaatgttgcgttcattggtgtcagatcgagccctttatgcgtcatagcttgaccggaaccagactagcgcctcaatgccccaacaactcgtggcgagcacttgcaccgccactgctccatagccgttgtagacttgatgtagtacctcgctagtcatcgggtaaaggacttggctcacttggacacgaagaacagcgccagcaccagctcccagccagctcggcatttctccgaacacctggcaggcgcctccagtgaaaccacctccaatgcttggatctagcctctggacgtcactgctgccactgtgtgtcatccaccttgccttctggtatggaatcccacggattgttggctctgataccttattgttacgaacccactccatgtgatttagtgaatttttgcacaagcaaacaattcttcctccaatacttgatacataagtatttttttttttgcagggtgatacataagtatttggggatacaaatggaggaaatggaatcaagactgagaatcagcagtaggttggagaagaagacatagctagagattggagaagagaagagaggtacagaggttgaagaagagagagcattagaaggaagaagtcaagttttatctgttctgttctattctgttttcttccccatttgttggctctgctccttttgtagtggctggagtggtcggcttatcgcagcagattgggcctagccagccctgagctcaatatgcataccaatccgacccagttacatgacatgctgccccacattcctacttgttctgttctttcacaaaatttacacagctgtaagatgggttgctgccccacattcctactgatttggaagattcagaacagggaatgccccttcaatctaatacgtagttaatttctataggcagacatcactgtcacaattttcatttccattctgctgattcaagtaactaaactggtttcatttcccacttcagtgcaaaaattgaagaatatgatattcgttcctgggcaatgcatactgtacttatttcaatttcagctgagattaatgaactcacatactcctattgtaagtaaaaacttgccacagtattatccagagaatgccagctaaaattaatgtaactccgtagccttgtgattgaagtactgaaccattaactttcttcagttgcttaagtttagggatggcaggcaagaggcaactttcataagtcctatgtcattctgaacaaaacactgaaaatatacagcagttcagacaagcaactaaaagccagtcatcaacaattgatcaatcagtcaacctgtagcagtcttcagttgcaactcaatcaagggtcacacaagttaacgtgccagtagaattctaatctgcaatattacaggatatcaacttcttcctgttgatggcagcacgtcgtcaaattcaggcaactcagtgcttcatcatgcagcaacagccactcatttgaaaccagacatcgagtcacttacaacacattgtgaatttgcaaggtcaaagttaaaagaagtgttcaaaaatgccattcatggttaatacacatgtacactgacatgccaaatgtcagtttcaaacatccgaattcaaaaacataatgacatgtaacagttgtactacttgacaaactagggaaaacaaatgtaagaaactgaagttgccatggcccatggagaaccaaatccatcgatgttctgcacaaaactaaacagttgaattatattttgctttaccactgaaaattccaaccaggttcatacttcaatttcgtgagaacattcgaaataatctttcagaaaagagaggggggggggggggggatatcaacaagagagcagctgccataactcataagctcaatcagttgtcagaaatggaactaggaaaacttgcatcattcagtcattaaacaaatgcagagatcagaattcatgtagaacattaaaatgattaacatcaaaacagatgcatcaaaaatcaatggaagcaatggtaaaagaggccgcaacctcagtaataaacagttaaacaccatattcaggtcaggataactccgaactgcaagtctgaaatattgtcagagataaagtatcagtaccaaatacttcatttatctcatgagatagtaacaacgattcattaattcttcatttctcactcaaaacaaattgggaaatctaaaagcgttaccatccctgaattaacagattactgaacgtgtccacaaaattatatcctgatacaggtgcagctctgtgagttttctcatcacttggaatctttggatcagagctctgtgagttttctcatcacttggaatctttggatcagagaccatctatgcatgttctagccgatggaaaaaacccaagtccatcgccaggtgccaggtccccgcaccaagcaccatggaagctcgcggcggcgtcgcagaagtagatgtggagcgggcaggggttgcacaaatcgacggagaagtagcagcctcgtctgaggaagatcctccggccgctcaggggcgccgattgcgagcttcttctagtgaggcggctgctgcccgtcgccgtgctccagcctgaagcgcatcaaacgccgtctccctcgttgagacgaacctgatgaccatgagcacgaggttgcgggcgagcaccaggaagtacatgcatagcgggcaggggggacctcttcctgatgtcgtcgacggtgacgaagcagaatcggcggaggaagattctccggcctcacagcctctcgggagggcgacacactcgccggtgcataggtcgagcagcacggggccgcggccgcgcgactcggggagctccgcggcgagccaggcacccgggaaggagccgcagaatctcgcgcagcgcgcgtcgccgaggagcccggggcggtgggtgtcctcggagacgacgcagaacaatgaggtcgcggcggtggacggcatgagcagccatgggaggttacacggcgggtgctgctgctgctgctgctgcgcgatggatcgccacggtttgcaaacaccggagaacatggcgtgatcgaggatgcaagggaggtggcggaggatgctgatgaggccatgggagaaggagaagttttgagtctgcaaactttttggtggggatttgggggaaaaaaaaaagagtaccggagagattcgttcgggatacgagaaagcaaaaaaaaatgatatggttacacgttttttttcatgaaggtacaataacataacagagccagctgtaaatatattttaagaagataaataagaaggagaagcggggtacagatttatagccagcagtagtatgaactcccagacgcagtgtgaatgacaggtgggaccagatattaatagtatagtactccctccatctacttttgatagtcatagttcatcttgacacacagacaaaggataagtaattctacttatcatccatttaaacatggtactagtcattcctcgtaaccaagcgattcattaatatttacatttctcaatacctatgtagccaatcatgtgtggaaaaatggagagtcacgcaataaattcgagaaaatcattaagagaataggttgttggattgaaatatgcctatcaaaaataaaattttcaaatttagaaatatgactatcaaaattagatggagaaagtatataattattgtatgaatgagctactccctctattctataatgatcatttcgttgtggtatcgagaccaagaagaggcccactacctattttctatttaatccttgtaattaatctccatattaattggctttgagaaacgaaacggcattactgccgctgcatgattacacatgcaagggatgttccgtgctgcatgcagctcgaaaatcgcatggcctactcgatctccgtggtagtaactagttaggccctgtttagatcctctagttttgccattttatagtactttttgttattttggatctaaacactagtagtaaaagttgacaatttgtcatttagcatttgctagtatatagtagcaacttgtactaaaaagtgctttgggaccactccctctctctttctctctctcactttagtgctagaatgtcaaaactttaatatgcatctaaacaccaactaatacttttgcaatgccaaagcttttgccatttgccatttgctattccaaataaatctaaacaggcccttaatccatccaacatgcacatgctaccagtgttaatacgctgatcaaatcggaatatctctacttttgttatgcgctgattattatgaaatggagagagtattaaattggctatagttaaattagaaccagtagttgattatactattaaacttgctcttatgtagctggttttttttttttgaggggaaagatgcaggagaacagatatcttcagttaattagtggtatgcaatggtcagtgggagaagcggagtttcagtttctggtaatgtcgcagaacacctaagcattgctgctttttcttaattgggttggcataataattttcaagaaaatcattctcctgctggggatttatttttttttctggaaaatcattttcattggctgttggtataacacaagcaccagcaaaaattattttcactggctgccctcataaggcagccgctagcgaagacaattttcgctgcggctgtctttattcagctgccaatgaaaatatatttttgctggcgactgtcttaagacggccgccagcgaaaatatttcttcgcttatagttgataaccgctagcaaagatgttgatcttcactggcctttgctttgtggcggctctaaattctgccagcgaagacccaaaatggccgccacgaaagatggttttcgtagcagtcctattgcgtagttttgattgcctgtgctttgtgaaaagttgttgtggattgggaatcattaccagaatcagcctatgtggtagatggatgacttgcgtggtcagaaacggatgtgatccgagatgtatgcgggcatcatagactaggcttcccgagtggaaacagattgttgtgctgcggggcagcgggactcctggagtccgagaaaataaaaaaggctcagggagccgcttaatcaagtgaaatggctccgtgagccgagaagtaatgatccgacctaagaagtcggtgcattgccatttgagttgctgaaagcatctctcttaagtcgaatcgagatgcaagtctcttttcgacctaaacttaaagaataaaatcacttagtggtttcaaatcaagtatttgcaaaacaatcttgcctctctttcaagcttgcattaaacacctaagttcccgtgacttgctgagtacataagtactcacccttgctctctctctgtgtgtgtgtatatatatatatatatatatatatatatatatatatatatatatatatagttccttcaccctgaaaatgaagtgaagagaagattagggtttcgtcctggttcccagccgttgcctgtggtattgggtgttagtccattggttccgctgatgttgctgctgctgttgttgttggtgttgtttcgtccgtgtcgtaggttgcattctcgggctgtcctgagtaaataagtcctctatataatttaaggattgcaatgattcataattgtctgcatggttaccagcgctatgtccttggactggtactcagatcacggtctcgtaagaagcggttcgcgccgtttttcctacgacactattggtatttcttacgatcacagataagatccgcaagcgcacggatataccgatgtagcacttcccctacggagtattccaagagtatcgaatccaagggaacgtgtgtgattatctctttctccggttcattcaaggacacaaagctaatgtgggcagaggacagaggatttcctaatgagaaacagtgtctatggaaagcttaactttaatcctaacacaatacttcaggcactggcaacccgctgttcccagatgttgctctactatgtacccggacagggaggacttaagtgctcttgagggctgtcaccacctctacacccacctcaaacgtactgtgggatacgcagcaaccactggagattaattacccagacaccgcgtctacgcaattaataactacactagtgctgatcaaacaataaagcattcactataaataaatagactatagtgaacaatgatcccgtatgctaattaggaactaactaagaagtaattctcactaagcaaatcttaattattcagaatgatatttctattaaagcagagtaattaacaagatacaaaagtaagaggagattaccgacaactccgggatttctccgattccttctaccttactatatccctattataatatataataaagtacactagagcctcttgtaattcagctcatactttggtgtgtgtttacaagtgaggatgagaggggtatttataggtggagaagtgccttgggagtgtggagatgctcgaagcatccaaagagcatcttctctcttgtgttgccaagtgtccaagcttatgacggtttctaccggtgaaaacggccataaccatcattgggaggtggattgctaccgaactggacttgggctggggcgaacggcctctgccagggttcggccgaacccgggacggctctgttcgctccaattttcgtcctggacactcattttgggcccctcaattcattggtatgaatgtttggcccatttggaggtgtttaattgggtttatgggtccaaaactccttaagttcggatacgagtttgattctcatcctccttcatgtatatttcctctcaaccttagtagtttgtcacctgcatatgaatatacaccaacactcgtggaaattgttagaaataagccctaccactatgttggatgtttacaattatggtcttatgcagttattgacggcgttaatttggtacttaacagccgtcaataaacccccacacttagctctttactcgtcccgagtaaaggttaaggattaatgtggaataaaatttcccaagatataatacaagtatacaaattattctaagccatacctgtacgtgtgaacttttgaagtgtctaacttaccatcttggacaattgatgaatggaacggtcgtgactcaagtcctcctttatcctcctgtcaatctcttgggttttttatatatttttgcaaagtagctatactcctcgaataactctctcaaatcactcacgtggtttgatttgtggatcctcaccaaggcatggttgccgatttgtccctattctaaaaggctgtataggtggagctcggtagggatcaatcggggcatacctgcatcacatatattgcaaagccaaaataccggacccaaggagatagcaagtcatactctctgattaagaatgtgcatgtgtgtgatatgtgtatgggtatgtgtatagaaaattttgtggatggaaaaaggaaaataaaagataacaactcctttgtatacctcctcctccaattttctctctttggaattttgagagtgcatggctatctcttttcttctctttttttttcatcatgccccgtactttgtatgagcaagattcaagggaaggctgttatgttgcaatcggttttgttttcaagttttcaacaatctaattgtgtgcttttccacaaccaacagggtaaaatgtaaacaaattgattttcaagtttgcacaacttctagagttggcctcaaagttggttttcccaaaaccaaaccaaatttccaatcttttggagtttagttgtccaaaataaccattcacttctagggactccctatcatgttgtctccctgatagccacttgcttttccaaacatcaggtttcccaaaacacaacaccttttcacaaagcaaggtaaaacgaaaactacgctaaggaatcacctcatatccacccatgatcgtgggcacggctatttgaccagtttgttaacctctgcagagggggtacactttacctacacgatgtcactaacctaggtcacctagcccatgcagaataaccacgtctggtgactttgaggctttcacgacaaggcatttccaaagccgactcagggtcaccttatgccaacgggaggggtccaacgaaccaacaacattttagtttccagaccatgttgtgccggaagccaaggggacctccacaacaccaccctggcgaatccacttgtcccttggcatcaaagcttccctggcctagttagttactcagcctggggtgtcccacttcacctatgcggtcgcacttgttatatgcttagatgtaatcccaaaggaatcggtccttaaaagcgtgatcacttacccctacttggactatggttttaataatcatattatgatcgtgaatataatggcccattgtttaaaccgctgccttcctagtggtatccgtgcatttgcatatttatctatgatcgtaacaaataccaacaatattagcttgtcgttttgtgtaccttggcttgattcatgggaagggatttaaattttaatacataaaatagtttgaaaattggctaatttttgggcgtaacaattttctctaaagatgtgttttacgttacactttcctaaccttacatcttcgttttccacgcacatgcttcccgaagggctagacagtgtttttttaaaaaaatatgtacaaaagttgcttaaaaaatcatattaatctagtttccaaaatattttagctaataattaattagttatgtgctaatctgccactctattatgcgtgataggggttccaaaccttcacaaaggaacacaacctaaattgtgatactaactgtattaaagtttgtaactagacatgcagaaactgtactctctacactgaatgacctattgcaatcaaacaaacctacaatttatccgataaacctatacaattcatccttagtattgtagttaatattaatttactgcattgaagttgagacaatcagatcaaattaggagagccattagatcaaatcgcaatggcttgatgtgcatccctctctattcttctatccaactctacatccaaattgtcacattcgttggcttccacgaccatcaaagctacgagagtaatgcttttaatctggtaaaattaattactatgtggtgactgttaccattcccattatctagtttatatgtatgagaaaggtgcagtgatgtagttatatcatgagattgggctataagctaacagtgtggctggtcatttgtgcagatgagatgaaagggcaacttcatctgaatgtagacattgtcttctctaacatgcctacggtgaatttgccatcaaaactggatcatatttcctcaaagcagatccttccatgaagcaggtggtcccagttcaccaaataattacaaaatgtgatgcatatttttgtgctgatcaataaaacaacaaaatttagatatcaaaatctgcaacaatgtaatgatggtatgcttactatattaaatgtttgtgaagcaacttgtacatcccattggtagcatatagtacatccgtagctctaggaggctttgatggaaaaaagaccatatctgtctgtgctatgccattgctttctaacgtttctgaaagttgagaaattttatggaatagccaaagatgagaacaaaggcggccataaagccaaaatgggcaagtataacatatcctaggaagtcatgtcggacgccaacattatcttccaaaatttggctcattgctacatggctcccaccaggaactgaaatcgatccaccgttccctccaaactgtgatgcaatgacaccatatattgtccaggatactgggtttgcccaatagtaccacctccaccaaattggtattgcctgtaacacatacaccaagttgatgaaggaacctagatacactaaatagtaaataagtaaaataacaacgaaaaagaaaactttgcttgctttaccttcctaaaaataaggaacccagcaaacaagttccaaagagggagtgcaaaggttatgagaatgttcgcaagcagtgcagatggggtgcatgccaccaacatcattccgaaaaatgtgaagtagttgaagcttgaaacaatgaagaatagaaaataaaagaatttgctagctttccaatcgtatccgatcattgcatagatgatgaccgtgtacaaaatcccttgtatgatattgtaaatgaactccacgcttgcctgcgtagatcaaccatataaaatcaaccaccacaccaaaaataatggttgattctgctgcaactctttcttgagtttgtgtgattcccagcattttgcattctattaagaggaaaaagtaaaacgttcacagtcttgagaatggatggatttagtgacaacttagaaatgatacaattgtttctctgcattctaaaagttaacaacttttccaagagaatgtgaaatagattgttgtcctcaaatttaagagaactattgtttactagattagaatggtatgtcatcaacctaagattaaaaaaagaaactagaataagtacacaagtgactactctttgctaatactattttaaacttacgtttgtgctcttatatttgcaagcatatctagttctctaatcaccttttattttaatagtttttcaatatcttggagtgccacagcattgatgtccctttttatttggaatgttttgaatataaacaaaattgtcagatttcattcaaaatggctgataaatataaacaagcatgcgatgttacctgagcaaatgcataggacaatggagagtacattcctgctgcgctttcacgatagtaaactgctctctcaattgatacaacaggctgaactgacatgcagttagtagccccaatgaagaagattgcagcataagtggctccgagtaaattgtacaaatcttgctgtgagtctctgtgcattacatatataaaacacactttagcccaccgaagactataatatggtatcaaactatatttccaagtagagaacttacaactttgttcctttttgccaaaatactgtgccaaagaaaaggccatagagaaacgttgttagataacgcaagctattgtaagatggattcttccaataagacttatattgcttccataagttcgcaacacattggatatagaaactttgagaatattttgtagcaaataagagatctcgatagcctggtgggggaatgctcaactcctcaataagttcttggtttttcctggcatatttaggaaaggtgaatttagtatgagtcgtacaaatgaccgcttcaattttttagaactcataatcatttttatgtaaacaaaaaccaataatacaaaatattgtcaaacaaagtttcaacaattgagaatgcttacctataaagcagggaattggcataaatttcagcaaaatctacgttcatgcgagcttcttctagagtggagctaacttctagcatccatgttgcaggattatatccttctgtaatacttggaacacctaaaattgtctgcacaacaaatgtatcttttgtgataaatataaaaatttgttgcaccttaatggagttgaaccatgtccatgtttattgactttcatagctaacatatcatactattaatcagagtgtgtattcaacttcagaaagaagcaaaacataactgaggtcaaaatattcaactagtttatgtgagtggtcaccaagttcaccagcataaataaccccgacctcctcttttcaaaaaccaaagcctggataaataaccaattgaaagttcaagccattgggggactcacaaactatgtatgaatagttcacatatccatgcataaattgcacaaacttaacatagtagccaaacatagagacaattgcatgtgtatgtgagagaaacctcatcaaaagactcaaaaatatcaatgcttggctgatggatcgtgcagaccacagtacgcccagtgttgacagtatttctcacagttcgcatgacaattgctgcagctctagcatcaagaccagaagtaggctcatccataaagatgattgaaggatttgctaccagctccacagcaattgttaatcgctttctttgttcagtcgataaaccgctaactccagggagaccaaccatagcattgcacaatacatcaagctctacaagggccatgacctcctccacaaacatctaaatttattaaaattgtttatttgatcagaaataaccatgttgggagttttaaatctgcatataaatgcatattaagtgaaaatgtggcttagaaaaaacctttcttgtattgctatcaacatctgagggaaggcgcaaccaagcagagtagagaatggattcatatacagtaacatttggtgaatggatatcagcttgttcacagtagccgctaatgcgagcaaacgtttcttgtttcttggagtaaccagaaagggttatgcttccttcaattgttccactagttttccttcctgctaagacatccatcaaagtggtctttccagctccactgacaccaactaatgcagttagaagacctggcctaaaagcaccactaatatcagagagcagttggagacgactttccatgagtccttgttgcttcatttcctaaatgacaaaagatagcacatgtaactatataactataactatatatatatatatatatatatatatatatatatatatatatatatatatatatatatatatatatatatatatatatatgtacttataaattgtcatacaagtcagaatttatttcaaacatgaaatatgaaatgggtaaggtatgcttactgagggcatgtccacataataatttagatggttgaaacaaagtgacaatggttggaaaggtaagacaaattgtgactgagttggcctatttccttctccgttagcacctgctgaaacaaacattgatatttactattgttggaagtttgttatcaacaacttggcatgttacatcattatgggaaaggtccaacaaacgtagtttggactgaaatttttttctgcataattgtattattttaatatagataaagatgatcttactcgtaggtatcgatgatgttgtggtggatgttcgggacctatgctcttcatttcttgtttccgtgtacaactcagtttcattgtgttcatcaataactagtgcgtttgcacttctaatagctaggagagccaatttttgaagtataagtgcccaactgaatagataaacaaagtaataaacatgatgaaaaaacagtggtgcttacgacttaagtatgtaagtgccaagatgtataaggtgttgaacaaaataatgaatcctactagggctccaatggatagccaaaatccccactctccagtgaacaagccttttgactttagaatagcctcacctaccgtttttgcatcaatggttgtgtcattgtttggctgtaataaaaaaaagctcatacattagttgaattgttgccatatttcagggtttgtggttacctcactatgtatttcatagatgtaaggaaaaattactgataaaaacttacaatggcccacctactggccagaaattcgttgatcgatattgcattttggctatacatcataggagatgcccaataacaccagatccaccatggtctaatgtcatctggccacattgcaatcaaataggaggttaatatcactcttgcaaattaaatgtaagtgcaattatgtgatttctcatgacaactgaaataaaaacagatgtaatatgctagatgtttacttacttttacgtatcacaaatcctccaaagacgaagacaataagcaacacaagcatcccaaaactaattgctataaccattgtttgcaagatagcaccaagaaatcgaaacagagccattgccattaggtgagtaacgaagaaagctagaaactgacgaaagaacctaaaattaatcaatagataacttttgtaagattctgcaatgattcatagcactaaaagtcaaaataaatatgtcaggtatgtcgacggatttttagtaccttcctgctgctggtgcaaatcccatcacatagtacgtgatgacaacccagaccgtagcctccacaagagatacaggaacctttattagtatatttgcaaccccaaaggtccatggagggaagaataaaaaatctctatgcttgtagaacacaggaagcttctttactgtcaagtttagctcagaaaggccattgaacatgactggtattaaaatgaatgtcaatgccccaagaaatttaatgccctcagaaaattgcccatggggcatctttgttctaaaaaacaccggcattgacaagaaagccagaatgatcaattgggtgaccctgaatatttaaaaaaaagaagtgcgtttcatcaacaacttctctctacaaagcacacccttcaatgactcccagggggataatgcatttttcattgttttggtgcagcactatggattttggatttttcaaatggaatatgttgctccttcatcatttggtggccaatataaaatgacttgaaacgttctgcaaactctgggactgacacataacaataaggctccttgtcaaggaaccaatattgttgctggtctttcttggaagtgacctcttgaaggaagtcagacactgctttcctttgagggcatcgaaagccagaagcttcaaaaaattcgatgtattctcgcgtggcccatgatagactatgtatccttctgatagtagaactatgtggtcaaagagattatatgtctctggcggtggttggaggagagagatcatcacagtttcattcattatatggaccaaatgcctaataaattttacaatatgaaatgtgctagagctatccaagccagtggatatctcatccatgagcaaagcccttgccggtcctgttaacatttcccctaccaccaagaaaagtaataattgtaaacgatatacattctatgactaatttttaatataactgtcaagtttctacctgttgtcacacgcttcatttgtccaccagaaattcctctaatcatctcatcaccaacaatagtatcagcgcaaatgtccagcccaagcacctaacaatgttcaatgatcatttcttgttatttcacccctaatagattacatgcaaaaacataacaataatatcaccttgagaataagatctgttatgatattagtctcttgtccttgcattgcagtagctttcatgaaagcatcgatctcagggtctggcttaatgcctgcattgcgttcccttctagagatttccgtgagcatgtcgtatcttgacccaatacctaagcaccacctagagaaatctaatgtctctcttacggtcatctctgcattatggagatcatattgactaacataggcacttgtccgctctggatagaactcggaaaatttatgtccacaataggtgatattaccaaatacctagattgtgatagaatgaataagcaggtagcagtaatgcatcataagcaatataaaatagtaatattccatgagatgactggatttgaatagaaccttgaggtttttatcaagtttcccagtgagcgctcgcataagtgtgctttttcctgatgatggaggtccaagaaggagagtcatcctgaaaataatactagtcagattaaccacttttttctacttatcatattatggcattaaaatttcttacaactaggtgattccccgcgctttgctgcggaaattactaagcaattctcaagaaaatatctactttcttgtatatacatatatttctattagtatatgtatgtaaaattgattgaatgatggttggaaatagtaaatatgatatgatatcttgattgtattattgtccaattgagtacctgattaaatatatagcatttagatggggtggtgattcatggcgttgtttaattggtgaggaagtggaggggacttttatctaatggctaatactagaaagacttgtcgatccaacggttgaaactattttgatgatgtggctaaatgtggtgcctgtttgtggtctcacttatatagaaagcatagataagaagattggtttctatctgaaatgtttcgcaatctcctctatacccctgaattttgcctcatcccctacatgcccttgagcttttatgttgatctcttctatccttattccgttagttgaccatgagttgactgttaaatttttctaaaatgaccatattgcccattttccattgctacagttacatgctatctactctacttcataattcacaatatgaaaaattgtaactcatgataaaatcaaatgggacataattatttatttaaaagaaaatttaaacttttgaacaaatttattttttttggacaaaatccatataagagttttagctagaaattgtgaaccaaaattatttatttgttgggttcaaattttgatgaacacaatgtacgaatatcatgaaatttaatttataatttatttaaaaaattttgatttatttttaaaattgttgtcaaataattatattccctttgtttatttacaaatagattttttttcatataagaattgtgtttttatcattaaactagcacataagtataaaaaaaggggaatataatcaatttcaaaaatatttaatgggtaaactaccggcaactaacggaatgggcatagaaaaaaatcaaataaaaactcaagggtatataagggaataggcaaaattcaaaagtacataaaggattggatgaattctcaaaggtacataagggattttctcatatgcttattatactatacagggcccatggtggtggcaaaatgtagccaccaccctaaatctataaacaaatatattgaggtggtaaatcgatcttgcaactgtaggtggacctcaacttttaatttgtaaatgggccaccctcaactatggatagaccctcacaacacattgtaattacacacaagtataataaaaccttaaatctgcactcctatttccctgccatgacaattcatcccttattctccggtgcactgctcccctctcccctcccctacacacacgcctctcacctcatccttctaccccaccacctaatccctagccacaaaagaaggtcccatccatggagcacactaatagttctcgaggatctagcttgtctattgtggtggtggctccagaagatcttgaacggctgcggtcatccatccctccagatcagctagcggaactgtcgatagcagccaacaactatcttttatcgagcagattgcacatttttctagattttattattgttatgcacaaaacacattggactaggtattagcacatatttttttacttttgactaggcattgttactaaagctttcactttgtactatttgtccacaagtaatccagtaaatcttcccctccccccatctcaagctcaatcaatggttgcatcagtgtcctattccgcctcaaccacggtcaattgaaaggcaatccttgaacctttctacgatggtgccttggcctcttcctcctccccatccccaaatcatggtttacttcaaaccactccttctttttttttagttttttgtgttaccaaatgtaaatgctgcaaaatttaggtgctaaatgcctgtagaccccgtatgtaaattctatatttctagttgcaaatactataagctgaatggtttgtgaatgcaagagtaagataagcatatgtcactacttttggaaatgattcacggtcatgatttcttcatgtatgggcattttatttattaacaactatgaggaaactaatgattttacaacttcaggggaggtatttatagtcacaatgggaattcatagctcgtgactataaacaggtagtggtttaggatttcagaagaaatggggtgctggtaccgccctcgggcttcaaatagcggtaccaataaacaggtagttgtattgccagaatgctaggcatattagaacaattattagtcattatcttagggaagaaaaattggttatgcttaggattccctggcatgaaaactaatcagttacatttttctggtattaacactaatcaccagcccagaagaggaaagaacaaaaaggaaaggaccatgttgctgcgagcaagtgtttatatgaagaaaagaatgggaaattcgtttaataccacaaaatatggacattttagttttactgcagcgaaatttggtagtacatgttgatattcaaattttcttcgatttccattctcaaattttcttgggtttccatttcaccactattgttcttttcttcctgtgcttaaggattttcatttattttcatttggtgaaataccaaattttcccctacagaaatttgttcatctctaatttctcaacatgtggcctttggaagaagaggcccagaaatcactcaccacattccatctcaacgtcggatcttggatctcgatcatcagctggtttgcgaggtgagcaccctttgttgtccagctcaactctatcaaccctctccactggccattaattggtccatatcttcctcagctccttaattgccttcactgaatgttgaccatgccacaacaggtatggcgtgaacaaggcagttgaaatcaactgtgcagaggtgtccggttaggcattgagtcgagcatgtggaacacggcggtgtgcagaggtattccagtgttggaaataggacac

SEQ ID NO: 60695 - DNA, 3813 bp, Oryza sativa
ttccatttacaaaggctaataatagttattgagccattggtaaccgtagtaatgatgtttatctatcctctcttctccctcctgtatatcagtaaatattcctaataaacaaggctaagaacccattactaatgtccacactgtacatgcacaacccatcccaatgaatttcatttagaaaattcaatccctatgcatcaatttatctattatattattaaatcagccttaaaagaagacatcatgtttgctatggaggctagaaattcctacattaatcgaagaaaagaagaaatatctaaaccattagattttaatgcattagattaaagggtgtagatttatcagaaaaaaagttctccaagtatgaaacaaactctacttaatacaaataggagagtcagtcttatctctcacgttacgtcacgcgcaggcatgcatgtttgagtactgattgtatttgggctaggatattgtccgaatgggggaaagggaaaaaaatggataccacatggattccaaataggaaaaataaaatcaaacggacagctttgatatacagatgtggaatcggattttgaagtgaaaaaatatcaagaacatcccgagatcaggccatcgctaagttaagtagcatggtcacggtggttagcgagacttctaaaagtaaaaaatgtaaacccaatgctaatcatgtttgatttttaaaatctcaaaaaaaaaaaagaggggaaccagctggtaggccgtagaggaaaaataaacaccaatgatagtcatgttcagtttttaaaatcttaatgaaaataaagaggagatgcagcgggcagctctagaggagtacagtggcgaagccgctaacggtttaatgaaacttttaaaaagtaaaaaaataaacccaaccgataattatgtttgatttttaaaatcccaatcacaataaagagaggagacagcgggtgggcagtagataagtataatagcgaaaccgctgacggtttggcgggatttctagaatgtaaaaaaataaacccaaacggtaattatgcttgatttttaaaatcccattgacaatgaatagaggaggcagtgaatggaccctagaggagtatagtggcagtatatttggtagcacttttaaaaattataaaaacgaaacccaacaagagaatgaactctaaaaactacgatgtccaatttttaaaggttccaaggactatggatagaaatggtggtagatcaaaaaagcaaataaaggtgtgacaaagaagtaaggggtaacgactggcatgacttttaaaaatataaaattaaaaacacggtgatgataaggtttgatgtttcaaagtcctaagactacaaggcaactattaaacaaaatttaagtaaaattatatgtaagaaatagataattttatttaggtgctagccgcgtaattgcgcgggccacctagctagttctttctcaaaggaccatgcaactctctcgtctaaaggcttagttcagtagctcgtttagcttttgcaactcatttatctatagcacccgttctaaaccaaaaaaactttttatatataagtttattttttaaaaaataaataaaccaatttttaaatttattataattaatactcaattaattatattttagagactagccctattttgcatagcacaaacattccaaacaaaaaacccacgtttgaacggaccaaatagtttgtaatcaagaaccatttaaaatctttatgaaccattggaaatgaactagttctataatatatctctaaccattacaggctaagaaacattagtggcttcggttaaatgttatggcctagttctataatttgacttcgtttgattctatatataatatactatcgtattttgcataacttctctgttttaccatcgtcctacttctacgccatcgatatcgctcactgtgtagatttgctatattgaggaatgatattaattataaaatacacttaaaatttttgcgttctatcattagatgttaatggatcaatttattcattaactgttggtgatattttctctctataaaatagatcagagcaaatatatataatacttcctgtctatgtatattgacgttattttaggactgagttgggactgatctaaggtagtacgtgcctggagaaagttgatggcagagttggaaagggtgggtagggcgcggctggcgacgaaggcgtctgcctggacggagagctcctcgtaccgaatttcgatcttcggaagttcaatgccaaccctgcgtgtatgcagcagcaggaccatgtaaataaacgcgagaaattgaacaaagaaaataaagacttaactgggcttagttggactcaaacttttggcgagacataaaacaaagagaaccattatagaatgattaagtaagtactattgttaactataaacttaaaaagtaaatttatttaaattttaaaagaaatatctatatagaactttcttttcaagaatatatcgtttagctgtttgagaaaaatgtgttaaccgaaaacgaggtagcagttgagctgaaaagctaagtagaagacagcgtgacatgtggtacaacaacgtacgcaggggcggaatcaggcatggggcagctagggcttgagccacatgactagctccataatcccattataatcttgaaaaatactaatttatgaaaatatttgagatctcattagctcagtcctagacgtggaaattttctggctccgccactatacgtacgtacatgtctatgcggtcccttagccggcgcaagaaccgctcgctgtcgtcctgcaagaggcgttccacgagggcgcgggcggcgtcgccggtggcaagcctcccgatgtcgacgagctccaccgccttgccggtgcccgcgtcgtcgtcgtccttgtggtcgtcatcaccatcacgcaggagcgcgctgcggacgacgccgcgtcgcatccggtcgtaggtgggcagcttctcgagcgccgcccaccgcaggtcctcctcctcctcgtcgtggcccctcatcgactgcgcacgccggaacgggtcctccgcctccacctgccggaacgactgcgagatggcggaaccccagctcgggctccgtccgctcgcggacgccaccagcgccgcatggtggcggtggctcatctcgctggctttcttggtcgatcggttgattactcagttggcatgcagcaacttaactcaagcatacgctaagctatatgtgtatatatacgcctagatgccagcatcccacgggcacccgctctatggctccgtttttttctccaataaaagttggatgaagattaagatttttgtggcacgtttttcaaactgctaaacggtgtgttttatggaaaactttctatatgaaagttgctctaaaatatcattttaatctaattttcaagtttataataattaaaactcaatcaatcattcattaataccatctcgttttgtttaaaaaacttactccttatctctatcttcatctacagaagaaatgaagtacgaactatacgtgagtgattagcagctgctaataatttcccccgcagccaatgcttggctgctagctgaccagctgtccatcgtcgtaccatttgttatatacagtacattatataggagtacgttgatatacgcaataatcccttatatgccactaaaaattggtcggatctcttatataccactaaaaattggttctttccttatatgccataagtctaaatttgcgcaccttctcatgccactgccgtcagttg

SEQ ID NO: 60696 - DNA, 11761 bp, Oryza sativa
tcaactgacggagagtggcatgagaggttgcgcaaatttagatcaatggcatataaggaaagagccaattttcagtagtatataagggatcaaaccaattttcagtggcatataaggaattctatatgcacagagacaccccaagtgccatgcggtacagccgtgcagggccaccgtttcgaatgcgtgaaggggaccagaattccaaaattccggatgaaaatttgaagaaattttgctaaatttaattaaaaaagattccgctaatttttttaaaaaataaaattttcgatcgagaagtacctcttgcacaggtacccactggtaaacacaaaattttggaaattctgatacggtgtgtagtactgtagtgtactctctcctcttgctagatcaaccggttatgcaaaacaaagcaacacgtgcgtgtactacataagtatatggaccagtatgcttggcacggttgtgggcggtggcacagtacgaggtacacaccgtttttttcttggtaacattaaatggattgcgtacatgtatatatcagatagattctaatatttaatttgggatcggcctacgatcatgtactactactacataaaataattatataatagaataataaatgaagtgtagatgttggaaaatagagaaccgacatctataaatatatatttatatatagtacgtgttatatttttccttcgccctaaaaaaaactgaacttctatagtttaaattttgtcccaccaaaaactaacttctaccatcctacctactctcagcagaagttttatctctttaataccctttacctatctaggggtgaaaacggtacgaaaactgacggaaatcatctttatcgtttttattttcatattttttttcgtaatcgaaatcgaaatcggaaacccggatacgaaaacggaatcgaatattatcgcaaccgaaaacggagcgaaaacgaaccggcgcgaatacggtaacgaaaatttatcggaataaaaataacccctctaactgataaatctaattctcaagtctcaacggtcaacaattcatcgtaaaacacaatcatataagtccaattattaagtatcaacagtacatcacaaaacacaatctatggaacaaattagtaatgctgttgataaatcccaatgtatgaaaaaaatattattatgtaattttagatttgcataacaaatattatttaaaaaataatagccaaacaccatggtataaactattcagtgcttaaaaaaacaatccagggtatttctagaaattccgagaaaaaattccagaaagttttcgacggattgcgagttctgacggaaactgcccttatcattttcgattccgtgtccgagaaagtatttccgaatccgtttccgtttccgaaaaattccgaaaaaattctgaccgacagattccgtttccgaaaataggtccggaatacggaaaattttcgtaccgttttcaccccctacctattactcttactatgttttttatttattaagggcattttagtcattatcactcgccactaatttcaccttgggatgctaggattggattttttttggacggagacagtacttggttgtaaaaaaaaaaactaaaattgggtgcgttatagtttgtctgtgtgtgtcaatatatatatatatatatatatatatatatatatatatatatatatatatatatatatatatatatatatatatatatataaaataaaactggtgtctattaaggtgtggctttttaaagtgctccacatacacacaaatatttgtgtcagttttcttaaccgtccgataccacatatttttcttagtgagtgtaggagttgagcctatcacttcgttatctttatcctatcctctccctctctcacgttctcacctattcccgtcccccccacccccccccccccgcgcgcgcactacccttctgatgtgaccatggctaacacggatgcaaccattgctcacatcatggatgaacaagaagatatcgagatcaagtactccaagtgctggaatccgattcggccacctactacactactgacttcaaacggccaccgaatctgcatacgacctccgttttcggcctgtgagtacttgatggaaagctcttggagccctctttctaacggatccagcctcttctctgaattccatctcgtgtggccggaatcataggaacaaggtgctgcatcacctataatgggcctatgggcttgtaacttcatttgggacccggcccaggtggggcccatgtggggtgcgccccaagctgatggagcacgaccctaggcacccctaggtcatcctcccaccctatatatagctagttaccccttcagggtttctcgggttttgttagattaaagtttagccattgctacttgcttgcagcgcgcgtgtcggctagaccgtccgtctgcttgttcttcagaaccccaacttatcatttgtattaaattcctatttgcaatatcagattgcttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcagatcgtcaacgtttctcccaaatcgtagttatcacaactcaccgaaagatcgggccaacaacagccttgagtgtcgagaggaactcagggttcatcaccttcgctcctcaaagttgtgcctgtcgccacctcctcctcctcctccttccacttcatcccacactatgcgtgaatggtgtgaggacactagccatcacgctcgcctgggatagcctctaggccacagcccacatcctcgcactcctcggcttctccctctcctgcacctacacctgttgggatggcgatggctgcccctccttctctccaatcgggggcgaccggattaatcgccgcgcgcatgggggcggccaaatctgccacagcgcgcggggcatgccactcgacgactacagtagtagtggcagcagcgacctcctctctttgtgtgatcaggagctgctcgatgcctcggctcgaattattttttattcatggaacctcaaaggtgttggttccaaaactggaacctttgattcctccttgttagtggaacctactaggtgtccgttatgaaatcttgcatctatgtgtggttctcaaccggtacctactaaggtttttgtagtagtggtaggattagaatgtttcaattgacatcagcaaaatatacgttatgaaataaataatttagtcgtcaaaacattcaaaaaaaaactttgaaacacaataaaaatataattctaaaattttgccctaacacgtgaaatataaattttaatagttaaagcacatatatttctttcatcaaagtataaccatcttattataaaggtttaattgtaaagaatatagtggttattcataccacaaatcaggtaagaaatcttatttaatttcccttcataaatatatggatgaaaatgaaattcccaatgggacttttcagttcgaagacttttgatgtatgttatcattagctatcattgtcaaaactaaagtcataacgtacaatgcttcaagatacagatagtgtcaagttcttttgtttgctagacaaaacaataagtaactttgaaatatggcaaattttattttaggacaacgtgagtttgcaattttagctgtagacaccacaagagtaaaactttcagttgaagacactatgtaaatatggtaattagccattagacatcgcccccaatatttttatgtatttggcctgacaaaacaagagaaggcctacatttatacatggagagaccgaaatgcctacatggtatttggctatatggagttggattggttggaacatggcctgagccatcagtcttgaagacccacggtggccaagcacatctgtcatcataccgtgatggtggtgataacatcaaggtgaccactttctccatggtggccacaaggcgaaggtggtgttgaccgtgatggccacgatgaggcgtaggtggccacaaccgcatgatgatgatatattcttcttcgttttttgcctcacgtggtatagtgggagcccggagttcctaggtcagcgatcttcctcttgtgaaatgcctgttttgcaaggacgattccatggtagtgggatcggacaatatgtaagcaatttcccccaagtttctagggctttcactacatttcagctttaggaatttcaatttgattaaatgtgtgttgttgttgtgttttgcaaactggtgcacaatgtaattttttgatgtggcacgaggactatgttgtatagatggtgaagaaagggtggcttcatgctacagtagattgcaatgcttcatgctacgtcttgatgcttggagtagactggatcaatggcagcatggtcgcacactaagtgcttgatcagcattccgcgacagctcggacataatgtggtgaggtaaagctttagagtattgatgtagaagtgaagggtggatgatggtgaacagaggctagggtgctatttataggatggctggcaaagggcaaattggccttggccatggccatggctgtcggcatctaggaatggaatttctgaatacccgaagcataaaccgtctaagtcccatgattagtagatagtacatgagtccacaacctgatcatcacatccatacataatatgcatacaaatagataacatggttcacataacatagcgagtgcataagtcatacaatataaatagggtcgaccagccaaaagaaagagtttaaacgtagcataataagaatagcaaaatatcattttggtatacccatctaccaaaccaacccagaaaccgatagggaatcaacctagaaagaaccatcctcgaaacctcctacacggtgcaaagtactcgtccctaagcatttcacttccaacatcaatgtctaaaaaaaaacaataagaggtgggtcaatacatatgtattggcaagtactacccaaaccatgtgaagtatatgtctattgcaagctgagatcaaaggaggttatctttgtagactaaattttagcataagcaattttttattcgcaatagtaataattatatattgcaactaaatttgtaaagcaacaagtaaacaataatagtaacataagcatcataataatatcatacttgtgcactccatggtagcaagtaaccatttcattctcagctaacaccgggcaaaatcagcactgaatttacaccataccaatttcacatatcatttcaaaaatcaccaacactatacttgtatcatttcaccaaatcgctcatgaccatgagaacagttaatcaattagtttagaatctgcagagtttgtataatgtatccatatgacacaaaatagtaatcatgcaagcatgccacgcgataccgaaaggtacctgatttaacacttgagatgtagttgttacattcctcaaagtctagccttgcatcaacaatggtgagtgaaaattcacactaaggcatatgacctagcgttgttaggtagcggctcacaccttaaacctaacgccatagtggcaacccaatggttctgcgtgccgtattggacaaacttagacgcccatgccgtatcctgacacatggggtaactcctttgagttaaactcaacacaatagaatcatcatcaacacacatcataactcatattacttcagcctaccaaaatacaagcctagtcaataagcaacttagtaagctaaggttaccccaataaataacacatgtggttgcatgatacatcttagttggtgacacatagtttagtccttaatcgacccagacgaacactccccctatgtcacgccctaaaaatcccaaatttataaattgttgtttaaatagaattataagaaatgattttaaaagcctagaagaaaagatctaattttaagtaataaattccaatataaaagtggactagataaaattttattaaatacttctcttgattctatagttcctagatttttctgggatttatttgagccaagaaagtatttttaataaatggaattgcatttcatgaataatttaaaaggaaaaaggtttaaaaatccttcttttggatttgggccgaaagctagcccaagtctctctctccccggcctgtgcgcgcccggcccaagccggcccaccaagccagtccgcccctctctccctcctctctcccgctgacaggtggggcccacctatcagggtcgtcttccacctcccgccgccagccgcgccctagccgcgcgcaagctgccgccgccccttccaaattcggtcgcatctttcccgatccgatcaaattgatagagggaaaatgatcccttcgatctcctctatcttttcccctatagaaactttagctaatttcgtttggaaatcgtcggattcgagttcgattcagattcgatttcttccctccaaccttaaaccttccatcgcctccgccagacgccgtgggcctagccgcagcccctagcccctataaaaggacccccgagacctccgctgttcgtgccaccttcgccttagccctccaccgccggtagagctctagccgcgttagcccgtgcgccgccgtcgccgcagcaagtccagccgtgtgccctcgccgctctggttgtcgtcatcgcttggggaggttgctgtcgggttcgccaagtcgtctctgtcctcgtcttgtcctccgtttccgccgaagatcgccggagcatcgcagtcgccgtcgacccgaacgtcttcgccgcctcgacctcgccgtcgtcgccgtctgttgccgtctgtcgtcgtcagagccctcggtgagttcgccgcgtcgccctctacccgtaggtgctgtccgtttgcgccgctgcgccgtcgttcgccagcgagcacgtggtgccgagccgccgtcggcaatgacgtcatcgtcgacgtcagcgccacgtcagccgtagacccgcaatagattagatcgatctcggccgttcgttttgtttagattaaatctcagccgttcgttccgtaaaccgttttcgtgcacccggtccaccgtaaatccgagcccgttgacacaataaatcattttttccttttcaaaaataattctttatagcgtcataatccaattaaaatctatataaatgatttaatccggtttaatcttaaaaattcataactaattcatcttagctcggatttagttggttcaagtctctaaatttttctaaaattgagatctacatgttaaaaatatccacatgtgctgtttatgattgtttatgtactgttttggtgattttggtcttttatgtttagattccgatgttcccggagagtccgattttgcaggagaagactttgaagaattccaaggccagcaaggcaagtcacacatatcccaaacaaccctttgagcatgttgatccagtttaaagctattgtttctattcaactattgcatttatttttgaatgtcaccgggtgggaacgacatattgcctttgttatagccctttgttattgatttcctatactttgtcacctggttaataattggattagctagaacattatatggttttagctaaagtaattaggatgcttagccatgcttagagacgctagctcatatgaatgggataattaatgattcactattacttaatgatggtttaatggtagctcatgatggttaatcatgataagatgccaactaaaacatggtaatagtgggttgtgagcacatggttttgatggtcgtgctcatgacaattaaggaccggttcacgattttcggttgtgaaacattaaccgtgccaaccacaagccagcgtgggcaacggctttaccttttgtatagtgtggttcatcgcgaggcaccagactgagaagtggcgaagataagcccacgggggtcgctagggagtccatgccttgttttataagtgggtgattatgatacaggaatggtgcactgatttgaattgtgctatgcggagggtattgtcacaatctctattcgggtacttgttaagtatcgcgacgcatggttgacatgatgttaaggttgtgtcttgtgggtacagtggtacacctctggccatagtaaaactattcgaatagtcgtgcctgcggttatgggcgggtctaacaatgtcttttgtgattagtctcacacctcttaccataataaatgatgctataattggtaataacttgtttagctcctggtttggaatggtatattcctggtttggaaatagaactgggcagccgggaatggttgttcagaatggttgggcctatgcaacgggtatgttgtatagcgttggattagtattatttaattaaatactttactatttttctaaattctgaagtatttattgaatgccatttatgcaaatgagactatattatgccatcctttgttatcccctgcacttgcatatttgctgcgtggcttgttgagtttgtcatatactcaccttgcaatcattcatcagaggaggagttctacagtgatgctgaaggtgtggaggattaggcgtagccctggtcaagctgcttgtgggatggagttgtctgcgctctttattttattttccgctgcttagatctttattgtttgagaggaactatctacctctgtaatgactttatattcacctattaattggaataataattgtactctattatcaatttgttattgtgtgcctcggctgattcctggacgagggtttacacgcatgtaagcgtttggagttttgcatagaaattccgggcgtgacaccctatcaatgtgcaactatcaccttatgcacatcacttgccacccaattctaaaaccatcatttttagtttttattttcacaaataatagaggcaatacccctgtccaatattatcaaatgactaatttgaaagagtgaatattgtgtcattgatatccatcaaaatttctaggcatggctaagcaatagctatattagtatctcgaatatactaaaattggtacttggacactactacaaggcatcctaggtatatcaacaggaatatgaacaataattcaaggtggataatgtaacaagtaggagttgttctatcggtacccaattttttcaacatcgcatacaagttatagacaatattgcattacgaaaatatagacatacaacatgatcggaggaggaattgaataggacttgccttactcagtgaactcatcacaagtatcaggttcgtgctcacactcctccacggctgtaactttgtcgtttattcaaatttaaatgaaactcgaatgaacaccaaatattaaaaatgctcaaacatgcatggtactagtacagtagatataggatgattttagataaatttaggtgaaaaaatcattagaatctgatttcatacgccttagttataaagctttcaaagtttaaaaatgctgaaattgcaaaggttactattcactatttgaaaattcagatttagctgtagatctgccctatatttgtcaaaaaatttttacttaaccacacgaaggagaatattatgaggatcaatggtaatttggttcactcaaatcagggtgaaaatgaattctctatgatttttcaaagcttcagcaaattacatatataattcacagaaattgttttctcaaattttttagttatttattaaacatctacttcaatgcattacaacttcttcaatttggtcttttttttttataaatgctttgaagtggtaagtagtggcatatgtctattttttgtcaaattgtaatggcattataaatgctttgaattataaatgctttgaatggtgtgcaggcctggactggcaagtgccaacctacctgctgcgacgccagggcttctctgttctgtactctcgccgtccctaaaaaaatctcaatttaagttagaactagaaaatgagcgtgcccgttggcatggatcttgtttctgttggctcatgttgacttcatgatgatgtagttaaccaaaatctcttgttattgtcacacaccttcactcaaggaacaacaatgatcgattaattgcacttcctcacgttacttcaactttctccatcgaccatgagagggcactagaccattcggtcgataagttttcacatgaccataccagcctatgagggcactcgcagtgcgccatcagaaatggtgcgcctgagcttggggctgggctagagaacaccaaaagccacttatctacaatgtaagtgaccttacaagtagcttatagtgggacccaccataccactttttccttttcactttccctccccctctctctcccctctcttcctctcccctctctctcccgagcggcggggcaacggcggggcgacggcgccgagggcccaagcggcggcgagccaagcgacgatggcgccaggcaccgggcggcgtggcagcgaggcggtggcagggcggagcggtggtgggacggccagatctggccggacttggcctcgggcagtgacggtgacgggcggcacgaggacgacaagctcgacggtggcggggacgatggtgccatctctccaccaaccagtggggcacggcgcggcaggagattctcggcgcgcgaaagggggcagccgtggccggcgtcgttctcaagctcctcgccgtcggcctcaagcttcggatgtgccgagctttcttccctccctctctcccttccctggtgacctgacaaagctgccaaattttgctgaagaacgtgtgtctcactttggtcacttggtcctgggttggtcacaggaaatgctgatgtggctgagaatctcctacatgtaagctcgaggctgaatgacacgtaagcccactgtgaatggcctgagatgcgttcaccacttcaccagacaaagcgccgcatgtgaataatccaaaatgtgggcatacatatgcacgctgattcacaaaacaaacgttgatgaatctggtgccacacaaacaaaacttcagaggatattgcatctactaatagactagcttcgaggcttggatatgcagaagatacttgccacgtccagaaatttagccaatttccaaattattttttatgtaataaatccatgtccaagaatgaagccagtgtacacaaaatgacaaattaatatacagatccaaacgcaaataaagcataagtacttatagaagaggtgcttagtcggttagtcctcacacagtaaagaaaacagcagtagaaagggacgataatagcgatttttaattaaaaatcattccctaaaaggaataataaaatttattaaaattcaaaaagaaattagaaaacattaaaatacatacaagaaaaattcgaatgttacccggattatttttcttaaattccccatgttataaaatgtctccctaatttttacatgaattttaagaacaccagaaataattttaatgcaacaaaaaataatttaagatttaattaaaatagaaaacctaaaataaatcccctctcacccgttaggcaaatccagcccaaagcctctctcccctccctctctttttggaaaaagtacatcaaaggtccctcaacttttcatcgagtcacaaaatcgtccccaaaccgcaaaaccg

SEQ ID NO: 60697 - DNA, 1402 bp, Oryza sativa
gggcgaggcaggaaaggaggaggcgtgggctgcgatgctagagaaggcgagggcagcggcagtggcgaaagcaagagcacagtgccacagtactgcgagaatgctaagccacacctgacatgcagagactaacacaacaactgccgaatcaagcgctcccaactattgggcggcaccttgccacttttcgctgccggcgatgccggacttcaagaacggcgtgccgccttgcgcgccaagcccggacatatgcccgctgccggccagcgacgtcgagtacctgaactcgtagccgccgttgccgccaagcctcacgatgggctccccttcatagctccttgacagcatgtggacggtggagaactgctcttgccagaagcacgccaccttgccaccgacggaggcaagcgccgccgagtgcccgacgttgatgaagctctgcgtgccattcggcaccgcgttgccaatgaactccgccatcaagtgtggcccgttcgtccccgtcgatgcggaagccgccaccgccacagccgctacatgaaccaagaacgacacagcaacgacaaatgtaaccgatgtagctgagtcaagtgcattcatacaaggcggcggcatgatcgatggaagctaagctaaggtaagataagccgtcgctgccctcgccttctccagcatcgcagccgccaccatggcctccacctctcccgcctcgccctggcggcctcctcctcagccgtcggccggcttgccagaagagaagagaagagtgagagagaggagggagaggagggggaagagaacctgcagatgtggcacctgacatgtggggcccacgtgggtctcaagctgacccagccgccacgtcagataaaacaggcatcaaaaccaccgaggaacctagtttgcactggttttgtaagttgggggatgctttgtgtctagttttatggttaggggacaattttgtaactcgataacaagttgagggacctttgatgtacttgttcctctcttttccctccttctccctgggccgtcccacctccttctctccctcccccgggctgcctcggcccgagccatcctgcccctcccgcctgagccgcttccctcgcgcggcccagcgccagccgcaccacccacacacgcgcgacgcacgtgcgctgaccgcgcgcctcacgtgggtcccgcctgtcagactcgtctccttcctcctgccggcctcctctcctcacttccgtgaaaacctgcctgagtcctccccaaaatccgctcgattcaaacagataattccaaaattaattggaacggctgtgcctccatcacccggaacggctgtgcctttcccgaccaccttccatggccgccggccaccattctcggtgctggccccacctctccc

SEQ ID NO: 60698 - DNA, 3537 bp, Oryza sativa
gaaaatcgaatcccggccgtctcaggagcgcgggtgagcgggagagagggggaagtgggcgcgggtgcgagggcgacgtggacggcgtggcccgggaggcgcggacgcgaggcgcggcggcggttgcgggcgcggcggcgagcggctggaggttaggggaggacccgataggtgggccccacctgtcggtgaccccgggagagaagagggggcgcgggctaagctggggcgtggcctccggccggcccagcaaggcgcagggagataggagggggaaatgggccggcggcccactaagggaaaaggaaaaagaaaaaagaaaaaggaagaaaggaatttccagggatttaaatattgcctgtgctcaattttaattgattaaaattatttctagggctctgaaaattccactaaaaatcctgttagtgaatttcgacatgtagaactcaagaaaaattccacatgtcagattcgattattatttgtattactttcttagggttttctcttgatttgcaccggcattttcttagggtcatttataaattaaattttaggcttgggaggagaacttcagggtgtgacatccactctctcttaaagttgagcgttcgccacctcaagattagcatgagactctttggtttgcttgtaaagccgtaccaaagcctcatttttctctctctccttagcaagttcactcttgagttcatgagaccgctctttctcacgaatgagcaattcctcttaactctcaaaggttgcatattgatcctcaattctcccaagcaactcactcaagtgtggtatggattccttggttatggatttgaacaactcgtcatccataacctcatcctcaacatcttcctccccatcactactaagatcaacattaaattgttggaattaatgaatgggccttagcccactcgaagattaattctttggaaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggccgggcagggcaggcggcgcgtgtgcacgacgtacgcgtcgaatggtccgaaaaattggctcctcacccttgcgcagatgcagcctccttttgcagttttgttttgctgcaaattcggattcgattttgttttggaaacgttccgaaaaatccggggcgtgcaaatggcgtggagtccggataagttacgcgcgacttatccggttcggttacgcgcagtagagatcgtgcgggcgccctgatcaagcgacccttctctatataaaccgacttgccgtcttcacgcaacacttgcgaaatcaatctagggtttgccttctactctgtactgcgctgtcgctcgtaaactactccatcccgctcgccagcgtgcaccggcgatcgggagagcaggtctccggaacctctgccttcgacgtcctgcaccaggagaaggcggcaataaggtttttgggaagcgcttcgcgcgactactccctgtttgttcgcgacagctcgccttcctcttcgctcgcgtgtttcgtgccttcgtagacacctacgaaaagtttcgaccaagcaaccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagattagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgatgctaaggagttgtgggatgcactgaatactaaattcggtgctactgatgctagcaatgatctgtatattatggagcagtttcatgactacaagatggctgacaaccgttctgtagtcgaacaggctcatgagatacaaaccatggctaaggaactcgaactccttaagtgtgtcttacccgacaaatttatggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtggacagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatgttgttggcacggtagatctgaagtttacttcgggaaagatcgtgcagctgaagaatgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaatatgtctgtgaaccatatttgtggcagtgtggatgatgaggctaatgtttggcattcacgtttatgtcatattaatttcggcttgatgtctcggctttccagcatgtgtttaattcctaagtttttcattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtgaaaaacgatatttcatgacattgattgatgatgctactagattttgctatgtgtacttgttgaaaacgaaagacgaggctctagactattttaaaatttataaggcagaagttg

SEQ ID NO: 60699 - DNA, 6254 bp, Oryza sativa
gtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactcttgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctattaccagataagactttgagtgaaacttgcttgcacaagacttgcaattcaaggcgtagtccattgttcaagttgtgagtaagtgttgcttggagttctaggtggatgttcaaccttaattggtctccatcgaaccgctagtatataaacagtatattggaaaaggcaaatctcagtgggattttgagatttggtgggggattgttggaattaatgaatgggccttagcccactcgaagattaattctttggaaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcacgctcgctcgcctcgcctcgcctggctgggccgggccgggcagggcaggccggcgcgcgtgcacgacgtacgcgtcgaatggttcgaaaaattggctcctcacccttgcgcagatgcagcctccttttgcagttttgttttgctgcaaattcggattcgtttttgttttggaaacgttccgaaaaatccggtgcgtgcaaatggcgtggagtccggataagttacgcgcgacttatccggttcggttacgcgcagtagagatcgtgcgggcgccctgatcaagcgacccttctctatataaaccgacttgccgtcttcacgcaacacttgcgaaatcaatctagggtttgccttctactctgtactgcgctgtcgctcgtagactactccatcccgctcgccagcgtgcaccggcgatcgggagagcaggtctccggaacctctgccttcgacgtcctgcaccaggagaaggcggcaataaggtttttgggaagcgcttcgcgcgactactccctgtttgttcgcgacggctcgccttcctcttcgctcgcgtgtttcgtgccttcgtagacacctgcgaaaagtttcgaccaagcaaccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacataaataacttgaggggagaaggtatcttagcctcctttgccatgaggcaaatgggagcaccctcatcacttgagtaatcgaagagtctcggtagcgatgaaagcttgacggcgaacgtggcgactccttcttcatcacttgagcttgactcggagtcggagccgaagatcatcccaaggtgagcttggccataatgttcccgcttgctatgcttgtgcttctacttcttctcatccttcttctcaccctttttcttatcttccttgaggtgggaaccatccttgaggtgggggcactccgcaatgaagtgcccgggctctttgcacacatagcacacccttgcggagtgtcttccacttgacttgttggagtagtgcttggaagagcttcccttgaagaagccgctttgtctcatgaacttgccgaacttcttgacgaaaagagccatctcttcatcatcgatctccaccttgctcttgctcttgcggttctcttcttcttcttcctctgccttcaatgccaagtcttccttcttgatgcttgcggttgagctttggttgatatattggatgacatccttggaatcttgcacgagcatgtcatgggcaaggatacgcccgagcaaatcataaggtgtgagagttttgtagtccggacgctcacgaatgatggtcaccaaggtagagttccttggagtgattgcccgaaccatcttcttgaccacaacctcatcggtcatgtccttggagccaagtcccttgatctcgttgacgatcttgctcaaccggtcgtacatgtcgcttgggatttctccatccaacatcacaaacctctcaaattgccccttgagaatctccaccttggactcacgaacactatccgtgccttcatgcaggttccgaagcgtgtcccaaatcactttggcactttcaatgccatccacacggttgaactcacttctactcaaggcgctaagtattgcattagcggcttgagcgttcttgtgctcgttctcgttgtcctccttggtgggatcttcaggattctgcaaaacatagcctttttcgactattctccaaatagatgggttaatagacttcaaatgcatcttcatcttatgcttccaagcggcatagtccttaccattaaagtacggagctttgccactataggtactcacataagatgtagatgtagagggatagtcaaaaggaatcctagctcccttttcaccatcattaccatcccccgtgtgacccgacatgatctctccaagcggttaagcctaattaggagattaggctctgataccaattgaaaaggtcaattaggcctagagggggggtggataggctaatttaaaaacttaagtaaagcggaagctgtaattttcggaactaggctgggaattttcggaacttccgaaaatgcacagagcagcgcacacaaaatgaagtctctagatctagaagtctaccacatggaatcaaagacacatacaacaactagaccaatagtggcacaagcaagcaaagctagaggagagggatgaagagatattgccaaggtgaagcttgcaaacttgatcccggagttcaaatccttgaggggattccactctccgttgaggagctcactaagagccaggtcttagctaaccctttccttaaaaggttacactaagcactccttcttatatgtctatgcatcatcccccttaatagtacagctttcctacgacacaatgcgaggaaaaagatacaatataccatttgatcattgccgcattgcaacgcgatgtcgcattctcgggatatgcattgtattacaacacgtcgaggaaataacaaccttcacatttgcttgaataaaaatgttagtcatctctaatctcattgtaatcaatcattaaaatcattagggcctagatgcactttcaagcttgcagcggtgctcccggctcctccccatccccactgcatgcgcatagaggcaaggccagatttgatatgatggcagtgttttcccttcaaacttttaaaaattctgtcacatcaaatgttcgaatacatgcatagaatattaaatatggatggaaaaaaaacaattgtataatttgcatgtaaattatgccatgatttgacaatgtgacggtacagtaaacatttgctaatgatggattaattaggcttaataaattcgtcacgcagtttatcggcggaatcggtaatttgtacatttaatactttaaatgtgtgtccgtatattcaatgtgtcatactaaaacttttcatgtctgtaactatacgtaactatacagttcataaagtgaaatgagggtgaacacggctcctgcaaaacaataagcgacatgaatatctatgtcgcccaatgcagcaagataacttgtcagacgaggtcaacgatataatctataccacgcccttgacacgctggccctacagtattccgggcccacacaccagtcagagaccttttctcaaaccgtgagccaagccaccgccgctcccgtttgttggcagcagaaaggaccgcggggcattgacgacaccgattttttttaagcacatgcttaaccaccgttagtcttatttaaaatttttttataaaatatataatactatatgtatatataagtatatttaataatgaattaaatgataagaaaagaattaataattacttaaatttttttaataaaacaaacaattagatatatttaaaaaaatcaacggtgttaaatatttagaaaccgagattccaactccaactcaggtcggtcaggtgtgtgtggtcgttgggactacttgcgttggttgtatgggtccaccagcgaaccggtcgtctccgggtctgtctttcagtttgcgaggggcaaagccaaagccgctacgatgtcctctccgggtctttctttcagtttgacacaaaaagttttcaatgatcatgcaagcgtgttgatatatatatatatatatatatatatatatatatatatatatatatatatatatatgaccgtgaaatctaatactctctggttgttgtttgatgacttgatcctctatgaggtaatgaaagagatttatttaatttatttggccgtcgtgttttcccttatctcctacaatctgcagtagagcaagtacgccactgtcttctataatttagtgtggatgtgtgaatggtcgaaagagatgctactctctttatctaaaaatatatagtaacttttaatagacacatattagttacagagtagtatttgtactaataatctagatatatagattccctgttcaaatttaaagtaaataaaatatatcatatcaatttaaaatcatttatattttaaggtgaaatgagtatgtccagttaattttgacacatcaacgtcgcagagaagatgtgttctactgcgatacactactgctgcctagatgctagtaatgctactacgtacgtcctgtgtgtaggaaatgttccaatggatggaattcttttgaaaagctatatagagtcgagagctagctgctggtataatctatagcatcagcagccgaaagttcgatcctgttgctgtcgacggatcgagcacgtcaattttatgtacttctcctcttgttgtctcctcaagtcctgtttattccctttgacttcagatttttagcatgtgcgatgtctctcatattagtcatatatatataactccctccattatttttatataacgtgcactaaccaacgacaaacaaggagaatcaaagggagtattattttcatggaattttctccgagattcatttccttgtagtgatcgaccacctccctccttatccgcggtaattacccttttatttacctctcaccatcaagttatggcttgggtaattcgaggacatgtacgtcattgctggcgtggaaggactgagggcatgtcactaaatctattatatattattaaagaaatagaaaaaggagcctccacgttcgctctcatggtctagaaattatcacattaatcggagaaaaagaaaaaacagagtttatatagaaatacaatttagaaatagctgaaattcggaattaaaaaaacaaatattagaagaggagactagagtccatatagaaatacaatttagaaatagttgaaattcggaattaaaaaataaggaatattagaaaaggagactagagtccatatagaaatacaattaggaaataactgaaattcgaaattaaaattaaaaataaggaatattagaattagagtatagagtccatataggaatttaaaactaacta

SEQ ID NO: 60700 - DNA, 4053 bp, Oryza sativa
cttaaaaagggggaaagaattgctattcccacgcacatttttttttctgttttcttcatttttttcgtttcttttcagttttttctttccttttttcgtttttttatttcttattaatactatgtatgtatacaaactaatatatatgtatacaaactttatatacatttatatttttttatacattcatatataaactttgtatacatctctatcactactcccgtccctacttaaaaaattcacataaaaaaagtctattcgattccctaagaaagtggaaaaaaaaggttcgtaaaaaataaaaaatgaacgagaaaaaaaaaataaaaagggcggaaaaaagcgtggcaaaatgttcgatttctattcgtttatgtagtccgtatatatatctcttcactatctctaatataatttaactatttaaaaatagatgttttcatcgtactactaaaaagagaagttttcattgtacaactgaaaagaaaaaaatgcgtgagaaattaaaaatggttaaaaaacgtgtgagcaaaaatggccagagaaaagtgctaaaaaaggtttccgtcgtccgtaaaaaataaaaaatgtgcgggaaataatatttccatcatctgtaaaaatttttgaaaaaacatgcaaggaaaaaactcttagaaaaacacgccatttttcgcaagaaaaaacacagttaaaaaaacaagttgctctgaaaaaactgtcagaaaaaatgctaaattgatggacgcttgggtgagataggatccatcatttttttctatctcctacacgacttttgtttcgtcatctattctcctgtattggagaccctgcatgtctttatatgcaagtatagctattattattgataacatatgatatggatataatattaaaataaacatatttttaattattatttagagaagagtgtacagtgactctattttgtgtaggcttgaccatgcgaggcaatgtaggatttgattgatcttattattggttgcaagaatgagattcaaagagtattttagattatatgcatgttgtcacatgaataatccaattattttaggtaaagcaagcatcgatgatattgtcatcgtcgaggctgaaccatttcattgaggatgttccaattttttgattgtcttagctataaacgatccatacaaatattgtcattggcattgttatgtatgaaaaatgtatataagtttttcacccgttgcagcgcacgggtatttttgctagtaaatataataaaaattaaaagtagagtttagagtccgtataaaaatacaatttacaaataactaaaattcaatattaagaaaaacatgggaagaagagtttaaagtcaatataggaatgcaatttagaagtaactgaaattcgaaattaaaaattaaagtatattaatagatgagtttagagtccacatagaaatacaattaaaaataataaaaattcagaaataaaaataaataatattggaagaagagcatagagtctataaagaaatacaatttacagaaaattcggaattaaaaaaaatatattaaaagacgagtctagagtgcatataggaatatatataatttacaaataattaaaaattgatattaaaaataattaataactaacacgtatataaaatacaatatgaatattacccattagtagtttcgtaaagttattgcaaaatttaaattatgttgtcattttaatatatttgaataatatattgagaaaacatatatgctattatatgagaaaatataatgatgctagccgcacaagctgcgcgggccaccatgctagttttgaatgattctaatatcttaaatccctttgttggcctacgaaactttcctgttctacaaagtctaggaaagtgtatgtattggaaaaagggaaaattacataagattttaccttagagtaaaatttgtcagtgataaccgatggctacccaacaagaacaacatggggcagagctaggctgccatctatctccttgtgttccatcagcgttgacatcgttccatttgggtttgagaagattccatagtctagtcaatattcatatatgcgcgtttctttagtctatcaaggaaataagttttcataagattctatcatatgggattctagaaaaactctccgttccacttctcagaccgaagaggttctcttgtcttaataattagaaaatatagtacatgtttaggtcgtgtgtgcttaattttttttaagtatacggacacatatttgaagtattaaacgtagactaataataaaacaaattatagattccgcttgtaaactgcaagataaatttattaagcctaattaatccgttattagcaaatgtttactgtaacatcacattgtcaaaacatggcgtaattaggctcaaaagattcgtctcgcaatttacatgcaaattatgcaattggtttttttcatctacatttaatgttccatgcatatgttcaaatatttgatttgaagtgatggaatttttgaaggtttgaagggaactaaaccctaccattgaagactagaccattatatttgacctccaaaacttacacatcacttactgtaccctgtgaaatttcaaccatcgccgtccctaccaatccactattattgtcccaatggtatgcttgagggtacccttccgctttggcaaccagctagttgagccacctagctatgccatctggtgctggcactactgcagaaatgcataaaaatgatagtactatagatcctgaaaatgctaaaatcaacacctataatagttttcccaaccgaagcgtgtgcctgcggagcaccatcggctagaaccgatacctttgtggagaaataggtaccggttctagagaaaaaccaacacaaatattatagatgctgttttttttaaaaaaatagatacctttaattaattataggtaccaattaattaaaaaccggtacgtataatatattataggtggtttaaaacatcggcaccagtaaaaaccgagctgggccactctctccactcatgagcagataaagagagggaggggcggggtgggcgtccttattccctccacttgcctcccttctctcttgagagcggcggcggcgccatccctacccgcaagcggtggtgaagtcctccccactcttgagacccgacggtgcattcctcaccagtgagcaacgctcacggcggtgataacctcccacccgcgagcagcggtgccctccccactcacgagcggcagcggcagcaccgacgctacattcgataggcccgagctcgggggccgctggatatggcctccgtgcctgtcctcgagcaatctccggcttctctgtccctttacatagacaacggtcggcaacatctgttcttgtgttatagtgtgcttgttgtgcttgttgtaggatgtttgattctgtgataaacttgttcatttgtgttgttgaaatgttaattctatgaatgtgttcttggatgttagattgatcttaggggtgatggaatctgagagatgaaggtgaactgctcgatgcatcggcttgaatcaagtcttttttttttcattcttggaaccaagaaccggcacatttgagtcctcgtcaaaggtgccacttgctgggtgttggttacgaaatccggtacctatggctggttgccacctagcaccaatcaacttttctgtagtagtgtggtgagctcaaacagattcgatgccacttgcaaatgagcctcacttgacaatcgatgacttatatatacactaataagtgtgactagactataattcaccgagtttttgaatataccatgtgtagctaaacaagggacaattggatcccaacaaatcaagcaatcaattgaaatatagctcaaaacctctttatatttatgatagacagtgaatgacaggtgggtcctctcatcagtgaaagagagaccgtatacctagcaacatttttggcctgcagataagcagagagtgaaggaatctttgatgctgcaaacgc

SEQ ID NO: 60701 - DNA, 14758 bp, Oryza sativa
gaatgaaatccatcaaaccatcgtcggacatatcattcaggcgtgggcatcgatcgactgatcatcctcgtcgtctatctcgttggattcatgctactagtattattcagagtttttgctccatcactattctttcagagtttcagacagtacagcaggcgatgcagtacaattaattaacgatgcataatagcttgggtttttggactcttgctgtctctctgtgtgctcgtggtagttaaccattcaatttgatcccacgtgtaatgctgaatgctgaaatgtacttcatcgagcctatttcttagcttgtttgtttgtttatttgttttacttatcagcaggttctgaagaggaaaaaaaagttgttttttaattttctagaggaggaacaagagttgttgaggatgattaagaacgaaaattcaggcaagattagtcaaacaattcttctaattgaccttctattggcttaatttacatgtgtgtttctagctaggcggcgtcaaaccatacacgaaacagtatcctcagatatcaccatcactgactaacggattaggtctcgaggttgtaggtggtatggtttgattcaaactattttattagtgtatatcatgattgtaatgagttcgatcctcttcgtattttgcatcatatgatacgatatttgttttatattccctccgggctgataatacttgtcgttttggacaagggtatggtcaaacactttagaatatttgattatgaatcatttttaaaatatttgtaatagtgactacatgtatagattggtcttaaaaagtactttaataagatcatatatttgttaacacttttttacatattacaatagaaaataatagtcaaagttgttttttttaagaccgtgcccttataaaaaacgataagtattatcaacccggagggagtacatgaaagacatatacatgtacagatcaatccatgcacacctccactccactcgccatgatttgaattctgaaatatattgcgtgtttcgttccttttgattttcaaacatacaatattttttactgctaagaattggtcattgccaaaattttatttggcaacgattagctggtatttcatttggtttgctatggatttgccgtgttggtcacttctctccatcatggcagtaattaaacagagaaaaaaaggatagattttaccaaaatattttagaatttggtcaagttaccatgaccttagtgacggtaagcctggttattgcgatggtaaggaacagaagcgtccaaattactgacattaaatcatttgagaattacaaaggaaataatcttggcctacagtggatctttcaagctcatctttgttttcagttgatctgcaccggacaaatcatttgatttgagtactctttaggtgaaaaatacacaaaaactgaggacctggttggaagacaatttttaattaggcccagacggtgcaaaggacgagcccaaaagtccaaaaacctgcgtggatacatgggccgaaatccatagcaaatttagtccagaggcccatccggcccacattaccaggggccatatccctctagcttttggcttcaattagcgttgctccaccaccattgctcagtttgttactgaaagtctgaaatcaaatctgctcgcaatctgccttgttggtagtcttaacaatgtagaatctttaagaatattgtgcaaacggaaatctgtgagctttgtgatgaataaatggaaacggcctttcacatatgcattgggtgtccttttgctcgttccttctggcaagctatgtaataggaataagtttactttgaatcccttaaaagtgacccgaatctaatccatgaccctcaaccgcaaaaccggacatgacgactccccgaactattaaaaccggtgcaatttgactttctcgacagttttggagggcagtttcgctgacgtggcacatacgtgacggtattgacctggtcttccttccacatggcgctaacgtggcagttatgtggcacttgaattttaaaaatatgtgtgggacccatatatcattcacacaaaagaaaaaatatgggacccacgtgtcatgcatcctgtctcttccctccttcctcctccctctgtcccttctctttctttctctcctcacgccgacgtcatggagcctcgattccccgtcgtcggcgcctccacctcgccactggtgacggcgtccacgtccctgccccccatgtgggggcacctttgcccctcgccgctgcagtagctgcaagccagcgctgatgaagtcacggcggtgtgatgaagtccgcttttgctgctccagatctgctgctatttgcttattgcttgatgaagcctagataacgatgaacgagcttgcggttgttagctcaacccgacaacaagctactgctgcttgtttgcttgagcatgaactaaaccaaaagaaggtttgttgtgctgttgctgctactacttggcgtaggaagaagaatagaaggtccacctcggcaccgccggcgccctcctgtcatcgtcctccccgacccctccttcatggattcacgccggcgacctcctccgcccctagtcccctcggctccgtgtgggtctccagcacccacgagcggatctgagacccacggcgccgtcttcggcttactccgctgtccacgccgccgctggcctctccaccgtagtcacctccaccggcaccgcgtagatcgaccttcttccttcggagcacagtcacggcctgtgtcaccgccatggggagcggcaggaggagcaccgtggagtgatctgacaccaacatgtagcgtcagctctgctaccagacgccacacggtggccgaacgggaggcgccgcacttggccatcttctgcccgagctagagcagctgggcggctagattcttcgccacgagctcgccgaacccctcatccaacgcggcggcagtggtggccgtcggcctccaccaccacatccgttcgcacagcgcgcacgaccaacaccatgcctggccactcccctcgacgctggtcatgagacgcgcgcaccgtcgatcggggaggacgacaccgggagggcgctgacggtggcgacgtggagacaccgacgagaaagggagttagagagaagggagagagagggaggaggaaggagggaagagagaggatgacacgtgggccccacatataccagtgggtcccatatttatttttttgtgtgaatgacaactgggttcgacacatattttttaaattcgggtgccacgtaaccgccacgtcagcaccacatggaagaaagaccagatcaataccaccacgtatgcgccacgtcagcgaaaccgttctccaaaaccgccgagggagtcaaattgcaccagttttaatagttcggggagtcgtcctatctggtttgcgattgagggtcacagattagattcgggtcacttttaagggaatcaaagtgaacttattccatgtaaatactagcagcgatccctgatatggcaaatctagtaagcttgcagtagggcgggcggcggcgacgcttttagcgtcgtttcttccttgaaggcgtcgtttagaagacctattcctcagaggtgttgtgtgctttttctgtatttagtagtagggacagacgtagacgcatggtgtggttgtttattttttcctgagtatagtttcccaagactatagacttgtattttattctttctttatcaatagaaattagaaatgtcacactttcttttacaggttgtttcaaaaaacagtgagcttacagaaaccccatggcgtcccaaataaacattttcaggtcttctaccttctgtgtttctgcggactatgcaatcaccaacactacatggtttttcgaggaatgcaaccatcactcagctgtctggtaaccaaatgcttggacgatgcaacgctttgggctgaaagactcgatactaatgatagaatagtggtttcctcttggaaggaagctctttcctcttctattcggcgttctgtaatttgacgaactacttgtatctttctctctgtagttgaatgaaattcaggtgaggaaactctccccatggcgaccattaaaaaaaaaaactgcccgctaatcaattttatcaagatttagataatatcaataaaaaaacaaatagttgaggatgtccccaaccctaatatatatatacaacaaattgataaacatgttggatgatgtactactaggtgaataacgcactatcacagttcttttcaggctacaatggatcaaactattattgactcttctgaccactatatattgcattcgcagactgtaaggctatattcactggtggagaaaccctttttagtcccaattcacaaccccctgtagtcccggttatgtaaccgggactacgaatctgggactaaaaatatctatttttagttccggttgtataacccggactaaagatatctttagtcccggttgatgttaccaaccgggactaaagatttagtatcttcattgtttagttcttcccaagctctgaaaatcatctagcacagcatatatatctttctttgcatcctgactcctgagagcagcatgaacgattttcatttatataaggaaaaaaaagtacaaattacccctgaactatcgtggtcgaccgaattaccccctaaactcaaaaatcagacattgctcaccctaaactttcaataccgaacaaattacccccctcgacctaatctaaagtggttttgtcctatgtggtgtacacgtggcaatccagtcagcattttattttttaaaaaatagtgggacccacttgtcataccatatcttcccctcttccttttcctctctctcaggctcaaagcgtgcacggcgagcggcggcgcgcgggggaggacaggcagtcggtgcgcgggggccggcgatgggcggtgacgtgctggggcggacgggcggtcggcgcgtgtgggccggcggcggaacacggggagggcgcggcgggcaacaggtggcgccgagcaggccaggagggtgttggtggcgacgggctacggcgacaagtccaccaccctctcgagctccacggctatggcgacgaggcgacgagtcctcggctcaggcgggcgccgtcgaggtcatcgttccagtcggaggcggcggagagaggtgcgaagaatcttctccggttccaacggggagtcggcgggatccatggcctccctctctctctctttctccgctcagtcaggcggcctgcgatgaatcctcctcggggagggcgtggcgagcggcgcgcatggcgcggaggacacggtgggcggcgccgaggaggcattggaggcggtgcgctacggcgacgagttcgtcgagttcgccgcctgtccacgtcgtccccatcgaccgtcgtcgcttgtcgaaacatgcattcggcaataataaaagggggtagcgcacgagacctaaaagtggatggatatggagacaaaggatctagacaggttcaggccctctcgatgagaggtaataccctactcctgtttggggatttgaatccgccgggtgtagtatagatctgacgatctagttgtctcatgccccctagagggcctcctgcccaccttatataggatggggaggggggcaggattataagatagaaaccttaactaatacggtatcggtttcctaaatctactttacaatcttatcaaaccaggactttaggccgttccataatatacaagaaaacgtaatacccaagtaatgatccattacatatttcatagatataagttatcccctatatcagtcagataaccacgccgtgtgggtatggggtacccataatctccacactagcccctgagaccttcacagtcgaaaagataatcttctctcgaaccagattactccaaagccgagtgcttcaatcatctttgccatggtctcccgagtacttttaccaaatctgaagactgtggagggctgaaaaataactgaatgtaaacttaggtgcatcgactagatgcacctaataggtgtagctcccgactatggggttaattgaataaaccaagcatatagtcagggaataaataatccaaccaactgagtggtttttgataaatatagtcaaccaagtgacttgataccaatatatagcatatgcggtgtgaaatgctgaataatatgatccaagtgatataccgactgctttgtagaatatgatgcgtgcaacctaaagttgacaacatctttgaaaattcacatagcaaaatgctataaagaagcttgtatgttgtgaataaagaaatttccaaagtattgggcatacgccatgcgcacactgctttaacagatgtgcttaagtccctaaaagacacatggcttcaccacaccaagaaatatacggcatatgtggtgtaaaatccaagtaaataaactcataaaggatttaccatccgcctggaaaatgaccaagatatataatcagcctaagccttaatattggtcaataaaaatgcacacttacatggcaaaaagcaacgatattatatccaatcaattgcttaaaaacccaaacagtaccttaacctatataaaaaagtcagcggggcagctatataaagctttactgtttgacaccttttaagatgcattgtaccaactactaaaaagttgagtaactacggtacaaaaggattttaaggtattgggcacttgatcacgcacactttgccctaagcaaaaagtgcctaagtccctaaaagaacgtgataggccacacctaaaaatatgggttgcagaacatattagccctaggccaaaaaatatgccttcgacaccctttaaaggatgacgcatgtaacatgctcccgagtaatatatcttccgggtgatatagaccaagtgtagctcatatgaatagcttatgatctgagtgattatcccttatgggatactccaaaatagatataataattgaatcccgactagcgcaagtattcggttgataacccttacgagaaataataaatagtccagtctttgagcatagaaaatagacccatgatcatgaattcatgttgcatgtatccggaacaagtccaaattgaaggtatgatacttgtgtttgagctagtaagcccctgagcatatagcttgtctttctgtcgtagtcataattgtccattgatggtagccgacgcagttggcatagagacaagatgaccaatatagagataatattgcccaccagaggtggcaaaaatattggtggtagtgaagatagtgataccaatcaaaagtgatgaagttgcacaaccgtggaggcgaagaaaccagtcggcagcagtcaggtcagccagcaatgaagatgaaggcgcccagcgattgagttgtgtagccatggcagcgaaataatcagtcggtgacagacgaggcagctggtgaagaagatgaagatgcccattagtggcgacataataagccatccgtgaaggcgaggataccgatcggtggtgacgaaagtaagtcgatggtgatgatatagacacgcattaaaggcgatgacgaaatccaccaatcatgaagatggagaaaatagttggcaaggacaaacgcaaccgacagtaatgatgataagtaacaatcatagatgatcgactatgataacgaagttgcccattaaacagcagtagaataggctatgttgaagaggcttgacaggatattgatgaagatgacgatgtcggtgatccagtcaatagcagtgtagcaaccgatgataatgacgaagacgatcatcagcgtttgcatagtaggtcaactgtgaaggcgaaataacaagtcggcaatgacggaagcaacctgaggcgaagacgtagtcatccattagcaatggcagagatgtcagggccgatgaagtagaggtgctggtgatgaagtccatgacaataatccatcaaactgttgagaagatatcgaagctcaagtagttttcttgatgtgtgcataacaaagattgatgcaacaccccttgatctgtaaagatggcagtagaacttggaattgtagctgttgcagattcttcacttgaaggaaagtaaatgttgttgtccaacttatcgaaactgagctgattggttgataactctaaactcccggacatgtagatagaatctcaaacttgatacttgaaaaatttggagtagattatggcagcgtccagaaaccaaaattgccggtgaaataattggagttgctgaagtagaatgtctgctccgaagcaaagataaacataatgactcctggagttgactcgttgactgattaattgatttcttcagcttgtcgaattttgagagtcttgtatttgtgtagcccccgactctttggttagttggaaagcaactgaacatagagtcgagaactatagcttcttgtcatcgagtagccatcacttgagtgaagatatgtattgaggatgtccgggtagaaatcttgaatactggaacaccatttgtggtaataacatggcatcatatttagtgatgcatgccgaaatgtcgaagctcttgtagaagtcatggctagtgaagtaacaaaacttgcgaagtagcggcaatagagtttgccggtgctgaagacattgaagatgaagtagctccaccatggtgacaaagttgcacagccgtgataaagtgaacacgagtcggcggtgacagaagcaaaccggtagtgaagacgcgcagttgtgaagataataacaagtcggcagcggaagaagtagaataatgatgaaaaggaagacgtccttgagtggcggcaaaataggccagccgtgaaagtgaagacaccatgagctgcggcgaaggcaaaccagcgattacgatgacgccagtcaatgatgacgaataagccagtcggcgtcagacaaggcgaccagcaatgaagatgatgacgtccatcaatagtggtagcggtataaaccagccatagaggcgagggctctggtcagccgcagacgagacgaccagcggtgaagacgataagaccaatcaacactggcataatcatgcagccgtggaagtgaagaaaccagtcagcagcagacgtagacaggttgcgttgaagatgatgatgacgcccatcaacggaggcggagtccactgtccttataggcgagaacaccagtcggcgacggcgaaacgggccaacggtgaagtcgtagacccccaacaaaggcggcataataggccagctgtgcaggcggagacaccagtcggcggcggcgaaggtgagccggcagtgaagacgtagaggcccaacaacggcggtgtgaccaaccaaccgtataggcgaagacaccagtcggcggcggacgaggcggctggtcggtgaagacatagacgcccaacaacggcggtataataggccagccgtgcaggcggagacaccagctggtggtggcgaaggcaagccggtcggtgaagacggagacgcctaacaaatggcggcataataggtcagccgtgcatgtagagacaccagctggcggtggcaaaggcaagccggtcggtgaagacggagacgcccaacaaacggcggcataataggtcagccgtgtaggcggagacaccagtcggtggcggcgaaggcaagccggtcggtgaagacgtacacgcccaacaacggtggtgtgaccaaccaaccgtataggcgaagacaccagtcggcggcggacaaggcggccagttggtgaagacaacaacgcccaacaacggtggtgtgaccacccaaccgtataggcaaggacattagtcgatgacgacgacggcaagccggtggtgatgttctgactgatccattcctggagcgtaggagataagcttaaagccatgaatcccttttatgcatatctggatctggatcctgcagaacaaacatataggatgagtagtatctgatgtaaatataatactcgatgaaaattcaagtattttaaaatgtttataaatatgtatttctcctctcgtcaattttgatttccacgagcagatgactcattacgtttaaacactctgcccgactagtcatagccaccaagcaccgggagtcggcctaggcacttcccaaacatgcatatgagtgacatgagttcatcattaatggaacaaagtttcacggatcagaatttactactcgggtacttttgcaattattaagagcagaaaataaatttatcttatctctatgcttatgatttatttcgagtaatacttagcaccttgagttactcggtccatccaacgagcccccgggtgctaggaattggcccatatccattgacaaaccaaacggaaagcataggaagatagaactccataactcgatcgaaactttattgttactcggattattttgccagcaatcaagataaatattatgaaaaattgttaaaaaatatgatatagtatctgtagcccccgactcactagtcaacggcgaaccatttgatgtagtgaggcagaggaaaaggaaaatatcatataaagaaaagtaatgatgacttagcttttttttatctccctcggtgacgatagaggtgaccgatgtgggaaacaaagtcatccatcaatagcaatgaagaaaccggacagcagtggtgaaggcaagccggtgtagatgacaaggcccatcaacggccgcggagtctgtcaaccgtataggcgaaaacaccagtcggcggcggaagcaagccggtcggtgaaagcgaagatgcccatcaacgatggtgtgaccaaccaaccgtataggcgaggacaccagtcggcggcggcggaggcaagccgacggtgaagacatgtacgcccatgaacggtggtgtgaccaaccaaccgtataggcgaggacaccagtcggcggcgatgaaggcaggccggcggtgaagtcgttgacgctcaacaacgatggcataatagaccggctgtgtaggcggagacaccagtcggtggcagcgaaggcaagccggcggtgaagtcatagacgcccaacaacgacggcataataggccggccatgtaggcggagacaccagtcggcggcggcgaaggcagaccggcggtgaagtcgtagacgcccaacaacggcggcataataggccggccgtgtaggcggagacaccagtcggggcggtgaagtcgtagacgcccaacaacagcggcataataggccggccgtgtaggctgagacaccagtcggcggcggcgaaggcaagcctgcggtgaagtcgtagacgcccaataacggcggcataataggccggccgtgtaggcagagacaccagtcggcggcggcaaaggcaggccggcggtgaagtcgtagacacccaacaacagcggcttaataggtcggctgtgtaggtggagacaccagtcggcggtggcgaagacaggccggcggtgaagtcgtagacgcctaacaacagcggcataataggccggccgtgttggcggagacaccagtcggcggcggcgaaggcaagccggtcggtgaagacgtggacgcccatgaacagtggtgtgaccaaccaaccgtataggcgaagacaccagtcggcggcggcaaaggcaagccggtggtgaagacgtagacgcccatcaacggcagcataataggccaaccgtgcagacggagacagctgttggcggcagacgaggcggctgatcggtgaagacgtagacgctcatcaacggtggtgtgaccaaccaatcatgaaggcgagaacaccggtcgataacgacggaggcgatttgataaacaaccgccattcgggagtacatgcaaacgatcaacaaaccattaatagattagtacaatatatatcggtgcatgcatacatgtttgaatgtagatgattcgatataagttaatcgtaggcttttgggctgattctgattggcgtatacatgtactccagatgcagatccatgtgttcgtatgccagcccaagcatatatatatttgtacatatatccatgtacagcttgtaatgacttgatgacgtggccgttgagcctccatagccgaggtggagtacgcacgagtactgcccaaaaataatctatcgcttggcatcgacggtactgtcaaaaaagtattgctagaacaaaaaagtaatgctagaacagatcaatctgcaattagaaataaatataatatatatggataagaaacgaaaaactcggatcgagcaatgaggctgaatcacgagtgacagccgacgacgcgccatgcagcgtatataagcccctgtagccgacgacagcttgatattcagcactgctccgcgtgcagggacagctgctggacaacatgatggtgttcggatcggcggccggacgtgcgaggtcgccgaccgcttcgccttgatctcatagttgcaaatagtaatgaaaaattaatctgataaaagtttgatcggaacggcaaacccgagtggaaaattgaaaccgtcgaacttatcgagatcaatctcatcacatctctagaaaaattggttccatcgcacttctcgacggaaaactcgacgcaacccctacctagtgcgccaactgtcgaaacataaattcggcaataataaaagggggtagcgcacgagacctaaaaatggatggatgcggagacgaaggatttagacaggttcagaccctcttgatgagaggtaataccctactcctgtttggggatttgaatccgccgggtgtagtatagatctgacgatttagttgtctcatgccccctagagggcctcctgcccaacttatataggatggggggcaggattacaagatagaaaccttaaacaatatggtatcggtttcctaaatctactttacaatcttatcaaaccaggactttaggccgtttcataagaaacgtaatacccaagtcatgatccgttacatatttcatagatataagttatcccctatatcagtcggataaccacgccgtgtgggtatgaggtacccataatctccacatcgctgtcaaccggagccacacagccgtgccatcgatttcccctccccggccatcgcgcccgccgctgctcgccgccgcttaagatgccacctgattcttctcctgctcctggtgttccccgcttcgttgctgctcctgtaaaactaccccgtcacaccggcaagcagcacacatctgtacaacctgtacatgcatgtacaccgttcgtcgattcaatttctctcagaattcttccgtgacattgccacgggtagatcgcgtcatcgccgcgagcagcgtgccagcgtccggccatgccgatgccaccctcgtctggtgggtggcgtgtgatggcgacgcccgagcgagctagccgagccaagccgagccgccgcttgccgccgcacttcttgcccccgccgccatggatgaggctactgtggcggtgcatggggcagacggaagggtcgtcgaggaagggttggcgaggatggacggcctcacgctcgagctctgcaatttttccccttcccttctctgcttctctcgttgacgcggtggaggcggcgaacggtccgtcgtcctggtcgtcggcattgtggccgtccaaccatgtccgccggcgaacgcaaagcaagctcgggcgactggtggtggaggcggcgagttcgggcggtcggcggtggaggcggaggcagagcgcgtccttggctcgccacagccatgtgttctctcctctgctcacggagagagaggcaaagaaggagagaaaaaaaaacactgacaagtgggccccactggtttctttatttgtttttgctggctgtatcgccatgtgtgtgccacgtaggtagtaaaccgctgcgatccgtgttaggatggtaatttgtcgggttttaagagtttggggtgtcaaatgtccggttttcgagtttaggggggcaaatcggttgaccccaatagttcagggagtaattcgtaatttttcctttatataataataatccttgtaagaggctggcgtagcaatgcccgctagctgcacatgacgtgatagagttatttggcatttggccacgccaggcggccaaaaggttcagatttacaaatacgttttggaatggtctgttaataaaattaaaaaaaataaaaaagtctaaaaaaaaagttttcagacataggtgggtggcgctcaagtaaatccatctctggttaattactcgtcgccccaacgtaacagaaagaatgcaaggaccaggcacaacatgagccccaggctagtaaagccatttctaaccattcactgttggcacatgattagcaagccatttttttttagaattacacagtacaatgcaaacactcacaacgcacgcgcactcacccctatgagcatcttcgaagactgggccggcaaattctggaatttgctgttaaattctagaaaattcattcccatgagaagtcgaacccagaatctcaggtgctactgagactcttgtaaccagtatgctacatgccttttcgcgaatagcaagccattttgcttctcctagaaatgagcataaaatgtatttttccccacctgcatgttctcaagagactattactagaatacacagagtaagactgatactgatgaaacaaaaataacagccacacaacacaataatttgctgcct

SEQ ID NO: 60702 - DNA, 729 bp, Oryza sativa
ccatgcattcagaaccccttagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttg

SEQ ID NO: 60703 - DNA, 1051 bp, Oryza sativa
gcctcatctggaccctggccctcaaattcttgactggtctcaccctgttccacataacacaaaaaaggaaatgaatgtgatgatgattattattaagaaaacagatagcgtaaaattgcattcagtaatccccttcttggtcagtttctggagctactaattgctgaaatctctcatttttgacttattaaaagcatcacacatgttttgcaaatgttggaagaaggatacagccacagctcaaacaagagagcaacaagtgaggagtcaattaattatacaattaaacgattagatattagaagttttgcagcatccaagaaacaaataataataggagttgaaactaagaggatgaattaataatcaatgtatccaggtctgatcgagaacttaccaataaacaatttccacaatcatactctaattggaatctgctagtcggacaattgggaagcgtctcgatggtagctttgatgaggcttacaacagacctggtgatgctatcgtccatatcttgtgccggatcatagataccgtcagagtaaatgttgccccatataccaatctcaactttggtaagggtggagagattctggatgccaaaatcagaagcaccattcaggcaatccattccatgtaaacggaattcaagctggaggtgctcaagctttggcattgaccctgcttcaaactccagcatggtcccacatctcttgattcgtaacgagaaatatctcaagttagacttctgaatccttggttgccacagatgatgatccttccattggtgccacagagagttctgactttcgagaaaatgcaagctgggtattgctccaaggatcttaacatcatttggtcccattctacggatccagagttgtaattcagtgagggtttccaagatagctcatccagtttgggaccttacggttgtaacagcctttgatatgcagcttccggatgatgcaaggagtaggagggtaccaaggatccagggtcagtggggccgccagtcaaatatagatgatgaaggttgctagacagt

SEQ ID NO: 60704 - DNA, 11538 bp, Oryza sativa
atctaaacagggcctaagatcaatactgaggtatggtatgttcaagttcaagttcaagtttaataatataccccactgtaaactccaaattatgggtagccaattcatacaataggggcttactatactattaatatctggtcctacctatcatatacacattacttcttggaagtccgtactgaagctggcttcaaatcggaagcccgctgctctgggttctcttcctttatctctttaaaatatgttaatacctggctatataccttgctattggacttgctctaatagaactagtatgttcattttatgtgtgtgggtaagatttttcttgttatgattctcagatcaaatatatcaattaaaaaattacccgttaaaattatatcccttaaaaattacatatttcaaaattttatcacgataaataataccattaaaatttagtcatatcccttaaaaatacaagtgtaaagttagttggaaaatattagtaaaatataggcggatgtgatatgaatgatctgttggagtggaaagagatatgaatgaggaatcttttttggatggccatccatatggacatactgaggatgatatttggatgatctcctgctggaaactcctctcctcggcgtggaccttggaggtttcggtggattacgcctctgttgattgaagacggaaataacgggttgtaagtggtagcccaggttcacaattctgatgaaaactggtcgaattccatgaagtttcgacgtttcgacatggctcggaattaagttttgattggaatttcgaaggtaaacaatagatttggtcgaaattcaattaaaatttatcaaaaaccgatcgaaatttatcgaaaatcgtgataccgatggggctcgagatttagtactcaaccggtaactgaaaccctgcttgtagccgtgtctaacggatgaaggcgtaaattcatttctgactattcgtgtacaaggcgtatttctgatttcgatggttttaattggttaaaatgttaaattgaacacctttacaaggccggatccgtggcgcaatggtagcgcgtctgactccagatcagaaggttgcgtgttcgattcacgtcgggttcaaaatccccgaaccaaatccggatataatttttttatttttccaacctaatccttttatttatccattatagttttccagatcaggttttcaaagctacttttattttttagaactagcaaaattgactgtgcgttgcaacgggaagaatacttttattttttttatttttccaacctaatccttttatttatccattatagttttccagatcaggttttcaaagctacttttattttttagaaatagcaaaattgactgtgcgttgcaacgggaagaatacttttatttttttagaactagcaaaattgaccgtgcgttgcaacgggaagaaaagatgagaaaattgatgaaaggttgataaagatttacatcatctaatacttgaaatacaaattttccagaatatttaggttttttttaagtagataggtatatgattaaattattttactaataaagtaaatgtgacaaataaaatgttatggttagatttaatttttatgaaattctccatattaattacactttttgaatttttattagaatttccatagcttaattgctaattttgataatacaaacatcattttagcatttatttaaataaaaatcccgctttcagcccgcaaccgagccggcccactttccctaggctgcaagcaagagcctagccctggaagcaaccaaagtctaattagcctccccaactcctcctcttacttatcttgtggaccataaccaaaaatctaattagcccgcgcgtggcccaacagggctgcggttcggcgttggagcctaatgctcgatcaatatgagctgttcgttttgatagatggctcagattagttccgaatcaattaaaaccctggtgccaaaaaaatcctaacccaagcttcattcctacccccaccgccatcgccgccctcctccccgcacccagcgccgcctctcctcctcccccgcccctcaccggcgccgtctctcccttacctctcaccccaccgacggtgcctcttccccttctcttccctcccctctacccatcagtggcaccacgccctctccccctctccttcccgtttcgtcggcacggcgtgacgacagcggggtatggcccggagacggcggcgacagtcgtccctccctctcggcctctttgtttttgtcggcgacggcaccttctccaccctccagatctcgatggcttcccgtgggcagatctaggcttggcaattttgcccatgggtctgggtatccgcgcgaatacccggttcgatgggcacaggcttgggtctattttgttgcccatgggcacgcccgcccgagacccgaaaaagtagcgggcagcaaccgggttttaatttctacccatggataacccatgcccaacccatgggtaacccgtgtcaaagccggttctttttctcaacttcaaacttcaactttttcattttctgttagcacgcttttcaaactattaaatgtggtgtttttgataaaaagtttttatatagaagttgtttaaaaaaataaatctatttttcaaatttataatagtcaatacttagagcaagtttaatagtatagccaacgactagctccaaatcatctatagctaatctaataacacattcatacaatagttaactatgaaaaaatactacatcattagagcaagtttaatagtatagccaactactagctccaatacatctataaccaatctaatagcttattcatacaatagttacatactacactattaatacctggtcccacctgtcatagacatactacgtcttggagtccgtgctacagctggctacaaatctgtagcccgctgctcttctctctccttatttatcttcttaaaatatgtttgcagctggcttatagcctgctattgtacctgctcttaataccctgtctcacctctcatacacacgtaatgtcttagagttcatgctgcaattggctacaaatctatagcccattttcttctctcttcttttttcttctcgatatgctggcttatagacttgctcttagttaatcatgttgtgatgagatttcttgttttacgtgcaaccaaaatctatctccaaaccgctgcatcgatcggggccgtcccttctgttggcccatttatagcccattaatcaaagaagtatgaggccatatcctgtgaaaatgcaccaaatgttgcaaacttggaaatactaatctccaccgttgcatccaatctgaacgaccatgataagctcccatccactctctcacctgttggatgcacttttgcagaaaaccgcccgcacctggctgcatatgttacaaaaaaaaccctatactcatcttctttatagattctatccctctcatcttgtaatgtactgctaccatgatttgttccaacaaagctcactggtcgactcctatggccagcgagacggcggtcgccggtcttgagctgcgccatgagccactccatctcggcgcgcttcaagaccgccttcaccttcaccccgccgccgccgccgcagccgtctcttctccatcctcctcctcctcctcctctgctggttcttccctcagcaggtggacgaatccatcctccgcggtggcgatggcgaacggcatcggcgctacccaatcccctaaggccgttagcaacctcgcccccgaccgctcccctgacctggacattgagttgcagggctacgaagggaatcaagtcccaaccagatctgggccaaggtattctcttctccctgatgatggatctgtgcattggagcctggtgaggtagagcaaggattggagggagagcacataagtgctcttggttttttttctctgatttcttagttagaaatgtgcaataaccctggaattgttctctgattggagggagagcatgagaatattgcttgcatgctggaattctataaatgtaactcacacatcatagtccctgaaatgttttttagtttctaaaatgtatatggatctctatttgggaaagtcactctggatgcttgtgctttttattatataattttttttacaaatgcatgtgcatctatccaaaaagattcatgtacaagtttaatttgattacgcgagatgttgctcctattatctctttgtgcaactaacaacataccatgaataagtatgtgcatctgatcacaaataagaaacattctacatctgggcatgccaatgagaaacattcagtagcagttgaattttgttttgtgtctcacaaggaatagttgttttttttcctatagagaacatctgcaaattgtgcataggaagattcaaatgtggggaggaggatgttgacttgaaaagaagatggaagatggaaagaagatggaagatgagactgtttaagattactcatttgattttttttcaaggagttgagagatttggggactgatagctctagagcactagtgataatataatttcaagaatgggataattggggcataccatcttatgcagatattgtgttcttcttttgtatgatcaatgcatgtctaaaagctttcaaattactctggtgttatcctgtgagaagtagtctttttatatggatgacaaacaacctaccggcttgaggtgagtttattggccagggattccccctcgtcaccaaagtgtccctgggtgagtttctccatcttctccatcttccccaatcatgggttgcaacaaaagaacactactgcacccaatgcaagtgggcaagcttgtgcagaggaacacaacaaatcaaatgcataaggaacaaatcaggtcaagaacaaatgggagcacacctcgattatgactgaagaccagccccatctgccaccgccaccccaaaccctaaccctaaatgaacacttgttgagcttttgtccatacctctggagcaggaatggaggaggaagattggatgcgaggaggaagctcgagggagtcagggaagcacataatcgtggggatttctcatcagttcgaatcggaaggagggggtaggggactagctgagggtgagaccttttcttttagatggagaggagctgagaattgaggtggggattttggaattgagagcgggataacatggtcctgatattttcagtaaaacatatgttaagtggggtggtaaacgtaaaatgtacagttggaaggggtacattatgatctcatcccttggaataggatctaacggttggtttgcatatttccaacatttaccctgtttgcacctgatatgccctcaagaagtatatatactatttaaccaaaacctaacctaatccatccacccatgacccgtacattcccagtgagaaattggcgattttaccaccacaaaataatagtttcgttggaataccattgctttaaagtgattcactacaatatcatcttaaattaagtggtgttcaccaaaataccatttttattctttttgttaatagaaatatttttactctattttacacttttctcaccaaaatacccctacctatatcttctcctttctcccatgactaggatattgcaaccgtcccaaatctcacatataggcacaataatctcgcatattttgtcccaccgacatagatagccattttaacatcatattaattaaatctaggcataaaattggatcgcatgtaggcgagcatcatattaattaaatttgaacagcacgtagacttaaaattggatagcatagatatgtaattgaattttaaaaaaatgtatatgctatccaattttatgtctatgtactgttcaaatttaattaacatgattcgtctatatgcgatctaattttatgcctataggttgtacctatatgcgagatttgggatggttgcaatatgctgggcatgggagaaaaggaaaagatagtggcatgggtattttggtccgagaaaagagtaaaatagagcaaaaatatttctattaacaaaaaaaaatgttggtgaacaccacttaatttagaatggtattgcagtgaatcactttgaagcgatggcattctagcgaaacatattgttttgcgatggtaaaatcgccaatttctcattcccagttccccagcaccttctaccgccgaggcttttaactatttgccactcttatgagtggtgtttaatgatttgtcactagacccatatgtcatggacagtgagtgacaaattattaattaccacgttgcaggagtggcaaatagttaaatttccccctaccgcccacgctcagggcggcgcaggcaagggacagcgcaggcagtcaggggcatagagcggcgctcgggcacggctaggctgcgggcaaggggcgcgcgcgtggcgtcccccagggcggctgctcggtccagggacggcggtggtgcaaaaaagggttgcgcccggcggcgacgggccatagggcggttgctgctcgtcatttgggcggcgactgctcgatccagggatgacgatggtgcgggcaaggggtgcgagaggcgcctgagagtgtatatggctcaacgcgataatcatgttgatacacgaagagtattacatataggcgccaaccttccatagaacactcgaccgatttatggaagcatgatcgggaggttttaggaaagagggctaattagagatacatgccatatacagtctaacacccccccgcagtcgcaacggcgctagcagacgttgagactggagcgaaactcggtgaagaccggtgtaggaagccccttggtgaagatgtcggcgtactgcgatgttgtgggaacatgaagaacacggacggcgccgaccgcgacacgttcccgaacgaagtgaaggtcgatctcaacatgcttggtacgctgatgctgcaccgggttggaggagaggtagacggcactgacattgtcgcagtagaccagtgtagcccgcgacggcggagaatgtagctcctggagtagctggcgcagccatgtgacctcggcgactgcattggcaacggcgcggtactcggcctctgcactggagcgggagaccgtgtgctagcgcttggaggaccatgacaccaagttgtctccaaggaagacggcgtagccagatgtggagcgacgagtgtcagggcagccggcccagtcggcgtcggagtagacggcgaggtcgcaggcggaggaccgctgaatgtggagtcccaggtccacagagccacggatgtagcggaggatccgcttgagggctgccaggtgaggctcgcgagggtcatgcatgtgaaggcagacttgctgtacagcataggagatgtcgggccgggtgaaggtgaggtactgtagcgcaccggcgaggctcctgaagtctgtgggatccgctacaggagggccgtcggaggaggaaagcttggcagtggtgtcgacaggagtgttacagggcttgcaatctgccatgcctgcacgctcgaggatgtcaatgcagtactgccgctggctgagcacgaggccagctaaattcctggtgacgctgacgccgaggaagtggtggagggcgccgaggtccttcatggaaaactcgccctgaagggcggagatggtccaatgaaggagcgtgcgtgaggaagccgtcagcacgatgtcgtcgacgtagagcagaaggtagacggtgtcgttccctcggtgaaggatgaacaaggacgtgtcggacttggcctcaacaaacccgatggactgtagaaaggtggcgaagcggctgtaccatgcgcgcggggcctgcttgagcccgtagagggacttgttgaggcagcacaccatgtcgggcttggcggagtcgacgaagccgggcggctgggtgcagtagacagtctcttgaagcgtgccgtggaggaaggcgttcttgacgtcgagttggtgcaccggccagtcgcgagaaacggcgaggctgaggacagtgcggacagtggccggcttgacgaccgggctgaaagtctcatcgaagtcgacgccggggcgttgggtgaagccgcgaagaacccaacgagccttgtaccggtcgagggagccgtcagcatgaaacttgtgcttgaagatccacttgccggtgacgacgttcacgccggcaggacgcggaacaagatcccaggtgcggttggcgaggagagcattgtactcttcttccatggcggcgcgccagagcggatcggcaaggcccgcccggtatgtcttgggcaccggagacagcggggcggcatgaagattaagccgatgaacaggcttgtggtgaccggacttggcgcgggttgtcatgacgtggtcgttgacaaccggtgagattcccaggccggacagtggagttggtgcgccggtagcacgaactgatcgaaggcggcgcgggacatgtggagctggcgggagatgcgggccgtccagtcgaggaaggccgggaggagccgggcaggtggaggctgatggagccggcccagctgaaggcggtccaggtgaagtcgacgccggcccaatcagtgcaggggtgggggaaggcggcccgagccggctgtctggggaggacggcccaccaggtgttgaggccggcctggtgggagaacagggtggcggccgctcaagcccatgcaccatgggcgagctggccgtctgtgttgtcggcgccacagctggtcgacgagtcgctccaattggtgcctgtgctggagcagtgaaatccttcaaaaaatcgagatcagtagcattggagacaccattagtgagctcagtaaatggaaacgagtgctcatcaaacacaacatgccgtgaaataataaccctgttggacaggggatcaaaacaccgatatcctttatggtagagggggtagcctaggaaaacgcacatggtggaacggggggcaagcttgtgcggtgtggtggcggagaggtttggataacacttgcaaccgaagacacgaaggtgcgaatatgagggatgggtaccatatagggcaaagtgaggggtgtggcgatcgagtgttttggtggggtgtcggttgatgaggtgtgtggcggtgtgaagcgcttcaacccagaaggatccggggagcttggcctgaaacagcatggagcgaacaatgttattgagggaacgaaggatgcgttcggctttaccattctgaggcgaggtgtgggggcaagacatccgaaggtgaacaccattggtgagaaagaaggtgcgagcggcggagttgtcaaactcacggccgttgtcgcactgaatgctgcggatgttagtggcaaactgagtcttaacataagcaaaaaagtgggacaaggtggtgaaagtgtcggatttaaaacgtaaagggaaagtccacacataatgtgagcaatcgtcaagaatgacaagatagtatttaaacccggaagcactaacgacaggagatgtccataaatcacaatgcaataactcaaagtttgtcgatgcccgagaagtagaactagcaaagggaaggcgaacatggcggccaagctggcaagcgtgacacactccggtgaggtcgccgcgtgtcatagggacgacggcagcgaggcggttgagggcgtcgtgaccaaggtggccgagacgacgatgctagagaaggtcggtgctggagttggcgaggagggcggtggctgctggtggaggaggcagtgcatggtgtagggagtagagaggaccggagctattgaacctggcgatccggtcctggtgcgaagatccttcacagagaagccaaaggggtcaaactcgacagaacaccaattatcaataacaaatcggcgaacggagataagatttttaataatagcgggggaacaaagaatgtcacgaagtgtaaaggaacggttagggtgacaaattttagagtgcccaatggaagtaacaggaatagtagagccattaccaacgacaatatgagagggggagttgggattaggtgggtgtgaaagggagaggataccggtgtcggaggtcatgtgtgcagtggcaccagtgtccatataccagtcatttgtggcgggttggtgtagcgtcgtggtgttgaaggagccggcaagggacgcttggtcccactgcgaaggagcaccaccaaaccagcccaaagggtgttgaagagccactggagtgggtggctgtgatgggccgaactggcccacgccaccgagctgggcctgctgccccaggccagctgctgtctggtaggggacgggcgccgggtagacttggccaggcagcgggccgccgctcggcccagccaaagcagcaccagcaaagggggagggtgccggccttgggccaagcacaccacgacccaacgggcccggccacatgtggatggtgccggcccatggattatgtggggaaggccactggaagccagccctccactgggcaccttgcgcctgtgctggaacggtgctgccgcctccttggttgctgttaccgccgccaccaccaccgccaccgccgccgccgttgccaccgcggcgacgccggttgctgttgcccttgccgccaccgccttggttgccggcaccatagccggtgccgtgcgctggattggcgcccttgccgccgttggtcgtgctgcccgtggcgaggaagacggcggaagaagcagacgcggcgtggttcggcttggagagttcttccaggcgaagcatggagcgaagctcggcgaaggtcgggaatggccgctgcatgggaactagagaccggaggttattgaacttctcggacaaaccgctcaaagtgttgaggacgagggtgcggtcgcggacgggctcgccgacgtcgccgaggctgtcagcgaaggtcttcatcttgcggcagtactcgtcgacggagaggtcgccttgtcggaacgtgtggaattccgtcgtgaggttgagggcacgttgctcgctgttgccaaggaattgatactcgaggccgcgccaaacgagacgagctgtagtgtcagtcgcaaggacgtcttggagaaggtcgaggagatggtgccgaagagccaagcgaggacgacacaatccatttgcacccaatcggcgcggtcgaagtggtacgcgtcggagaggacgtgatccgtgagggcgtacttgccgagtgccacgaggaagaggccatgccatcgtgtgtagttggtggcagcgacgtcgagagtcacgggaacgagtgccttgatgttgaggacgctgacggcttgagcgtggagtgctgccaaggcggcgtcgtctagaggagtggcgggtgggcgcgagaagtcggggacggtcggctccggcgtgtggacgccatgcgcgaggcgcgcagaggcgaagagggcggcgaggtcatccggcatggtgccgggaagaggcgccgtggtctcaagcgccacgccgtgggtggcg

SEQ ID NO: 60705 - DNA, 1176 bp, Oryza sativa
atgagagtggatatggctcaacgcgataatcatgttgatacacgaagagtattacatataggcgctaaccttccatagaacactcgaccgatttatggaagcatgatcgggaggttttaggaaagatggctaattagagatacatgccatatacagtctaacagcggcagaggcgcaggcaagcgacaacagagcaggtgcgggcaagcggcgacataggcgcaggccgcaggcaagctgcaacaacggagcaaagtgtgaacccggactgggtacctgtctatctttgctatttttctttactgatgtataataattaacattgcaaataatttattttattttacactgatattagggcaccaagagcagcatgattcttggttcttagtttttttaatgcatgaatcggactttttttttcgcccttctttactggttttttgttttcttatcgcctttttacgacttttttttctttgtgtcaaatcggactttcttttttcttgtttttatgttttttcgcagagatagtgatgcataagagatacaaatagatatttcatgatctcttcatgatcagagattctatctttttttctgttttttaatttttttctctattttcatattattttcgaactcttctcctcttacgagtgtatcaaaattttattcttccagatcagaggttttcaaatctacttgttttctgatatcctcatagtcaaagattctatttgtattttcagattttttttcccgatctcttcacttcttttaaattcagaggttctcatttttagttcatttcgtatttgctccacagaatcttcgtctacctgcagtcccgtcgctctctcaccagcagccatggccgcggatcccaccaccggcggcggcgaggcggagtccttcttccgcgccgcgccgccgctccgcgaccaggaccgcgtcgccggggacctcgccgacttcgtcgcccgccactccggcaagtccctcctcccctcgcctcctccttccctctcctccgatctcatctccttcgatgcgtcgcgtggtgggtgagtttgctgatctcgatcgtgtttggtggtgggtagggagcggaggaggggggaggctctcccgggtgtcctgcttcacctccggcggcacgacggtgcccctgga

SEQ ID NO: 60706 - DNA, 5243 bp, Oryza sativa
agttcataggagctgaagttgttactgcatgctcgtttacgatcattgtgtagatagacagtgcttgggacgttttcagggaataaagaagagacaaaaaccagtgtagatagacagtgcaagctgttttgtttacttttctttcttttttgatttgttttagttctcaatgcctcatttagtggaagagttgtgagtgacatcagcgcctctttgcagtgggagcaagcaaccttactgtaggtttcttccagaggattcctttcttgatttattcgagcttggtgaagaatcagatatccaaggttggggattgatcctaaattatttatattcatgccaactgaattatctgttgtttttgcttcttttttttcactttttagatgtttgaccttaattataaacatttattgatatgaactgaaaagactaaatgataaactctcatgtaagttacttacctcagtcccagaatctcatgccgcggttgtcaagacagcaataagaaattatcggaaggtataaacagttctgttttaactccatgaaactagtctcatgcgctggttacaacttacaactggtcagactggtacagttgtgtgaccattggcttggttccttgattgcaggcgattgatgaaggcctattgctgaaacttcctttcaccactatctttgagtaccttcaggttttgctcattattcctacagaaacatgttctcatatacacgctatcataaagacagaggacttagtcagtctcacgagaaaggcttaggggtcttccggctagcaccacctgggttcgagcctcacccctatcctaataaatttcgatctgagagcccttcctctcatatccagtgttttttttttcagtcagtctcacacatagcgatgcaagtggatctggatggacttggcccaatggcccatgctaattcatttgcttgaattataattcgaatgcatatatacatatttgaccagaaagtgactcatcaattgagtaaaatgggccaatggccaggtgtccagtccaattgcatttgtgctcacacgtccactactgctggtgtttcaaacattttataccttgtttcattgaatatattattatatgacttagcattgcaaaagaattcaatcacgatctgtctccaatacattaaggtggggagatgcttggattttgaaaatccagtcataatttagactgtcttagatatcgaatgctttaggaacttgccaattttctgttatgttctacagtaaaagattaaccttggcatactgttatactgatgaggaatctgatatatctcttctgcttgtttttccaatagttactgcaaatggtaggtacggcgatgaattgcttgggacgccaaggaatgttttaccttgctgcggcagtttctgacttttatgttccatgggaaagcatggtaggctctactcttctgatcatttcattgtattaaaacaaacaaatagcctatatgttcactgcatttggtgtatatatcagttaatgatgctcgtaggcttctagatggcgtttgtcattggacattataggtgcctggcttttccctaaatcaggggatccttatttaagagatcacagccccctcttacttacaccatgttagagttataccatttcaaaatcttgaaacttaggaaccatgtattggtattgaaacatatgattcttttcgtaactagttataaaaatggtagttacgtagcatagtaatggactccttgttatcagatgtttcatatatattggcatattgcacccaatgcactagtagttgcaggcaacatggtcattatgtacctcgcacatgttttggcaggctaaacataaaatcgagtcagcaagtggtcctttgaacatgcaactcaatcaagttccgaagatgcttttcattctgagaaaacaatgggctccttcagcattttgtgtatccttcaaggttagtttgatgtattttcacacttccatatggagctatggttgctcaagcttttttctgcattaaagaaaacctcagtgtaccttcattctgctcgtgttactctcgaaatatcttattttctagagtcgagatgactagacccaccttactgctggcgcctaatacctgcacattacagttgaacggacccagatatccttctgcagaaggcagaggcagctctgagaaagtatggtatgaatgtcgtggtcgccaacgagctagcgaactacaaagatgtagttgtgatggtcacaagcaatggaaggacacccgtgcgaaggcccagcaaggaggacgacgtcgaagaacagttaatcgatctcttggtagagatgcactccgaacacatcatgcagctcaatcaagacgtgcacaagctgacataacaattatactgaatggaatacgagtatcagaattcttggcaactacatcatccaaagttgttacaacttacgagccacgagctgaactatgaatatcatgacttgtaaaaaagaaaaagaatagcatatgcccacaaatggtggtaaagtatgtatgtaccacattcaggtgtcaatgttacgcctggtgcttctgtaacttactacatgttaattccctgggaaagggccttgggagataggcatgattttttttttctaagttttccttttctcaaatcatcttgttgtgatttttggacgttttgtgtagtcttccatgctcctgcttcaaattccctagggagatttttggacgttaatagattcattaacatctatatgaactgtgggcaatgctagaaagtcttataatataaatgtagattcattaacatctacatgaatgtgggcaatgctagaaagtcctataatatgaatatgaaacggaggaagtgcatttaatagcactatgttggtgcatacctagagaaaaattatcagaactttggagacgagcttgcattatttaatatggatgaagggggtgatccgatgctagtactaactgattgaaagtcaaaattgttttcattattatgatttatgacacgatatgtaaattcacgcctatccgatgctaggatcatttgatttttttttctagtcaaacttttttaagtttgatcaaatgtatagaaaatatactattattttcaacacaaaacaaacataatatcaaattatatttaatgttagatctaataaaactatttttatattttagttgttaaatttttatataaactaggaaagtcaaacaactttactgtatgaaatggagggagtaaatgacactgtgcttccccctcaaatgcacgcttagagcacccgcaatggtaaagtaatgtgctatctataaaacatgtacatctcagcaatagactagattaatagtaaatcacttcaatggtatgtctcaatgggtatctatagctctctaattcattgcctcgtttttctctatagactatctctaggttagtagataactttgctctctctcttcatttaatctcttccaagtagaaaaatatgctgacatggatctcttgtagatagcatatagataaccattgagggtgcccttaggtatgacgcggcactatggaggcctaagagttacggtgaggctcaaaggttgcggctggaggttgaagaccgttgacgagtaggcctattggcaatgaaaaaggatactaacatacgggggataatacgggggcttatcgccggttatggtagctgtcgaaattgctacatctgcgacaattcaaaacaactgtagttgacagccattgacaattgtcacgactatagcggctgcgacgacaagtttagccgaacacgtctataaacacatgataacgatggcccagtaacacatgatactcgctccgtcccaaaatatagcaacttttgcttagatgggacgtattctagtactacgaatctagacaaagcaaaagttgctatattttggaatggagggaggaggttccatggatagtattgacattttttttttcaaattgataatgttaccaattcaattaatcctattacaatacaaatgagcaaggtgaaacaggagacaaaagagaccctgtttagatgggactaaaacttttaagtccctatcacatcagatgtttggacactaattataaatatcaaacgcaaactattaataatcttggactaattcgcgagacgaatttattgagcctaattaattcatgattagcctatgtgatgctacagtaaacattctctaattatggattaattaggcttaaaaaaatttgtctcgcaaattagctttcatttatataattaattttgtaagtagtttattaaattagtgtctaaatacaccgaaacactagttggcgcatacgcgcgaggtagcgaagtcgcgcgctgctgcagggcaggcccaccagggccacgtgatgtcacgcggaggtacgcgcagcgcgatgtttctttttttttccattttttggcgctatgacgtttcttttttttttttttgccgtggactacacggccctgtcacgtttttttttcacatttgactaccgcacacgtaaagatttaaaactttcaactcaagaatttttaaaatttttcaacttagatttgaaaacttttaactcggacttgaaaactttcaagtcaagatttgaaaactttcaactcggacttaaaaactttcaactcaaaaatttttaaaatttttcagcctagatttgaaaactttcaaatcaagatttgaaaacttttaactcggacttgaaaactttcaagtcaagatttgaaaaattttaactcgaacttgaaaacttttaagtcaagatttgaaaactttcaactcggatttgaaaattttcaattgaaaatttgaaactttcaactcaatttttttaaaaaaatcaaatcaagatttgaaaactttcatctcaaaattcaaagcattcaacttaaattttaaaaactttcaactcaaatttaaaactttcaactgaaattgaaggtgaaagattcaatttataaaatatagcacgaaaaaaaaccgcgcgaccacgcgaagaaaataagggagcgattcaagaaaaaaaaagcgaaaaccgaaaaaaggcgaaaaaaagaaaaaactaccggggcttagtgcgtctgcgtgtgcgtgggccttgcggcgtcgttactatgcta

SEQ ID NO: 60707 - DNA, 863 bp, Oryza sativa
acgtgtctcatgtgttgggacgaggctcatgtgttgggcagtcacggagtgcgggtaaagtgtacatccactgcagtgtgagtaaaccaaatctattcgaatagccgtgctcgcgttattgagcaccgggacatgtattacacttggctagactctaaattcttaacttgtgggggatgggatattgcatgatgaattttatgctgatggagccacattctgagaggagggaaggtggacatcctcagaaaaccatgacgattcaatggcgggaagctatccttgggatcacaatggatggtggacagaaccgtcgttgtttaaagtgaacactggtgctaaaatttgatcagtctatgctaggttttaggcttgtgaaaagaattgtaaaattagctttatgcaaaagaacctgaagccattccttgaaataccctctatcatatgcattgttgttgtggtggcttgctgagtacggttggtactcacccttgataattatatatcttttaggagagtgttgaagagaagcccttgtcggtacgcttgcgtatccaacaagatgatcggagtgcggtcttgttctaggtctcgttccccagtcgactgcttgtggcatgttaaccgggcccttatattatttggtcttctggtgttgttctctgatagttattggcctacctggccctaatgtaagtatttaactcttttagcctgaattcattcgtgatatgttgtgattcaactatgtatgtgtgtatcaactactgatccagggattggtacggataaacacagatgatttccgatttccaaaatcgggggtccacagcagcgggtgagatccgagttttcgagacaaa

SEQ ID NO: 60708 - DNA, 2856 bp, Oryza sativa
ccacgtggcgcctggggtagcctcctccctctagttcggctagggagtggccaccgccctacctcgggcccgacccctctcgggggagggccacgtggcattggggggcagcctcctccctctaaacatgatacccccgggcccatatcaccgacagtagcccccggcgttagtcctaaccaaaacctttcccaggtagtcagggttgacgccaatctgctagtcagttgacatgtgggcccgatctcctttcctatcattctgggagttgggcggtgggagtttaatcacgttcatacgtcgccttaacttcccactttcctcccggtttccgaggcgctgtgggatcgggaatttagcccgcaccttaggccgtgaacttattacctatatatactcagcaaacgttcttatattctctcgggcccatgaccttacgccgcgtacctcgtttgcccttgccttttgttaacctctattcatgttctactttcgcgtgagtgtgaggactgaactttccatagccagcaatcttcacccgcgatcaagccaagctgggcgccgtagccagccggcggggccagagccaattgctacggaagagccagcacaggggccccgggcgtcgaggcgtccagagctcaacgcaaggctaggatagagctaggaatcgtagccccctcgcttttagcaaagaatcgtttgaatggatgaaccgaatacaaactttttgttaccaaggggggcaaacgagcgcgcgacacgtgggtacgcgggaccgcgaggaagagatgggagagagataaatataagcaataataattctatgcaaacgattatcttcgcgcgagtgcgaggactaaatttccatagccaacaatctttacccacgatcaagccaagctgggcgatgtagccagccggcggggccaaagccagccgctacggaagagccagcacagggggccccgggcgtcgacggcgcccagagctcgacgcagggctaggatagagcaaggaatcgtagcccccacacttatagcaaagaatcgcttgtatgaatgaagcaaacacaaaccttgcttgcatgtcacgacctttcaaacctttagctcgaagagggcctcccaccatgggttcctaacaattttgggaagcctgcgaccacttagcaaatgaggtgaggttcccacgaggctgtgtccccacactacacattctgtttgctctttcctttcagtggcctccttccaatatctctcccttttacacggacgactactttcgcacgagtgtgagagccgaaaaactctagagccagcgatccccgtccacagttgagacaggctgggcaccatagccagctggcgggaccaaatctagccactacggaagagccaacacagggggtcccgggcttcgacggcacccggcgctcaacttaaggcaccgagggagcaaacaaatgcgtaacacgcaagcgtcgcagggccatgagaaaagaacgtggggggggggaaataaatataagacttcaagctatattaagttgaagaattgaaaaattgaaaatacttgaagcttgaaaggacgattagttgagccgggccaggcaccgcagccagccggcgggaccaaagctagccgctacggaagagccagcacaggaggtcccgggcttcgacggcacccggagctctactgcaagagccctcctaggagtagaccgaggcgggtggcaggttcatgagcgatacccgcgcttggccctggagggccatggggaagaaattcgccttggcccgatcgtcacaccacaccgcctctatgatcatcgtgtggatttggagggactcgaaggggttgacgctaccgtggtacctttcggtgaggctaggccgaaactttgggagtcatcggacattccgaagaatcgccacaaagacctggccgccagccatacccggtgaagatgtggggggcctagccccctgcttagggtggcgcggaactcctgaggaggcgggcgccttcccccgcatttgcggcgcgacgcttatctcatcggcgctcgaaagaacctcaaaaatcacgaacgcgccccctacctggcgcgccagatgtccgagggtgatctcctccatcagggaaccgtgaggcccccctttttttgttcgaccgggggggcagcgggtgagatccgaggttttcgagacaaaagagacacaaggaatttatacaggttcgggccgctatgaagcgtaataccctactcctgtgtgtatgatgattcttttgtgcttgcaaagcctctgaatctccgatgtacaagctagggttagagaagctttggctcggggatccagagttcgatcccccttcccgctaggtatggtcctccttttatactctaaggggataccacatgtgctgcgagtgctacctaggaagaagggaaaatattctctatattaatgacatgtcttgtgccttagcttggaagccgcatacacgtcgtctcggtcgtggggcctaccacatcatgccgcctaacacggggggcgcccatgtcattcactatttaatgggtgaagacttccgggttctcgttcgcaccaggaaacgggaacccgggtcagttctgaccagggtaagaggctgtgaagcccctcattattatgatgggatgggacggagaacgccgcacgccgcctgacaaactgacagggcgagggtacacagccgccgtcccatcggtcattcgaccggtcacggacctgtcacagatcggtcacagatctgttgagtgcactgcacgccacattaaatgcggcgtggcgcaaccgctcaggtcgc

SEQ ID NO: 60709 - DNA, 608 bp, Oryza sativa
ataattaaaagaacacactgttccactgatggaaagcatatcattacttaaccaataaacaatggtttgagccacaatgagtactagccacagaaagtaactacgtggttgattaaaagacaaccttttggcaatttaaattgactaaggtttctcctttgagtggcaaaattgacgattaaaccatcattctaagtatcaaaagccaaaataaatatcacaaaatgctcacgacaatttattcagaaagccatgaccaacaagtggaacaatttgaaagatcttagctcattttagaattaaaaagaaaagaaaagaagggaccctaggaaagctgaattcataggaaagcatgaactaacattaaaaatatgtaatctgtcaaagttacccatgctgtcaccatgcatgatgacaagaaaaaaacaagtatggcttccatggtagaaaagaggataaaaggcagtaagtgtattgttacctcccctgggggtgctgctgtgcgctgcagctgagcatggtggtgagggacagcatcctttcttcctctcacctgccatattttcatctcctaacgttagctccttcccacattcttctgtgtcccg

SEQ ID NO: 60710 - DNA, 6348 bp, Oryza sativa
  unsure (1)..(6348): unsure at all n locations
gccctccgggaaaatccttttcctttttctttttcttttccctccctttttccctctttttttcttttcggatgggccgccggcccattcccctccttcctccccctcctccttgctgggccggccgcaggccgagggcccagtccggcagccaggccgcccgctgctcctctctcggggtcgccgacaggtggggcccacctgtcgggcccgtctccctcctcccgccgatcccggcgcgccgccgcgccgaaaccgccgccgcgcccacgcctccgtctctcccgggccacgtcagccacgcccgcgcgtgcgccgcgtctcccgcgctctttcccctctccctcccgttcgcgcccgcgcccgagatggccgggattcgaaaaccgaatcccgcctctctctcctcccccactccccacgtcggccggcgattcccgccgctcccggccacgtccggccccctctccccttatttaagcatcgccggcaccccctctctctttttccccatttccccgacccctcccgtgctccccatcgtacccgcgccgtgcaaccacccaccgacgcttcttcccgctactccggccgccgctagccgtcgctaggctcgccgccgtcttgcgccgtcgccgccgttcgattcgcgtggccgagatccaccccgtccacccctcctccgtcgaagttcatcgccggagccctcatcccctcgcgcacgggtgagcaccacctccaccgccgccttcggccatggtttccgatcgccgtggttcatctccctctctctaacccctcccaaccttttctctaggtcctcccggaacccgtcgccgtcatcctcccgtctctcgtcgttgccgttcgccgtcgctcctccctcgcgccggccgagcccctcggtgaggatcggtctccctctcttcctctctctccctttgccgcgccgcccgccgcgtagcgccgccgctagggtcgctcgcgccgccgcttcggccgccgccgccgtctttgcgccgtccgccgccgcctcccgtcgccggttgccgtcgctggcaaccgtgcgcgcgcgccgccgccctcgccataaccggccggccggcttgaagccgagccgagccaccagccgcgccccctcccgccttgtgccactgtcagtggggcccatgtgccggcgcccctccctctctctcttgagccgctgcccagtgggcccacctgccagccgccccctccctctccccttgtgccgctgacccgcgggtcccgcgtgtcggcgccacccctccttgtgctgacgtcagccctggggtgaattattgcgcaataaatacattaaggcttttctttaatagtaaaaacacagagaatcttctaaaaatcataactaattcatccgagctccgattaagtccattcaagtctcagtaaattcataaaaatgtgtagaatccattaaaaatggttttgtttcctgtttcagtagtcttatagcatgttttgcttgtgtgctttgtttgtcgcgtagatttcgcccgtttcgtcgattcgtggtttctcgaagacgttgctgtggtctcatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagtcatgcttagttcaactagtgcacaaaaggggaccacattaaagcatagacttgattattggtaaaagctttggattagtgccaccgcattggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcacccctagtttagcttaatgaactggctagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtaccgtgggtagtactcagtcttgctctcttttcccccacaccagagttgaagtccttctcagttgaagatgtctcgaagaggttggtttcgtcgctgccgtcaaggattgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaaacctaagagccctctgaatccttttcattgcatatattctttgcaattggatttgtttcgggaaaaatttggggttttgcctctttggtttgtgggaaaaatcttggtcgttcattcggatcggatccttaaaattagctcggtctagggttttagaaaaattttatttggagttatatttgacagtcagttggggatttatcgggtgatatgcattaggtcgtgtctatgttcgatggggcaattttatgcgcatcattttccatgcaactagtttatgcattaagctatggtttagtcagtcgcattagtgtctttatccgggttcatgaaaaatgttctatgcataaaaatcatcatgctcggcaagttacttgagtcattcgttgctttatttaatttggttttgagcatgtgttggttcctatccctctgtactctttagatgtcagacctattctccgatcgcaagcgccgctccaagcttcagagtcgccgcccttagctttatcgtcttcttagtctgtttgcgtgctagtttttggtgtttaggtttgttgcttgtgggttagtcggcggtcgatatcatgtgtgagtggtatgacagcctttattaggagttgtgtgcctctttttcagtgttttaatcaagattaagataatggcacttaatttcataagaaagattagtttccgagccatctgttttcttcctttctcttatttctacctatcccctccagatggtgaagacaaggaatgatccccgtgactccagcgacgccaggggcagcgaagagcagaccgatggagctcatgtcagtagtgcatctggcagcagaccatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctctagcaaggaaccatgtcagttacagagtacctgcacgagttcaaccgccttgcgcgctacgctcctgacgacgtgcgcaccgatgctgagaagcaggagaagtttttgtttgggctagacgatgaattgaccaaccagctaatctccggagtctatgaggactttgagaagcttgtggacaaggctatccgccaggaagagcaacgcaacanaaannaanaaaattttaaggnaancccnccgnaaaaaaaagaaagacagctcagatcagctttcctcaggggaacaatcagaagcctcgtttcatgacgggacagctaggtgggccttccaccctgatcgtctgtcagcaccatccctatcacccgagtaacttcgacaacgactacaacggtggcagtcacaacaacagtaagcagcacaaccacaactcgactccacccccactaatggcaccagctcagtcagatccgccagctgtgtcagctcagtcagaacaacccaagaagggggctgtaggaaagccaggacactgcttcaactgtggcaagcacggccactttgctggcaagtgtccgaagctgaatcgcactggacccaggctcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgtccctcggtgactatagagatcaagagatcaccgtttctatccaacctcatccttctcgaatctaaagacctagatgtcattctcggaatggattggttgaccagaaacaagggagtgattgactgcgcaagccgcaccatcaccctaaccaacgacaaaggggagaagatcaccttccgttccccagcgtcgcagaagtccgtagcgagtctgaagcaggctgctattgagggtcagacagaaacagtggagaaaagttctaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggtgatctttgtggagaagaaagacaagaccaagaggatgtgcgtggattatcgcgcccttaatgaggtcacaatcaagaacaaatatccgttgcccagaattgatgacctgtttgatcagctaaaaggagctaaggtgttttccaagatagacctgcgatcaggctatcatcagttgagaattcgggaagaggatattcccaagacagccttcatcactcggtatgggttgtttgagtgcacggttatgtcatttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtaacttctggttatcggaggtcaaatttctgggtcacgtcatttctgctcaaggcgtggcagtggatccatcaaatgtggaatcagttacaaagtggaccccaccaaagacagtttctcagatccggagttttcttggacttgcgggctattaccgtcagttcatcgaaaatttctctaagattgccaggcccatgacacagttgctaaagaaagatgaaaaattcaaatggtcagctgagtgcaaccaaagttttgaagaactcaagaagaagttagtctccgctccagttctggg

SEQ ID NO: 60711 - DNA, 2988 bp, Oryza sativa
tatgtggcatgcaaccctgagctttttgtccacccaggccaatgaaatttgtagattcgattataaattgatgttcagcactccatatttgtgaagtgatcccatggatagtggtgacaccaacggtttctcatcgttgctcaactcttgttacttctaagtgattttagtggttcctcatcgtagcatgttaggggtttgtctcactactaagtgattttatttttattttcttaggtatatcgttgatatagaagatgggatgtaaaatatgtttctttataaaaaaacacacaagaagttgcaatccctttacaacttgatggcagtaagtgagaaagaacagcaagagttaagccattgctcccatgaataaagaataagacgagttgctatttttttatgttgtacatatgtgttaaagatggtaataggtaagagcggcatgtattatttttgtgtcccttgtgaatacaaaaataagacgagttgtttgttattattttagttatcactacatgtttaaggtggtagtaggaaagagcggcatgggttggacagttcccgtgaataaagaaagcatgattgtttattgttttagtagtggtccctgcatgttaaaaggaagggccaaaccactaatgaaaaaagtagacttgagcatatatgtggtgatgatattattatttttggctccaattagaccttcttctacttgtactctaacagcatccgttccctatataaaggggaaggatgatacattatgcgaatagccaacttgctcacccaacttctcctagctgctcaaatactcatatgcatgttgcctctgtgaccgcttctcgtcttcaagcccatggattcatcaagacaactaccatcttgccatcctacagtgcctccccttgcttctccctaagctaagggaatatcacagcctgacttttcgttttaggacttataaattgtttttataatttatattaaatgttcattaatttacaagtaaagttaaatatgggaaataaaatttcctaaatataaagcatggctggatttaatttgtattaaattcttcatgattaattatactctctggaattttgtcggatttttttcagagctcaattactaattttaataatacaaagaacatttcagtaattatttaaataatgaacaaatcattaaaggatctggttttaatgttgttaaatactttgagtgtccaattattttcaggatttttcttgaaattatttgagcactagaaatatttttaacaattcagagatcatttcagtgattaatttaactagaaaagtaaattaaatccccttttccttttccggctgaaactggaaaagtctatctgtcatcctcagcccatccgtcctcttcgccctctgctctatttatggcgacggtgccgacagggctccacctctcctcctcctccaaccagcggcccaagtgggggactgcgtggcaggagctcggcggcgcgcgagtggagaaaggcgcagcgggatcttgggaggcgcgaacaggggacaacaggagctcggcagggcagatttggtggtgtggccctcttcgccgagctgctgctgtacgttgtggtcctcggctacgcgcaatggcgacaacaacgaggtttggtcatcatatccaccgccgccatcttcccttctcctccctaggccgttgccaccaccatcttccttctcctccctaggccgccgccgccaccccgttgagctcgatagatccgaccttgggtttgccagatctagcgagcggcaccactttagggacgacacacctactcggggtgatggcctcgccagcaaccgccgccgtcacgcatgggatgtgagggcgtcgcatggggccatagcctctcaatgcgccgctccacctgcacctcgccccatgcctgcaagttttgacgaagaacgcgtgacttagtttggctccgcggtcttgagttgggagcaccacgcacgcatctggtgaggaatctcctatgtggatggggcagaacaccacctcagtgcactgtgaacgcccttagaggctcatcaaagaagatggtgttgtggcttttgctcaaaagcttgccaagacacaactctggcagcccacacatctccgtgtgacaggttgagaaagtagacgaatttccaatagtaattcccaattctttattggtaaatgcctaatatgctactaaattttttaccatgtcttttattaagccactaattaccttactgactcaggagtctaaacatcgcatatctgacattttattatatcagtgatattatatcttggggagatgagcaatgcatcgttgtctcaacagtggttccaaccttttgaaaaaagtagttggaactaccatcaaaaccaatgttcataaagcattgatacttggggggcccactaccaaaaacagtttccccacttatctcccccacccacttcacacacacactctctctctctctctctctccatgaaaagatcattcttccccgcccctatccttatctctctctctctctctctctctctctctctcacagaaacccatctctgcgcccctcagcccgtcactgttgtgcctctgcccaccttgtcctcccctcctctctaaacccctcctcgcttctccccaatccaaatcaatgaccaaatcaaagacaatgatacctcgacgatgcttctcctgttgttgcttcctctgtctctcccgctcctatcctctcattcttagtcaacaccgtcaaccacatccaggccatggcttggggtgatgagctccactgttgcatagattgttggcggctagggttgatgagctttgcggcgacgcggggctgctcaaagcctatgaatgagctcagcttcgaggtagatccgtccaagtgcttgacagatcaggtcatggccaagtcctcctcggcagcggcggca

SEQ ID NO: 60712 - DNA, 34639 bp, Oryza sativa
atataactaggatgtgtctaattagatactatgttgctatatcttgggatgaaggcctttttttcctttctagttaacatgcagatccaaccttgattttcgttagcacatttttaagctgttaaatgatgtgttttgtgtgagaactttttatataaaagttgctctaaaaatatgaaataaatccatttcttaactttaaaataaataaaaccttgttaagcatgtgcttaatagctttctcgttttatacgctcatatttactcaattagattcaaacgcttgaatggagagaaagtatgttgatcggatgataattataaaatcttggggttttaaaagcgctgaatcgtattgggtggggaagagtctagcaagctagcaactgtgcttgtgggaatatatactgaaacaaacactttatatgaaactgatttagtattattttcaatacaaaacaaacacattatcaaaatatatttaatgttgaatttaatatatgaatctgatttagtattatagatgttgataattttttctataaatttaattaaagttaaaagaattttaaaaaaagttaagtattttataatatgaaacggagggagtactcagtactagctagggtctgaaagtcccagagagtgtcttatacgcagatatcctccccgttccatgacatacgatgttacgtagctgtagctggtagatcgattgcagttgttctctcgttctttctatccatacttgcattatattggcgtattccactgttcctactcaccttgtactagttggctgataggcgtagttttctatgggtgcttgaacgaaggatttgtaaatggtttgagttggattctccgagggtgtttatgcttatacttatcagctaaaatttaaatttttaatcttaaatttgaagccaattttaggattttttttatcgaagtttattttctaaccattgcttttaggtcgctaaaaacacgtatataaaaattgtattcacaaattatttttcgtttgtaaatatttcgtttggtttattccacgaataagcgaaacattggggccacgagtttctcgcactacaagtaatttgaaaatgaaggtagtacgtgtcttcgtacataagtacaagttatttattagttttagctaaaatattaaatgaaattatgtacgataaccatatgtagtgtacttcctctgtctaaaaataggtttattttttatttatcccacatataacaatatgaaggaaaagattacaatacctcaactttatcaaattttaatgtaattgttcaactatatctacttctcagtgcatttatactctattttcacaaactctaattaataccatgattttaaaaataaatttattttgaaacaaataatcttatttcggaacggatggtgaaggatgtacatgtatacaagttatttatcatagtggctactatagcagatagctgggctggctatgtgcggggagcactgaattgttaatggttcgacggagtctacatcgatctctactcgcttgcagttgcagggcgaggtggcgggggacgtgtagtggactacataccatgttttcttatgctaggtactactatattatttataggaaaatattgtgtatgtttctattatacagttgtagaaggtgtgatgaaaaaacaaaacactgtgcacggtgtgccgtactcttaaaacactatgatgatgcaaatcataggcaaccacggatagatatttaattagcgaaaataattttcttttaatgtttatgcaagtaatataatattagcttttattgggtttagctttctcacctgtggtgttacagcatgaaagctcaatttttagcaggaaggctggaattaaagaagtgttggcatttagtcgtgagtgcggccgtgcggctgcgagtgggcctggctccaggcctgttcggttacacggcctcgggctccgttcctggggcggtcacatgttgtgggcccattgcaccgtgggcccatttggatccccaccttcgacaagacgtaagcccagagtccacagatccgggcccacaagctggtctcgcgccggtcaacgggcagctcgtgacgcacgcgagtcgcgtactagtactgctgtactgtgtgcccgacacaacctgaccagctgttgtacttgcacccagcctctctgtgcacgagtactcttttccgataaaaaaaaaattcaatcctagctataaatataaaaatatacatgtgtttacattcttaattaagattatttttttttatgaaagattgagcattcatgcaattcaaaacaaaaaagttgcaaatttgcattgaagttcccacccgacgcacgatggactttacttcctttatatctttcataaaaataaaaaaagaattcccatatatgattatcaaatttggatttattttttcctcatatgatcatgatcaaagttggatggaggatgtacatttaaacatacataaattctctgcaaaaatacatgagcgataaaaagttaaaaagtataaatgatatatttgaaactactctagtaaacgagtagaggaaatctaagcatctctaatctatatttcctataaagttacaacccacaaactctaaagcttaacatacagccatgccacattatcacccactgaacatattcaacctcatacaagcatgcaacattgtctacaatatatttaattctacaaatcaacatgcaaacatatccaatcatcaccactcacatcattttcacaatatttttacaaatctatctatcatttttataatatttaacataaacttatcaatatgttccacattaaagcgcgggtcatttgtttcatgataaatactgataaactctaatatttcatttgttttctttttatccctagcttgattgtagcaaaaatatatatatattgaaaattacttagtaattcctgcagcaaagcgcggggaatcacctagtaattattacgattaccactatggctttatggagtgccaacgtggtggaaaatatttgtgggacctacaaatcagtctatccctctccttcatctcctccttcggcatgcagccaaccttccctcaccgccatcacccatgtcccgcatccagtcccatatgccgtccacaccaccatcgcctgaatatttgctcaagatggaccctgttcatctccaccgccggcgctactcgagaggcctccctcctgagctcactcctccaggctagcctcgcctcgtcactcgcagggtctacgactccacttccacgtgcagacttgtacacttagtctgcctataacctcttctctgtcgccccttcattcgaaaaccgttgtagttgggttcgttggcgttgtgggcttcccccatttcttcactctcctctctaatagggcctaggtcagcccccttcactacgctgctcccaacggcgtcgtctccactggcagctgtctccaagtcgcttgagcacgattgcacgaagttgagtcgggtggcgccatcctccctggacagtgtgactgttgacggtctttaaatcataatatttgaccgtcaatacttgtatataatgaattaacatatggcatccaacttagtggtagggattattactaatcaattccactagtgttagtgaaatatgttatgcagttattttgaggagaaaacacatccatcatgcgacaaaatggacctccgcatatttaggatgcgtttacccggattggagggcccataagtcgataaaaaccacttagaattgggccaaaatatagtgcaagttattggggacccattaagcaacctaccggccaaatgagaggctgggaggacactttttgggttcggccgaacccaccagttcggccgaacccgttctgcggccgttcatcgccagattacacgtgtacgctcctgatcacttcccaatggcagttccggggcattttggacatttcacataggctgtaaccgtcatacctgcctatataaaaggaggagctcactctcatttccaacacacaactttgaactgaattacaagatactctattgtatcttttatacattagaataaggtagagagtgaggggaagctttggaggagtgcccggaagtttggcgctcatccaacttctacctcgacgagtgtagcttcctaggagcaattctggaggagtaccggagctgtcagtacactctgctctgggttcggagaacttcttctgtaaagtaagtattcgtgttcctttcttatgttatttaattatttagtctgagtaagttatatttccatctttgcgggttcattgtttagtattcatactaagtgctctagtactaggactccagatagagaaggaagttcctgcgcaagtattagagtagtaattaataacttagacgtggtgtctaggttagagattacctttatttgttgtgtatcccacggatttgtcagaagtaggcggcaggtggtgacagccctgaagcccgtcctagtaatcctccatgttcggatacatcatagagctatagccggaaccacactggcagaccagcagggatcggtgcccgaagcaacagatagaaaattacctttgcttagcatagataattaaaactcatagaaagtcctgtctagcttagcctgcctaccactagttgttgtccttggatagtcttagtcttaggtagattacacatgtttcctgagttcgatatccttttgggtcacccgaaaataaagtgctacagtggtattccgtacacttgcggatttatctgtggttgcaagaaataccaactatgaccggcttgtgcaggatgcgaagatgcctcaccacttcatgccgcgggggagatcgagctgacagacttgtgggtcccacggctctttccacgctcgcactccacgtaggcaaagttgcaaataggtaaagaaatcacgtgacaattttacaagttcaaacctagaaaatgtatttggagatttaattgttaaacctaatattgacacatagttaaaaatttggtgatgactaattcttgctattggcgtaaaattttcgcaaaaaaatcctaaagtaatcgacaaagtttacggtctcatctttttgcttatgcttatatgcttatcagccaaaatttgaattttcaaccttaaatttgaaggtgattttggggttcttcattgaagtttattttttagcctttgcttttatatcattaagaacacatatataaaagtattattcagaaattatttttcgtttgaaaatacgacatttggggctgttaatgttgagcaaggattgaaaacatgtgggagaaaaaccttacgtgaaattaattagagaaaaatgcactggcggttcttaaacttatcatgaggtttcacttagatccacgaacttgcaaagcgcatatcgaggtctctaaatttggtttattgtatcatcctggtccaaagggtcgtttgaccgtggtcttgtctacgtggcacgccatgtggacgatgacatgggtttatttttcctttccccttttctttttcctcctattcttttatcttcttcctctactagagccacctcaagctccccgcgttgaagagcccgaagaagatggaaatgaaaggaagaagtgagaaaaaaaagaaataataataatattgtgccatgtcgtcgtctacatgtcatgccacgtaggcaagaccacggtcaaatgagactttggaccgggatgatataataaaccaagtttagggacctcgataacactttgcaagttcatggtactaaatgaaacatttttacatgtttaaggaccaccagtgcaatttactcaattaattaagggcccctttgaatcataggaatgaaaaaacggaggaataggaaaaacgtagtattctgacagtaatgtaagtgtaaaacagaggattacaaaatattggaaaaacgtaagaatgactgtttgattggaccacaggaaaaacacaggaatttgagaagagataaagactcaaaggatttttttttccatgagattctacctcttgttaaaattcctccaaaacttgtatgggaaaatgcattccataggaatttcataggattccatggggttcattcctttgattcaaagggctttgtaggaaaaattcttataggaatgaaatcctctaaaattcctatgaatttcctttgatttaaagggaacataatactccaacatatccgatactcccttcgttaaaaaaaaactcaatcctagatttgaaattagacaaacatgtgttcaggtttaaacttaggattggattttttttttttaacggagggagtaagtagtactctctccatctcatattataagggattttagatgaatctggataggctccttatctagatttgtagtactaagatgtatcaaatccatctaaaatctcttataatatgggatggaaggagtagtagtaaaagagacggaaggcagcaaaatccaaattaaggctgtttttagttcagtccaaagtttagaatttggttgaaattggagacgatgtgactggaaagttatatgtgtatgaaaggtttgatgtgaaggaaagttgaaagtttggaaaaataactttggaactaaacaaggcctaaccctagtgagtgagagaaggaaaaggcgagcgacagtaactgaacacagatacgtacgtaaacccaggtggcatggccagtcgggcagtccaaactactgtaggtgacgatattatcgaccaagatagaattgaagtaggagtagtaaaaacgataggatggggcgtgacagctagctgcagcctgcagccgctggcggtaggagcagtcctctgccggaaaaaggaaaaatgcgagcgcacaaaattaaacttgtgccctcctccctgcatcatgcagctgcaggcacgtacgtacagtacacttgccggccatgggcgccatcgtcgtcgtcgtcgttggcatatgcaagctaagctagctgtcgcttcgctcgcactgtacgctcactgttcgcgtgcatgcacaccacaccagccggcgacgagacaaatccgcggccggcccctgcagagtccgtacgccgacatccatgctctcccgtgggctccgccaccattgccattgctccagcgaccactggagctctctctccctctctctctctctttctctctcatcttaaggagggcaagtaagcacaaaaagaggggcaccgttatgtaccacggcgcaggtatcgagaggcggctgaccggccggcctttcagaaaagaaatgaaagtttgacaggcatgtctgaaatggtctttagacacgaatgaaaaaactaattttatagctcactgcaaaccacgaggtgaatttattaagcctaattaatccatcattagcacatatggttactatagcacttataactaatcatagactaattaggctcaaaagtttcgtctcacgatttttgtgcgaactgtgcaattattcattgtatctatatttaatgctctatttggatgtccaaagatttaatgttatatttttaggaaaaaaaaattagaaactaagccaagcccaaggttgaatgaagaagatgaggacgacaacgacgacacgggtggtggtggtgggcgcgcgccgtcgtatcgcacttactccaccggccggccacgacatggatggacagggggaggtcagttcacttcactgccgccgtcaactccatccatctgtaggagtacgcagctagccatagctcctactcctggctcctactcctggctcctactactaggagtagctgcaagtacgcggtcgctgtcgtcgtctacctgcagccagccactagagcaaagtactgtagagagagcggttgattgcacttggggtaatgcagtgcgcccatggcatctctgcacctgtgtgtctgtctctcgccatggctggctggcgctctctatctctgatctgtgcctaggtggtacagatgttttcatgctgcctgcccaccttgcctgccaatgtttacactacagcaatggcccgatgcaccatggcacattgattaattagttgagcattctggtacattgatcgtacttactattcaatattggccgtaaacctaattaaaccagtgcaaattattgttagcacatagtttcaggttgtaaaacgttttaactttggttaaaattaaattgcttcaagtttaactaaatttgtaaaaaaaaataataataacattttcaacccagaacaaatttattatgaaaatatatattgaattattgatttaatgaaactaatttgatattataaatattactataattgtctataaacttattaaaaataccataatacattattaatatatattcaattatttgactattaaaaataccataatacattattaatactccctccatcccaaaataaatacagttttgcattgtttatgcccaatgtttcatacttcgttttatttgaaaaaaaaattatgatatgtattttcattgataaaacatgaatagtactatatgtgtgactatattttaaattttttgaaataagacggatgatcaaacgttggacacggatatccacaactgcacttattttaggacagaggtagagtgatgtttacaaactataaagattagataaatattgcaaaaacacactcaaaatttgtataatctgtttgtagacattgcaagaatgtgtcatagctaaaaatagaccctaaaaattagtaatttgctgaaggccactctcagtttaattggatagagaaattatttaaaaagaccagaatgcttcaaagaccaaaagcttcttacatgaggctactgtgaagacagaataagatgtactccctccgtccaaaaaaaaagacaaaccatgggtttccgtgtctaactttgattgtccgtcttatatgaaaattttttgtaattcgtattttcattgttgctagatgataaaacatgataatattttatgtgtgacttgtctttttaatttttttcatattttttttaaataagacggacggtcaaacgttgaacacggaaactaggatttgtctttttttttggatggagggagtatttgggctaatggcagatttacagttgcatagtaactttttaaatttttcatcccaactccatgatcgaagcatgcggccccagagagtaatggttatgaccttgtgagtggcatgcagatccgtcggtgttgagcacgtacgagagtggcgacgacaaccacagtgaccttaggaccgacgacgacaacggcactagcctttggaggtgtggatccagcaacgggaaggtcggggtctgcgtcggcgacgacggattttgtagtgctcatcaacgacagagccacctctcaggcatctcgagatgttgttgcctatgctcctccaccatctatcgcctacagattttgttcgtgtatgaaaaaatagtctaccacgggaaaatgatactactttcgtcctaaaatactgtagtttagtccatctaatccataccaatacaaaagaaaaaaaatatataatgcacctattagcaaactccaataaaattatctcatactttaacaaatcattaaaaaaccactttcacaattgtattatcccatactataacaaattacaatagatctataacccactttcacaattgtattatcccatactttaacaaattgaaatggattataacccagtttcacaatcctcaatactcctatattgcttaaaagataaattctttatggataaatagataaaaatataaagtctccatgaatcttccaaagaagaatattaaaagcgaacacgcaaaacgagataaccattaacgcatgattaattaagttttaattattacaaacttgaaaaatggatttatatgatgttttaaagcaacttttatatagaaagttttcggataaaatacaccgtttagcagtttgaaaagtgcaaatgaaaattgaggaaaaatctgtattagggcccctttaatttggaggaaaaaaatagaaattttggaggatttcaatcctatagaaaaatttcctatgaagccctttgaaacaaaagattgaatcctatccatctttcgaaatttttatggaatggacaatcatgtagagatattggaggaaatttagcaagagttttaacctattggtaactttcttttgagtctatctctgtcatccaattcctacgtgtttttcctgttgttcaatcaaattatcattcgtgtatttttttctacgtattacaattctattttacacttacatttctatcaaaatcctacgttttttctattcctacgttttcttaatccttcctttagattgttcgggggtgaggacgacgtgctcctgtcacacattgctttcaagggttttagatcttgtttagttaccattttttttaagaaaaaatcacatcgaatctttggacatatgcatagagcattaaacattgataaattaaaaaactaattgcacagtatgcatggaaatcgcgagacgaatcttttgaacctaattagtccatgattagccataagtgctacagtatcctacatgtgctaatgacgtattaattaggtttaataaattcgtctcgtagtttccaggcaagttatgatattagttttttcatttatatctgacaacccctttcgacgtccagtcaaatatccgatatgacacctaaaaaattttgttttcgcaaactaataaacaaagccttactggttggccatcaagtaggttaacgacgcacgtacggtgtactaatgctctgcaggctgcgtgctgacgcccgtagtgctagacatggagtacagtatcccaaaaataccacttaaggggtgtttatatggaggaacgtaaacttttgacatcacatcgcgtattatacagggtgtcgcatggggtgttcgggcactaatataaaaactaattacacaatccgtcagtaaacagcgagataaatttattaagcctaattaatccatcattagtaaatgtttactataacaccacattgtcaaatcccggagtcacattccctcctagtttggtttaggtaagtagtactccatccgtctaaaaatataacaacttctctaccaacattctcttctcaagaaatcacaaccctccaccattcgcttttctcatctatatccatttctcaacccatcatcatctttttttatttaactttacctacttttctaataattatgtagtacaactctaaaattttttatattctgttacggagggagtacactttagaaatgtcaagtcgatcgacagctggtcagacacgagtaccgttcatacagtagtggcttgccagtcacatctgaatatagcgtactggcaggctgatggacgtatacagattcgctggttggatcctattttgaataactcggttgtacgtaaaaagtactacctccgttcttttatagttgtcgtttgggagttgtgccccctcacaagcacatatttctagcgactaataaaatgggacagagggagtatcttggaaatttacccttttagcacgcaccaggtaacaacatactccctccctccgtaaaaaaaataataaatataaatcatagtataacgaatctgaaccgaggtatatttatattcgtagtaatataatatgttatatttaaagtattaaatatagattaaaaaaactaattgtacagttaggaggaaaatcacgagacgaatcttttaagtctaattagtccataattagttataagtactatactaacctatatatactaatgatggattaattaggttcaaaagaattcgtctcgtggttttcaggtaaattataaaattagtttttcattcataaccgacgaccctttaaacatctcatcaaacatccacacttaaaattttttttcctgatttaaacaggccatactactagtactggttgtatcgatctgctagggcaggaccgcaggagtagactgtctgcctgcagcagctattcttcaaaagcgctacagtgtacacccccggaggcaatgtcagatcctgcagttcacgtgaaaacgacataattaaacggacacacattatttttaaaacggttttgctaaattttctgcgacacattttctggttgattacagtcgtttgttgagacattggatcggttataggattcgtgctagcatacttaattacgcgtaactagttgtgctttataggttacaggtcgctaattagcggtctactggagaactttactactattttttcttcactgcatgcactcgatcaagtatgagtatttgtaccgaccagcgaaacacatatgtaattaaagtataaatatgtaattagtatatattagtagtatatttagacagtagttacatcctacttacacaccacttacatatataattagtatgtaattttgtgacttacatatgtaattttagtacttacatatgtaattctgggacttatattgtaaatacactaaaattacatatttaatttagtgacttacaatctaaatacatgccgactaacttttggtgaaaaatatggcgtcataaaattattttgacataattaaacggatacacataatttttaaaattattttgacgtatacgggcacacatttaaaatattaaacgtagactaataacaaaataaattatagattctgaccgtaaactatgagacgaatctattaagcctaattaatccgtcattagcaaatgtttactgtagcaccacattatcaaatcatggcgtaattaggctcaaaagattcgtctcgtaatttatatgcaaattgtgcaattgatttttttcattcacatttaatgctccatgtatgtgtccaaatatttgatatgatgaaaaagttggaagttcgaaagtaactaaacaccccgctgttcgtggggcaaggttaaggccagttcgagctgttcgtgtttcggaaaattgaacggattagtagggtatgattaacacgtacacccttcgtcttataaaaaattaggtgattcctcgccctttgttatggaaatttctaagtaatttttaatatttttaatcaagctaaaagtaaaattatattagttattaacaattaataaaactggtttatcaagctatgttcagagaaaaatatattagtaaactttacatgagattgtagatgaaatatgatatcccgcactttaattatatggatgaatatatgctgaagattataaaaatgatggatacatataatatgttaaaaatattgtgaaaaataatatgaaggaagatgattggatgttgatttgtagaattcatgaattatagatgatgttgcatgcttacatagattatgtatgtaattattgctagcagatgatgaggtggcatgtttatatgttgaacattagagtcaatgggttataactttatagtaagtaagataggatatcaaatgctcgttcaaattcatctctaagagttactttttacagagaaagtattaactattgtagattataaaattaattacttttaaaggtttttatataaaaaatttattcacaaaacataccgtaaaaattatgattacagaagacgagtgaattgttgtttcgagttgctaaaaagaactcagtcaaagtgatcatttcgctcgcttatataacaagaatgggccgtgctgagctagggcttggtgttcggcccgatcctagcctagagtcctagaaaacagaatttcccctctttaattcagaaaactaagggactacatatatatttattaataatatttcttccaaaaattcgacatatgtaattatagtatatcatgatgtaattatattgtaatttgcacgtaactaaaatgtaactttcaaaattcctccgtaacatgctattttcgtgaaacggaggtcgtggaaccgaatcctcttacatatgagtgcgctgtgattttttcgttgctcaattgcacaaatcctgaaacaaatctaacaattcaaaattatatacatgtcttaatggggtgctcaggaacctagtttagaaaaaaaaaaagctatagtttatctattttcataatgtgcgtaccccgtcggttcaaaattcactgctacaaaacttcaaataggtgtcggcactataggtgccagaagtgttaaaaccggcacctataggcttttcccaaccttcgcggtccaaaaacacaaaaaaaactgacactgttaagtgattataggttttggttctataaaaaaactaacacctctctatacttgaagtgtcggtttttagtaaaaacgacacctttaattaattataggtgtcgggtttttaaaaaaccgacaactacaataaataaaaggtgtcggttttttaaaacaaccgacaccttttaaaaaccgagccgtgagccgagccgccgagcgcttagtcaagcggataatgtcaccgctctcatcattcttatccacttccgctctctttctttcttttttctctctttccgctctctgctctctcataccctcccctcgcctcttctcctcttcttctctcgcacccttggcggcccggcagtggaggcggcaccctctgctagatccggccgagagcggcggcctggcaggaggggaggcgggggcggcgcctcccctccgtcagatatggctgggaatggtggcccggtaggaggggaggcgggggcggtggcagcaggcggtggcgggaggggaggcgacggtgacggtggtgcctctcctccgctagatctggccgggagcggcaacccgacaggaggggagcgggggcggcggcagtggtgggagggaaggcaacggctggcgggaggggactcggcgactcatgtgttcttgtgtgttttgtgttcttgtgtgctcatcagttatttgtgtatgacttgtgtgttcatctcatgttcttaatgtgttcttcatgtacatgtttcatgtgaaattgctcgatgcattggctcaattcgggctgatgcatcgagccggctttttttttattcctgaggcctcaaaggtgctagttttaaaaccggcaccaatgactgaacatggtgctggttgggaaaactggcacctaaggccggttcccaaccggcaccgattagcttctctgtagtagtgacactactacaaaatatgtaaatggtgcccgttggaaaaccccctttggtgtcggttttcccaaccggcacccggttggcggcattgattaccgagggtcaagggtgcctgttccaaaaccggcacctttgaggcacccatgagccaaaaaaaacggctcgatgcatcgagccgatacattgagccatcaagccgatcccatctactacccaaatcccaaaatttcctcaaatcctcagaaattacattcattaagaacactcatcaacatcacatttatcaataacacatcaacatcacattcaaatacattcatcaagaacgcattcatcaaattcatcgagaatcggaaagagaggaggaggacgccactgacgtctcccccgtcgccgccgtcgtcggatggagaggaggagggcgccgttgccacggcaccgccgtcgccacctccactcccaccgccgagccgccgccgccgtatcccctttagccgatgggccgccgccgccgcctcacctcccaccagatctggtggaggggagtgcgccgccgccgggttgtcggagcaccgccgcctcccctcacaccgccgacccgcagccgccctatccccttccgccgctgggccaccgccgccacctcccgtcccgccagatttggcggaggggagggcgctgccgccgggccgtcggaccaccgccacctcccctcatgtcgtcgacccgcagccgccctatccccttccgccatagggccaccattgccacaaaatataataggtgccggtttttacttagaaccaacatctataattacttaaaggtgccggttttttacgatttcaacccgcagaggtgggaaaaggcctatagttaccggttttagcactactgacacctacagcaatggcaaatatttgatattttgtagtagtgtgattagacaccagtatcaaactaaatccgatctaaattagagaaagtcctccacctccattctgaatttctgacgtagctcagtcccgatcaccacttcacgaagcctatccctgatttatactccagtaacatccagcagtagataaagcacagtaaaattgatccaagccaacccaacccacacgcagagcagaggacgccgtggccacccgtaagagcaggtacaatagcagcaggttacatgtgagctaaggagatgcggaagagaccagagaggagagagaagtaaaacaggctacaaatttataatcagctataacacagtctccaaaatattatgtgtatgagaggtgggatcgtatattaatagtgtagtatatacttataaataactattgtatgaatgagtagtatcttaggctttgttctcaactctcccatctcgttttccatgtgcacgcttttcaaactgctaaacggtgttttttttaaaaagtttctatacgaaagttgtttaaaaaaattatattgatccatttttttaaaaaaatataatacttaattaattacgtgctaatggatcgttctgtttttcgtgcacggaacatgggtttccaatccagtctgccaaacacagcctacttgctcatcatcttgccaaaaattagtagtactagctgttagagtagtccgtgcacagcttaggccattactaatgcgtagctctgggtcgtcccctcaccggtgggcgttcgctttttcgtccgcgccggctccccacgatggagcgcgtcccccggttgagggacacatctcttgccacttttcggccgagcaacacagccgagagacgcattggggggcgacagctcctgtgggcacaggttccccgtacgtattcctattccaccccttggccggaggatggggataaggagggagacgtgttcctgttgccggaggaggaggtggagaccaggagcgcgtgcgcgggggtgggggggggtcggaggaaggggaggagaaggcttcatcggtggcggcgaggtcggcggtggcgaggtcaagcatgcggcggaacttgaggaagatgaggtaggcggcccttgccatgagaaccaagtgcgatggccgccaccgccacgccattgtgccccctcctcctccttccgtggcgtagcaggggggtggggtgggggtgggacagagggcacgcctcgcgtctccggtgagcctgacccgaaaaagccgtcttcccgtcgtcgctggcgctgggtagccccgtgacgccgctccccgggtccgacgaggccgaggaccgtgccattgctgagcaaggggatggggggagggcacgcctcgcgtctccagcgagcggcggcgcgctggatctggcacagtgcggcgtgggaataatgggagaaggagtagagacgggcgacgggcggaggagagtggcgagcggctgcggcgagagggagaggcgagtggtggaggggagtaggcgagcacacgcggagggcaggaggcgcgccggtaaataagagaagagagagggagaggagaggggtagtataataaaatacctacgtgggctttttaggctagggacactcgttgggccactaggggtatcctccattgtaaggagagtttcgtagagagtgctctcgttgcagtatccctatttgtacatgcccttgaggttgtgtttagatccaaactttggatacaaacttctaacttttttcatcacattaacctgttatacatacacaacttttcagttacatcgtatcaatttcaacccaaactttttaactttgaaagtaactaaacacagcatgagtgtcaatgcatgtagtacactgtactagcagctttatgtctgacaagaccgccacctgagtggaccccacgacgcgtgacatgatgacggccgcgagacggtcggacgctgagcgattgagacatggagacgtcgtttcaggatgcgttgtttgcattgcatgtgcacggggacaaacgtaatgacgtcgcccctcgagtactctacgtgttcccctccctcgtcacgtctcctctccagatactactactacttgtactagtcctaccgtgtgcttgtgcatgcatggcccatgcacgtcatatcgccggtcagtcatcttcacgtccacatgcatcaccactggtcactggagtactattccattccacgtcggaatatgtttatttttactcatcctgattaattgtcttaaaaataaatttaggctgtatttagatctacgggtgtaaagtttgggcgtgtcacatagaatatacggacacacatttaaagtattaaacgtagtctaataacaaaacaaattgcaggatccgcctgtaaaccaagagacgaatttgttaaggctaattaatctatcattagcaaaagtttactgtaacaccatattatcaaatcatggcgcaattagagttaaaagattcatctcgcaatttacatgcaaactgtttaagtagttattttttcgtcaacatttaatactccatgcatgtgttcaaacgttcgatgtgacgggggcaaaaaaaaaatttacctgtagatctaaacacccccttagttttaagtgaccattgtatcaaagtttataaaagtagtagatagtaattatattagaaatagataaagagagaaatacgtgtcctgggatttaagaaaccggtggtattttgtttttttacatatattcatatgtatgaaattgatgaaagaaaaattagtactccctccatttcacaatgtaaatcattctagcatttcccatatttatattgatattaatgaatctagacattcattaacatctatataaacgtaggcaatgctagaatgacttacacgaaacggagggagtagtaacttgtttttatagaacggtgaaatgatcgaatatgcatctccgacgacggccctgcatcgatcactgcatgcgtgtgctgggtattcactcttctgtgccgacccgactcagaccaatctcttgttcaacattcatgcattcacgtactaacgtactgcatgccttgttcctaaaatataaagattattaggattcagattttataccatgatatccgttttttttgtgtgttgattctcataaatcgcatcattttagtgatttcacaaccaatcggatacttagaacatctaagcaatttaaaattttgaaaaataacaatcaaagtgacaaaagctattttttttacttaacatcagtatttactaaacaattaatttagaaatcattttattataaagtactcatgtactactagctagcagtagttgtcactgcgccatgtcgactgagacccaggccatctcttgttcaactatgtacttccttcgtctcattttaaacgtagttgtggatttctgtatccaatatttgatcgttcatcttatttaaaaaaatcataaaaaactaataaaataagtcacgcataaactattatttatattttatcatctaataacaataaatatactagccataaaatattaagacatacgatttaacgttagacatgaaaaccaacaactactcttaaaatgagaacgagacggatgaagtacgttattattactcgtacacacatatagtacacaaagctagctaaagcttgcatacgagtatatgcttgttctgggctcttggtcgtgtcgtctacttgctgtctgtatggattgagacgatgctaggcagagagcacattaacgcttacgtgtccatgtacttgtgctgctcgagttgtacgaactacagtagtgtactacgactcgagtcgtcgcagcgaaaaggttgcattgggccggtccatggaccggttaaagcaaggtaacattgcgttagtacattagtactctgtacaatattggactatgtgctagtacaagtactatactctgatgatgtactaactggccagcctactatcggccatagaactattaattgtattttgtcaaaaaagaaggggaaaaaaacttgtggagtttgattctaacggtcttaaattgttaggagtatgcatgttggtccggcatagattttccagtcactcgggttttacgagtacaattgaacggccccaccttgtcattcaactgcatgctttgatgaccgtgctagtctgcaactatggattcgaagagagaatatttttttaggttgcccggtagacccacacgcatacacggaggaggctcgtccacacgcatacaactatggattagaggagcatgtgtcgctgacatatggtctcgtaacggtgcactacttaaaaaaaaggccatagggtcaatatcaatattagtaaccgacatctatgaggaaaattaaactggcacctttagctttgctcgagcaaagaaaaaaaaagaccagctcgaatcgagccgaactcactaagcaccatcgctgcaccatgcgcccatgcgagttgctcccaaatcaaattgaaatccccaaatcatccacaaatcatcaccaaaatcaattgacatcacagataatcacccacaaatcgtcaccaaaattgtcgcttgggctcttaccatccaacatcacaaatctctcaaattgttccttgaggatctacaccttggactcacgaacactatccgtgccttcatgcaagttccgaagcgtgtcccaaatcactttgtcactctcaatgccatccacacggttgaactcacttccactcaaggcgctaagtattgcattagcggcttgagcgttcttgtgctcgttctcgtcgtcctccttggtgggatcttcgggattttgcaaaacatagcatttttcgactattctccaaataaataggttaatagacttcaaatgtatcttcattttatgcttccaagcggcatagtccgtaccattgaagtacagagctttgtcgctataggtactcacataagatgtagatgtagggggatagtcataagggatcttagctcccttatcaccatcgttcccatcccccgcttggcccgacatgatctctccaagcggttaaacctaattaggagattaggctctgataccaattgaaagtgttaattaggcctagaggggggatgaataggctaattcaaaaattcaattaaaagcgaaagcagtaattttcggatatttccgaaattttcggatatccgaaaattttcggagtcagcacaaatagcaaagtaaatcctagatctagttgcctacaacaagaatatgctagcacaaatagcaactagaactatagcggctcaaacaagcaaagctagtggagagggaggaagtaaaatcaccaaagatgaagctcacgaagttgttcccgaagtttgaatccttgaggggattctactctccgttgaggagctcactaagagccgggtcttagctaaccctttcctcaagaggttgcactaagcactcctccttccactaagggtatctcttctctttcggaggtgagatccgaccttcacaaacttctcccggtcaaccataagtagatcggtggctcgggagcgacacctagccgcctaggagtcttcaacctccaagagtaacaaatgaagcaaagaactcctggagatgatgcaagtgctcacaaatcttcacgaagtcaacaacaagcactcacacaaactcgaatccacaactctcacacacacaccaaatccgaatcgaacacgggtgagaggggaaataagaaagcaaagctcaaaagtgctagagagagagagcaagccaagggcacaaataattggaatggaaccagcagcactcacaagtgaggggggctatttatagccagaacccaaattctgcccgttatgcacaataattgagattttcggatattccgaaagattttcggacatgtctgaaaattccagctcagcaccaacaacaaagtcaatgagagatttttcggacattccgaaaacttttcggacaagtccaaaaatttccagaaccaaaaacaccgttctggatgttctcggaaaagtccgaaaatagctttcgaacaagtccggaaaaacacaaaagcatttttgaatttgctgaagttttctggaaactccgaaaatctattttggaaaagtccaaaaataaacagaaccatatttgcctccacagtcattttcggaaagtccgaaaatgtttttcggacatatccgaaaatttccaggagcgaaatttggttatgtgcattttcggaaagtccaaaaatgactttcggaaaactccgaaaatgtctagaacaactcaaattgaggagaaacacttttaaaaattgattttgagcactttgatcactcctcatatgtcaatgcatcatccctcttaatagtgcggcattcctatttactcaaatgaaaagaaaagttacaatataccatttgctcctttgccacatcacatcacatcaacgtatttggcgggatatgcattacgctaactcattgaggatataacaaccttcacatttgcttaaataaaaattttagtcctctttaatcgcattgtaattaatcaccaaaatcattaggggcctagatgcactttcactttaactacagcttctcagaatctgcataaaaacctgaacgatttaggagagtttttattctgaaagaaaactgtaggtgccaaaagctccctaactaggcccttagctaacacagaagggttcatggttctgcttgtcaaatagttgtaaaactactcttcttatgaacacaaaagctggctttggagaatgtatataggtagacgacgtaagcttaagaatttgtatttttattaaccaatgaaaaaggttataaatcacttaagttgatatgtggtttatgataatttaaatactatatagattgataataaaaagctaaaagtaaggtgatgactttatgagagaaaaaatgagagaaataatttggacaacagattaatcatttaaaggctagaaacaattgatatgatgtggtctaatgagagaagatagaaaacattaactaagtagggataaagtatataggatattgtagaaaataaatagatatatgctgaaatattatgtaaattatgtgggatgatgatttaacatgtttgtatttgaaaactttagaatatgataaaatatagagtaaatttcacaaaactacatgtactttaacaaaattatcgtaaaaactacaaatgtaagacgttgtatcaaaaaactacaaatttaacacaaaatttatctcaaaactacaaatttaagaccaagtatcgcaaaactatagatttaatactggagttgtcacaaaattacatattttacagtttaaatatctaccactactattatgttagagttataaatgttgtagttttgtacttataacatggtgcaaaacatgtagtttgtgataattttattactaaatctgtagtttggtgatcttcgaagtttaatatatagttctttgataaatttggtcataaatttgtagttttgtaatagaccttcttcaatttatagttttgtgatagattctttaaagtatatatgtagttttgtgaaatttactctaaaataaatgctaatagatgatgatgtgctatctttgctggttgagtttgtaggttacgtttagaatgtagtgggttgtaactttatagataatagagatgtgctaattccttttttcccattgaaatcaatatatatatatatatatatatatatatatatatatatagtaccaataagttcaggagtaagataacatttaaatcggctaattatcatattaccaaaaaaaatcattttcattaatattttctactctcgtgtgtgggttgtttgagtatgaagtcaaatgaatacaaaaccttgatggaatcaatataaccattacgtaaaagtataattaggatcattgcgataaataaacacaataaacttattggaagtggtactagttttcttatgcataaagatgaggggatatctttattttttaagtgcgatcataattttgatatgggcactataacaagaacgttgattaggttctccaatgtaaatatctatccaattaagaaaatgttttaccacctcatagcttgtgatctttaactattttcagttaattgtgtgcctgaacaccaatgcgttcagttctctatagataaagtagataaagatgacattgtgtttataattgggcacatcgctccacacaatcctattgagactgtgaggatttggataaggagcataatgatgaactaaaagcactactaacaggagattttgtgtaactatatatatgtacattagagaactattttatttatagtttaagaaaatgatcatttttattcttatgtatagtgtgattcatatccatccgttaaagatgagcacgatcgagtatacatgtgagggcactatagttgtattggatggtctttgtggaggaaggtaaagttattggagtacacttagccgctgataagtcatggggagataatatttctactgaatctgtgatacatacggaatggttagaattggagatggtatttagtaaatatgtgatacatgatggaattactaggagtgggaatcataagttcaaatatttactctctttaattttgaatatgaatatgaaaagatcaattgttgatgcatgtgttttattaattatatttttttttgttttagttagctcttcatcaggttcatccaaggacacttagactaaatgtagactaaagtgtaaagatgatcttctaatttggtacagggtcgtttagaaaacttaactttaatcctatcgctatactttaggcattggtttgctcgctgctatcagaacgcgctctactatgtacccagacaacagggaggactacggtgatatcaagggttgtcaccacctctacaccaatctaagtactgtgggatacgcagcaaacactagtaattaaccatctagacaccatttctatgcaattaattactactctagcgttagctaaacacaaagtaaccactatctcttaatgaataatagtgaacagtgatccaccaagctaaataggtactaactaagaagtataccatacaagataaatctcagttacttaattaagatattctcaactcgagcaaaataattgctaaggtataaaagaaataaagagagttatcaacaattccgaaactcctccaactctttcgtcctcactgtctcttctttattctaagtatacataaataaatacaaagagcctcttataattcatctgtacatcttggtggtgttgtgaatgaagaggataggggtatttataggccttagaagtgtggagattctaagcatcaaaagagcatcttcactcttgagctgacaagtgtcctccatggcagtggcaaatctaggatttagtatatgggtagtccgacctaattttttttttctaaatacagtaaatctaacgatgctaatatatacaatgcaagtatagataatagaatagaccaaatcaccaaaagtttaatatgatatattaataaagcatcttaaagcatatataattagtaattaagtaaaatttcgatttaaagaagcttctatggctataaaagtctaaagaagattacatactatgttttcttcttatcgggtctactttttctcctcaacaacttgttcttgagtgtgctcctcaatcataaccgaggaagaaggcaatttagaagcattcttctttgcagcgtgttttcaaaaaaagagatgcaatatctccatctttcttcatgcttcaacaatccacaatttagtactacaatttaatatcacaatgcacaagagttcaaaattataaatttgaaaattgaaaacagtacacaagtagaaaacctaaaattgttggcgcgggcggctaggcgacggtggcggcgcactgtaacaaggaggttaggaggcaggtcttcgtgagtccgtgactccgttttctagttttccccatcttcacgatggctcctcgcagtggcataacacactgcagcagtgcagcactacggcggcaaaggcggcgggttggggaggcgtcgggctatcacgcgttggcatcatggcgtcagcgcgtgggccggcggttgcgcggtgctctgatcagatcgtgtgattcgcattggcgctcgcgagggcgtggaggaaagaggcgcattgggcccgacgcaagtcacgcgacgtttaagtttctttccatcccatcgatccaagcgcgtgcgcgctccggcaccgggcgggatcgctattttctctctttctatttttaatattagggtcgatcgccgatttttgggtggtccagggaccacccggaccaccctatggatctgccattgcaccatggtggtttattccgatagaaatgttcacaaccgccttggatagtcgataactactgacctataaatattgagggccaggtgggctgtctctgggttggccgacccaaccgctagctggcccttctggccctaggctttctcctaggccctggtaggtaagtccttggcccagtcacatggtggttgggcccattttctagtatttcgttggatttgtgggcccaagacttcatgggcttggatattaatgtaattcttcccctctgtcagggttacggataagcgaaactgctaatacgcgctcagtcgcgcgccccctcccgcgtgcgactggacacgtgtcgcgcgtggagaggagggcggcggacggcgcgttttttttggcgtacgtttccttttttttttctgtttttccttccgtatattttcagtttacggtttcttttttttttctgttttttctttccgtatctttttcaatttttctaatacatatgtatgcaaactttatatatgtacatatacaaactttatatacacgtatacaaactttgtatacgtgtattttttgggttgttatatgtacatatacaaactttgtatacacttatacaaactttgtatacacgcgtatataaagtttgtatacacgtatacaaagttgttatatgcgtgtatacaaagtttgtatacgcgtgtatacaaaatttgtatacgtgctaatacaaactttttttatgtatgtatatatatacacacacatacacatagtatagtactagtagtagtataaaatactagtatagcagtataaagaggaaggatagtatactagtagtagtacaacgagacataaggggctggactgaccgcgcgcggctgtaggcgcgcggtcagtcgctaatcagccgtccccacggataaggcataccctctatcctaggagttatgagatatacgaatacggtatatatcgtgatatatggaaaggacaagtgtaaagtaaggaaatcagcaaatcggtatggtaaatatcctttatgagtagggctatatatgtgtcctactcagataagagaaacatggtattgtatcgtgcagggtccgatgtctccgagttctacttggagataaagctgacctgcggtataaatacacaccccctgaggggttcagggcatcgaatcctaagggcaagacacccaccaccacataagcaatccggaggacttgaagcctattcgccgaaagatctcatcaagcccctcttgacaaggatctcgtcggtaatctcggagatccgttgtcttctctgcactctgtggttttctctataatcccacataaaccggattagagctattaccttacgaggggcttgaaccagtataatccttgtctccttgtttgcttgatgtcaaatcgtgtaaatcctcgtaccaacgtaccctagtaccctcatcatctagtttacgagtatcccccgtcgacaccctcctttatgtatatttcatctcaactttggttgtttgtcacctgtatccaaatatataccaacactcgtggaaattgttaaaattaaaacctaccactatattggatgttttatattttcaaaattatgcatgtattgacggtgtaaatttggtatttaactgccatcaacagtatcatcataattatattggtgtctttatgattcattgtagacaaattcgacaatagttacaatatagcagcaaaatatgtatcttgtcagatgaagctggtagagccatgtcttaccatggctaataaagcatgtcttcttcaaaccatgcaaattagttaatccatatgacacatattcccatgatctcgcctgcatgtacacacaagactctggcccaaccacatctagcttccatcctcactttttctagtcaccaagttgaaataaatccagataaagaatgaaatagagttcgcatctaaattttcggtttctattgaactagtctgatggtagtattaacatacgcataccacatggtatattacttttcagcttgagttacatatgacttttagaattgtccaaaaaaaccatatgaagaacttacttgaagcaattgaaatataaaattagcaacacaactatattggtcacttacaggctttcaagctaggtacagttttttcacttgatacatttatatgtattatatatacttattggccatttagttttattaaaaatgatcactcatggtcgcatctatttctagagtttgttagcttttgggcatattttagtttttttttctgttttagaagcaaggaatgaatttgttaaagtttatatgatgtgttttatattctgaccaactaaattgtgcacaagccaatttatttaatacgatcgcaaaaatcacagagttggaaaataccattgtgtgttatggttgacacacgggtctcacatatataggattgtattttgcaactaacttatctgtgtggtggtattgtccaaattatcccattgtgcacggcatatgctcttcatttttcatagataaggaaactatttttaggaatattgtttgcacgtgataggggttgacgtgtgcatggttcttccttggaggaggtgaccatggaggtgatgaagaagttaccatatttatcactcttcaatccatgcaacactatttaatttagaatgattaacatgatgatatttgttatattttgttgttcttgttttctgtgtcgggctttttagtttgtttttgtgctatagggatgaaacataaaaccttttaatggttgtaatgttttatgctactagactatatggctatattatgcttactgcttctttctggttgcttaaatgagtaatgggagaaattgaaatgtgctttgctagaatgtgagaggcatgaattgtgatgatggatggtaggcaattaggaataaaattgacgagagtagttgtcccttcttttgcctcccggaaataaaaattcaaccatctcacaaaaaagttgtgataatcttgttgaggaaattatctacttagatatttcggcaagatcaaatatcgctactacataattaatttttgcatacggccaaatcgattttcacaggtggctaggcagcccgcatgcacccaggtgtctgcgaaagtcatatttttccatgcggccagcacaaccgcatgcgaatctcattttcgcatccagtcacatataccgactgcgtggaaaaataatttcggtgaaatatataaaaattcaagaaaaaaattagccaaaaccctagcccactgctggccaaaaccctagctccccaaggcgggtcgtcgttgccgtagcagctgtcaacaaggaccgagggtcggggatggcagatccgcacatcccgatagcgatgccaccggatccaccaccctcgagctccgccatcgccacctgccatcatcgtcatcatccttgtcctcgttactcaaaccagccggtggatcctcgcgctgcgcgagatggagaggcggcgagatccacatgggaggggaatggggcgctggatctggccctcccgtcaccgccggcggctgatccttgcgtgtaggggccagagaggtagagggatccatgcgggagggggagggacgccagatctgccccttccgtagccgccgctggcggatctgcgtgcatggggggtggagcggcggacggatccgcacgggagggggaggggatttagggttttctctgattttgggttttcttgaacttagctttctaaattaggaacaattagtaatatgtgtgtgctaacgctatggcaacactgctagccaccaaaaccagaaattgataagcagtaatacaagtgacgtagcaggtagaaatccaccaaattggcagtaaaaaaccatatcgatattgtgttaaaatgcatataaagattatcacaaatttcgtcattgacatcgtactacatttcatcaaagttaccgaagaaaaggaatggaatgtctcgcaggtataaagacaaggtaacaaagataataaatggatgagtttgtatcattgaaaataagcccttctttcgcccaagtcattgaagatggtaattgatggctttgctgcattctttcgcctccctttccgagatcaagtcctaagcaaccatcataaaaatttggaaatttcaaaggcacatggattaaaatgtgggtaaacaattcgaaaggattaaaaaaatgaaatagtgattaagacctgagtcctactaaaaagcacccaagagatccttctgccagacacattatagaatatttctttcaacattaaacacataaaagaatgacaattacaaaaacgaaacgtagtagcagaccacttgggtgatcccactcgataaaatagctcagtcgattattttgattttttttatttttttagtaattgtccctaatattctcaattgaagcccatagtaaatagcagtaatcctatattgtttcatcacattgcgatggcgtttgaaactcatatagttatgaagataaaattaagtgttttacataaaacaagatggtattaacatattattaattaagatttaattattacaaacttaaaaaatatatttatctgatattttagagcgactatcatataggaagtttccgctcgaaacgtttaaaaaacgtgcacgaatatccaaatttttcatccagcttttgttcgatgcgtattgggcctcaactacattgcataaaccattattggcccattattcgatctgtattgggcctggatagaacttctgggcctatttggcccactatttgtcggtccgaactttctcccgtcgagggggcggtggtcagcgccaccccgcttggtggtcaaaccaccccacaagctttggcgaaattcggaacacggtggaggagttcgccgtccccgagatgccgccgccgccgccgccgtcggtgcgcacgaggagcgtcacctccgtcgcgctcccgacgcacggagatggcggcggctgtcgccgcgtgccgctctccccgttcgacgcgtactgggtcgcgctgccgcccgtccgccgcgtcttcctcttcccgtccccgccgccgttcggagacgtcgtacgcgcgctcagggactccctcgaggcggtgctcccggcgttctaccccttcgccggcgcgctggtctactcgccggaggaggaatcgctgtccattgtcgtggaggccggtggcggcgtggcgttcgtggaggccgagacggacctcgacctcgggaggctcgtcgacgaaggggaggagcacgacgaggacgcgctgcggcagctcgtcccggacatccgccgcgacgagctccccgcgcccgtcatggcggcgcaggtgacggagttcgtcggcggtggcgggggcgtggcggtcggggtggccatgcaccacgcggcggcggacggccgcggcctctggcgattcttggagatgtggtccgccgccgccgcagcggccgtggccaccagtgtcagggaggccctcccaccgccgctccacgaccggacgctggtgcggttcgacggcgacggcgagctggcccggctgttcttgcggcagatcgcgccggacttgcccaaggtgagctcgctctgttctgttcccaccatgctctagcttaattagccatcatgaccaaagaaatcgaaatgaaattgatataccatgacaaattcaaataataattacagtagtattagcaattcagcatgcgcaatgaggagtcaagtagttaacattctctcgtagaaaaatttggacaccttcggtatttgacatggttccatttgtaatcaatgaattctgttaaaaattctgacaaaaagttcagaacaaaaatatgggaaactgtagttctgattactctggagttcatgttcttccattcaaaactatcctgaaattcttcgtgtgttactcttgattcatcgtcagccataagccgagatgttggttgccccttcttttgctactatgattttgcaagatttgaaaattcggaggtgagatgttaatttgaatcagtgccaatagagcgtatgacatctgtattggcttcagatcgaattcttcgtaatgctatgaaaattgaaaaggacgggcttgattatctttgatcatggagatggagatgcctcagttacatcttttgtaaaaaagaaaagaaaatgtatcgtgacttttgacctctgcaacgactaagatatattacaaaagtgcctaaaaaattacacataaatctggtgatttctgcatttgaggatctagtgattatgaatttggaatagtcaatcttaaaaacgaaaatggagcatttcgtcatgaaaattagcattttttaagttcaatgagtaaactgtgaagtttcttactccccccgtttcacaatgtaagtcattctagcatttcccacattcatattgatattaatgaatctagacatatatatctatttagattcattaatattaatatgaatataggaaatactagaatgacttacattgtgaaacagagagaaagtaattacaaacttacaatgtcaatttgataagcatatttgagagtgtcactgacaatctcctgcagatcgttcacgcgcccctgcgccaatgccctctcagccggcgaacgttcacgttcgccgcgccggcggtgaagctcctgaagcagcgcgccaccgtcggcggcggcaagacgccgtccacgttcgcggccatggcggcgcacgggtgggtctccatcgcgcgcgccagcggcctcgccgacgacggcggcggccccgtgttcgccgtcttcctcgcggacgcccgcgcgctcatgtcgccgccggcgcccggcgcctacgccggcaactgcgtcgcggtgtgcgcggcgtcgctggaaggggcggagctcgccgccggggcggacgcgcacgcgcacgcgcgggcggccgcggccgtcgggggcgccgtcgacgccgcgaggcgcgacccgctcggcgaccgcgcgcggtggcacgacaagttcgcgcgcatcccgcccgggcgcgcgatgatcatggccgggtcgccgtggttcccggcgtacgcggtggagttcggcttgggcaggccggcggcgagggcggagctggcgtccatgaaccacgacggggaggtggtgctcgtcgccgggagggaggctgggtcggtccaggcgtcggtggcgatcgccgccgacaagatgccggcgttccgtgagatgtttgtggttgggtgcggatggggcgagcctgactcgaactagttctttttatgtctaattatagattttagtataatgaaataaaatgtaattttcgtaaaaccctatctattatggaccaggtcacccaaaaccatcgggattttggcaagagatatataaccctagtttttatggttcttacgttttataaaaccatgtccttaaccaatttaacatacgagaaaaagaacaatatgccacttttagtgggtttcaacatgccacccattagaatggtaaggataaaatactacttaataggttgctttgagatattttaccacattaaggagttttaagaccataatgcccctattgttgatagagaggaagggagagagaggggagcggcagctggtgctcaccggcggcggtcgcgagcaggggagcgcggttgcgggctgcgagcacgcggggagggcggctagcggcgacggggaaggaggacggtggcgctacgctgggaggaagatgggcgac

SEQ ID NO: 60713 - DNA, 1138 bp, Oryza sativa
aggccaaagtaataataccatggtttttccttacatttggtccaaaatagttaaatgtcaccaccagtcagtccaataatcacaggtccagcaaacagccgcagcaaccttaatcctagctgctaccttgtgagctttaacatactgggatcttgttgcaacttgcaagcttgcagcagccactcaggaccagggtttgacttaccatctgtaaccgcgcggttaccgcggttaccggccttaccgcggggtatggtaatagaaaaccacggtaacctccttaaatttaaataaattttaaaaataatttgaatttttaatatattttgcatggtttcgtacggtttttcacagttaccgcggtaactgtgcttaccgccagggcacggtaaccccggccgcggcggtttgtgaaaccctgctcaggacactagttccttgggatcatgccgttttcggagcactgatatccaaggcagcacatcaaggaaccaatcaagcaatatacatcaaaacatagttgtagctggctacattgggccaattggttggtatgataaaaatcactcttccgacggacaagaactagcaactaccagacaagaattagcagcaaactaccagtgcgcaacaatcatgtccgtcaagtcaacaatccactctgagttccgatggtcaagtcaacaatccactctgagtttcaatgagggccaagctctgagggcccaaaatcaggagacgttggctcaaccggaagaaagtcttgctacatcccaaaagggagaaagccttgctacaccccaaaagctacatcaagaggtgagtgactccccccacttttaagttagttcaactctctctaaataaacaatgtgtgactattcccaacaagctctacctcctgccgtactacttctatcttctgccactcctcccatctctcggcaaggccatcaccttcaagcatcctcaccacctccgccatcttagggcgttttacaggggagccttgtgtgcaaataagcgcaaccttgattagtgattctacctcaacatgaatgtaattgctctgtagatctggatcaaccaacattttcagccttttctccttgagtaatcgtttgacctgcacaaagca

SEQ ID NO: 60714 - DNA, 11943 bp, Oryza sativa
ttgtttaaactggtgctaaaatttgatcagtctatgctaggttttaggcttgtgaaaagaattgtaaaattagctttatgcaaaagaacctgaagccattccttgaaataccctctatcatatgcattgttgttgtggtggcttgctgagtacggttggtactcacccttgataattatatatcttttaggagagtgttgaagagaagcccttgtcggtacgcttgcgtatccaacaagatgatcggagtgcggtcttgttctaggtctcgttccccagtcgactgcttgtggcatgttaaccgggcccttatattatttggtcttctggtgttgttctctgatagttattggcctacctggccctaatgtaagtatttaactcttttagcctgaattcattcgtgatatgttgtgattcaactatgtatgtgtgtatcaactactgatccagggattggtacggataaacacagatgatttccgatttccaaaatcgggggtccacagcagcgggtgagatccgaggttttcgagacaaaagagacacaaggaatttatacaggttcgggccgctatgaagcgtaataccctactcctgtgtgtatgatgattcttctgtgcttgcaaaagcctctgaatctccgatgtacaagctagggttagagaagctttggctcggggatccagagttcgatcccccttcccgctaggtatggtcctccttttatactctaaggggataccacatgtgctgcgagtgctacctaggaagaagggaaaatattctctatattaatgacatgtcttgtgccttagcttggaagccgcatacacgtcgtctcggtcgtggggcctaccacatcatgccgcctaacacggggggcgcccatgtcattcactatttaatgggtgaagacttccgggttctcgttcgcaccaggaaacgggaacccgggtcagttctgaccaagataagaggctgtgaagcccctcattattatgatgggatgggacggagcacgccgcacgccgcctgacaaactgacagggcgagggtacacagccgccgtcccatcggtcattcgaccggtcacggacctgtcacagatcggttgagtgcactgcacgccacattaaatacggcgtggtgcaaccgctcaggtcgccataaaagcgggtaggtgagcgcctggaggcggccagctaacccatcgcacgtggcgacctagagaggtggtcgagggagcccgacccctaatcacaggagagggtggccgccgccctacctcgggctcgatcccccctcgggggaggttcacgtggcgcctggggcagcctgctccctctagtctcggccagggagtggccgccgccctacctagggctcgacccctctcgggggagggccacgtggcattggggggcagcctcctccaactagtctttgggaaggagtggccaccaccccacctcgggcatcactcctctcgggggagggccatgtggcattggggggcagcttcctccgactagtctttgggaaggagtagccgccaccccacctcgggcctcactctcctcaggggagggccacgtggcattggggcgcagcctcctcgctctaaacataatatccccgggcccatatcaccgacaacacgagttctgttttatagttttcttgagggaaaccacacctattttatgttattttgttccacttttctctatttctcgatataattaatgaatcatgtatatttcatttttgtgttaactatgcactaataattatattactactactcgatataatgaaacatgacgtttcacttaccaaacgcatgagcagttaaagtaagtttgtttgagacttgacacttatatttcttttcatcttcatcatcaggtttgaggttaacttttaatttcgttaaaagttttcggtttttgaagttcctaccattcatgcctttttttgcaaggcttagttttggtttagtttacattctcaaatatcataaaagcaaaactcgcactagtatttagttgagaacgtacgtccatactccatattcaatttcccatgtatcatgtcgtaccaaggtggctgaatgatttactagcttgtggctaatcaatgcatttaggttgtgttctatattatatttcccaacttttacccatttgttttccgcgcgcacgctttctagatggctaaatggtgattttctttagaaaaatagttctataataattcatattaatctatttttcaagtttttcttacctaatactcccgcagttccatattataatatgccttttgttttctaaatcacaattatttaagttttatcaagtttatagaaaaacatataacaatatttttggcaccatgcaaatatactattaaaatatgtccagtattagatttaatggatctaattttgtatcataagaattgctatattttttataaacttgatgaagaagtttgacttagaaaaatatgaatgtcttgtaatataaaacggaggaaatgagtagctccattttaactgtggggatattatgcattaacttgtcttgcaagcatgtcttagttttacagctagaagaaacaaaggttacacaggtgtggcccgaactgctagtgatggcccgacagtgatggcttgttttgtggtagtgcatcatccctaggttccaaaaacatatttgtcaaaaaatagttactcgttcatccgcagttttggagtcagactgaaatccgtagccgatcgtgtgagcagcctgaaaataatttatgcttggaatgtcccaggtttgccaaatggatgtcgtcttcatgaaaaaggcaaaagcttgtatgccatatagcacaagggtgagtatcctatcttactataaagttatcccccactaactccttaagattaacatgcaaagatgccatatcatcatccactaacaagatgccacattatcatccactaatccactaattaacaagatgccacatcattatccactaataatcatcatatttaaacatcatgcaaacatgctatgtctttatagtttttataatttaagagcttttcaaatacaaacatgttaaattatcatccaacataattcacataatgtttcaatatacatctttattatgttttatgatatcctatatacttatatagttcatcctcacttagttagtgcttaaatgattaatctatggtccatattatctttctccttttttcctctaattaagtcatatcccatcaattgttttcagcctttagataattaatctacggtccacacacccaaactatctccctatttttattcttctataaagtcatactaccttactttttatgtttgaatcaccattctacatactatttaaatttaaattatcataaaccatattaatttacttaatctggtgttatctagctatcatagctatcttacacgttatttttttttattgttatcatattaaattctcgcagcaatgcgcggggtttcatctagttatctaaaaataaaagcacacgggtgggtgttgccacactaatggacatgatcactacatgtcaatgccacttctagttacgaactgttactaatgaaaatttttgtcatgaaatttttcaatttcggttggggggggggggggatgcgggggcttactagtttcagttccttgctcgaagccgtactaatgagttatccatggttatagcatgaaccaaccataatgactctgattgtacaaattgccagtttcggatatgaaaacatatagctttttttttacacgagagtatgaaaatttagctgtcgatgtgatttatggttggcagccttttatttgatgtcatttaaatgcctgaatcagtggttcaaatctcgaatagggagggttaaaagtaaacaatgtacatatcatgatagaattggtggtaatcacacatcagggagacttttcgggttcaaatcttattgcaacaaggtatgtgtttcacttgaatgaaaaaataggtaccaaaacttagagcctatctagctcatatagatggagcagtaatcgtggttttgcttgcataagcagtggtttagacaattggaggctcgaagctgactcctgaagctctatcttgtctgcaccagggggtatgctccaagtgaacccttgtagaagccttgcgaatagcatcattgtaattgaagtgccaagtgacacggcagagggcagccacgcctaccagcaccgaatgatacaaaccgcaactctggctcagctagcaccatagtactagtagcattgttcagatgtcgctctggtcgaaattcaagtgggttaacccatactctagggttccggccaagcccaattcggcttagcattacatggctatcctttggtatcaagtatccggcgatgatcgtgtcagatatggcaacatggggtggattgaacgggtggtaggggtgaatgcggaacgcctcccggatacatgccttgaggtatgtgaggttctgaatgtcggattcctcgacaagtctttccttaccgacaacgacatcaagctcgtccactgccttcttcataacatttggattgtttaccatctcggccagtgcccactctacagcattcgatggattgtctaccgttgcaataattatttcctgcagccataagattaaatcacaggtgtccttactttgcatcgtggggacatcattacttatcgaatacaatccaaacttttggaaaattggaaaacaatattgattatactgtggcgtctaacgagcccacaacaattacgtctatacctaccaaacaaattaaatataagtgtaatccagtgatgaacaatgcgatattgttcatagttttgatttatctcttcgtttctcgatgcacgcgcatgggttaagttcagaatgagacagtaaacatgcattatactagagttatctgttttctttccaacattgtcataagtatttaaagtgttatctagatgaaatcattgattcttaacttcaaaatgaatgaaaccacaccataggatcatgattaggtataacaagccagcacctcactgagttatattccatctatgtcaaaatataagcatttctcgactatgacatttataaaaatatacaagcatttcatgaatactatttgttgttttaaccaagcagcattcaatttttttcccatcttattccccaaccatcccatattcataagagaaatcaaagtttttttctactcaaggtttcctcaaacctataagtgcttatattttactacctctgtttcatactataagttgttttgattttttggaaaaaatccaaataccaccctaaactttggataaatccatctagcactctaaactttaataccagacatctaactccccgaactttgtaaaatcgctcatattaccccctaatatggttttggatggtgattttgcatattttggtagcttaaacaaagaactttaaataaccaatataacatatttggatatcatcagttgtaagtcatcaatttatacttatacggtgataatatattattattatgtaggtacttgtttataagagctaacaaaagctaacaattgaaaaaaagaaagatttaagctgagattttaatatatatgtctaatgtgtatatcacgtgatcaaacttatccaatttatatacaaaaccatcttaggaagtaatatgaacagttttgcaaagttcaggggggttggatgtccggttttaaagttcagggtgctagatgaatttgtatctaaagtttaggggggttatttagactttttccttgattttttaactaagtcaagttctttagctttcacaaaacttataaaaaaataatagcaatattattaacataaaacaaataaactatcaaaatatatttaatgttagatttaataaaattaatttggtgatacttttttttatattttctataaactttgtcaagttttcaagaagtttgacttaaaaaatcaaaacgacttataatataaaatggagggagtataacacagtaagcaatacacaataatactaacaaataagaaacatgatacgccaatcatttagcgtgcgcagtactacactttgaacaaagctaaccgtaagcccgcaccatttgttttttaataaatgacgctgttaacttttgaatacattttgaccatttaatatataagatataaatcatgcttaaagtactttaagtaataaaacaacttacattatagttatgtaattttttaataagacagatagtcaaacgtgtgataaaaagggtagtactacataaattggtgacagtgtaatagtatcctttgttataacgaatcaacacctcactaagtaactaatatgccctccaatccaaaatagtagcacttctagggtttaatgtttataaataaatgtaagcatttctagaataagtctatgtctatgaataaatgtatgcatagtagcactcatatcgggtctattgaagaaagcaatgaggttgaaccatagtcactaaataagtctatgtgaacatggaagttcagaattaataggaaatgaagtggtgaaaagcgacggtttatttggtcatgggaaagactgatattcttctactatgaatgtattaaatttggctatatatattgctggcaaaaggcatgaatgaataaatgatatgcagtttatgggttatgaaaatccatatgaagttttcgctagaaagaaaacaatttcgcaacatatatgtaaatctcataataatcagtgtcatgaagcacactatattatcatgaagagaattgcaagactcgtagaagagtttatgatgactcacaaagagtttttctcctagaagtgagaatatttctcatagcagagaaattgacttccggaagaacaagttgatccttgtaggactacgctaatgtatgaatcaccggttaatctccatataacatcgataactcttactcccataaagtggacagacccgttcaaacgaatgaattggaaaatcacatccactagcatgcaagtggattggtagttttctacatactatgaaggtgtaagaatttatatatcatgaagatatactaatcaatggtatttggcaatcttattaattcccctaatgccaaaatatagaccggtttatgtcactctaagtggtttaagctaattgttgaagattagtgaaacaatcaaattggtaatgattgataaatccactaagagaaagttgcataatatttaatttcttgtattgagctaattattttatacataccgcatatgtgtatcgttgcaacttattttcccatagtcctccgtaaggataaaactttgtttgtactgcacatttgaataagtggttatacatattgctcctatacgttgatttatttctcatgttcatagtagaacttatgaaataagtaaacgaaagattaaacattgtggtaattttattttcattattttacacattaataaaaatgtggttatgacattggaacatggaagtttcaacggatctcttcttgagggggagcatatatgctaaacattgattatcatacttaagacttggaagtcttatttttgatttaccaagaattaatcaaattaatcattgttttgataatttaccttgaaggttactaccgctatattgttgtgttaatccaagttgattaatataataaagcatatagatcattagctatttatgaagaatagtcgatcttaaagattatgcgatcaagaatatttctcacgcaaggtttttaatgaggcaacaagtgcaatatattctcctatccttttctcccactaggtttttggatggagtttttaatgagacatgtgtatagcgcggtattcgtccaagggggagtgttatgaaactattatctcctgccagagataaatatgggctcataccaaatatatggatacgtatcctaataggtgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaaaataagataaacggcgcagacggctccactccacaggcagcttgaccagggctacacctaatccttcacaccatcagcatcactgtagaactcttcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaatgtcacgcccggaaattcactagtaatttccgaactaatttgtgcataaaatcctcgtccaggaatcagccgaggtacacaaactgacaatttaatatacaaatccatcttaataataacgttacatacttacaaagaaaagaaaacagcagcggaattaacggtctagcgatggcttcagctccactcccacaggcagctcaactggggtataagccaaacgtcttcccttctggatcctttatcttcaactgaggtttgatgattattgcaagaatgagcatatgacatactcaacaagccacacagcaaatatgcaagtgcacaaggattccaaaggatggcataatataggctcatttgcaaaagcagcatttagcaaagatttaagataagtaaaacagtagagtaattaatcatcaattttaatcaacactgaacagcacacccatgctgctcaggcccaaccaaacctgaacaaccaaccccggtcgtacagatcaaacctccaaactaggaattatccattccatactaggagtcaaattaattatcacattattaacattgatgagtagtgtgaaactaatcacgaaaaacattgctcaacccgcccataaccacgggcacggctattcgaatagttttactctggccagaggtgtaccactgtacctacaagacacgatttcgcacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccccgtggacttcttgccacttctcagtctggcgcactataatgaatcacgctatacaaaagataaagccgttgcccatcctggcttgtggttggcacggtaaatgtttcacaacagtagctcgcgagccggtccttaattgccatgagcacaactatcaaaaccatatgctcacaacccaccttaaccagattttaattatcaattaattaacatcacacgattaatcatcatgagctaccattaaatataaccataattaataagaataatataatataatttatatttaatcccctttaattagctaatgtttctaagcatagctaagcaaacttacatatagcatttagctgaaccaatccaatatataaggttcatgctaatcaaattataacccataggaaaataagatcatcttcggccattaattaacggggaaaggttcaccacccgatgacattcaaaaataatgcatagttgaaataaaataatagctttaaatgggttcaacatgctcaaagggttgtttgggatctgtgtgacttgccttgggcttccgcaaacacttccgaaccttgctcaacgaaaacgctctcctccagaacgtcggaaactaaagcgaaagaataaaaatcaacaaaacagtacaaaaacaagcataaacagtacatgtgaatatttttaacatatagatcttgattttagaaaaatttagcaacttgaaccactcgaatcggatctacagttatttagttatgattttccgaagatttaatctattagaaaaaactggaaaaggagaagatgatgatgtcatgctgacatcatccatggcgaccggctcggatggcgacctcgccggagctagggtggtcggccgggaaaaaggagggcatgtacacgtagaggacgacgagacgaacccaacggtactcaccacaacgacaaacgacgttggacgacgaccggcgacgagaggggcgacggcggcggctcggttgaccggcggcggaggagctccggtggccggcgacgacggggaaggggcggccgggctagccctcggtcacgcgcacccgccggcggcgagaggaggcagcggcgacggctagggcgacggcgcagcgcggctgcacgttgaccggcgacgacggcggcttgcgcgacgcggcgacgaggctacggagcacgagagagcacgggaaagagggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccaattcttaggggtaaagatagaggaggataagaggaatatttcccctcaactaattttgcaaacggagctccggatgaggcggatttaacggaggaagcggcggctgcgcagggcacagcacgggcggctcggctctgtccagagctgtaagatgaacagtgccagggaggtaaattagacttttggttggctgagaacagaacagggcacttgacttgggccggcttgggctgcacagcacgcgcgcgacggagagagaagaggaaggaatgggccgaaaagggcccaagctgaggaggaggatttttattacttttccaattaaaataatcacttaaatgatctttcaattgttaaaaatacttcctatgctcaaataattccaagaaaaatcttgaaaatacttggacactcaaagtacttaacaaaattataactagaccatttaattattaatttaatatgtgggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctgataataatttattaaataatttataaatcctgaaacgaaaatcagggtgtgacaataaaacagttaggtaataattaattaatattaatccaacgctatacaacataccctgttgcataggcccaatcattctgaacaaccatcccggctgtacagttctatctccaaaccaggagctaatcaaattattaccagttatatcatcttttattatgatgagaggtgtgagactaaacacgaaagacattgttagacccgcccataaccgcgggcacggtattgaatagttttactctggccagaggtgtaccactgtacccacaagacacagccccacaacatgtcaccatgtgccttaataccaccacggtacctcggaaaggagctgtgacagtacccctcgcacaacacaatcaccacagcgcacctttctggatcataatcaccccctttataacaaggcatggactccccaccaaccccggtggcttatcttcgccacttctcagtctggtgcttcccaatgaaaccatgctatacaaaaagtaaa

SEQ ID NO: 60715 - DNA, 14097 bp, Oryza sativa
cctcaattgatttcaccggagaaggaaagttgcggccgaatttggaaaccgccggcggcggcgcggtgctagggtttcggccggaggaagacgacgactccgacaggcgggacccacctgtcagcggcggcgagctcgcgcgggcggctgctgctgcggactttgccgacttgggcctgggagagagagagaaggttttgggccgactttcggcccaaagccaaaagagacttttaaaaatctttttcaattaaattattcatgaaatgcatttccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccatttaaacaacaatttatatatttaggatttttagggtgtgacaaacctaccccccttaaacagaatctcgtcctcgagattcggaagaactggcgaacaaatgcggatgagctgacttcaattcatcttctcgttcccaagttgattcttctttcgagtgattactccattggactttgcaaaaacggataactcgatttctggttcttctctcatctatttccaagatacggattggtttctccacataggtcagatcctcttagacttctatctgttcaagattagtttcttcggtaggtactcttaaacacatcttcaattgcgacacatggaacacattatggactcctgccaaagattgaggtaacttcaactgataagcaacctctcctcttctactgacaatcttataaggtcccacaaaacgcggtgccaattttcctttggtgtgaaaacgatgaactccttgaagaggcgtgacacgaagatacacataatctccttcgtcaaaactcaaatctctgcggcgattgtcggcataactcttatgacgagactgggccacacgcaatctttcttgaatggttttcaccttttcttctgcttccctcaggatatccgtcccgaaaacctgacgttctcccgtttgatcccacaaaagcggagtgcggcacttccaaccatacagtgcttcgtaaggagccatctgaagactagcttgataactgttgttgtacgagaattccgcataagtctaaagcacaagctctcaacatgtcttccaaaatctgatttaccctttcggtttgtccgtctgtctgcggatgataagcagtactaaagttcagcttagaacccatctcttcctgaagcttcttccaaaactttgaagtaaactgactgcctcgatcagacactatcttcttagggacgccatgcaaacacacaatcctggccatatacaattccgccaaccgacttccagaataagttgtctttactgggatgaaatgagccactttggtaagtctgtcgactatcacccaaatagagtcatggcctgatgacgttctgggtagaccagtgatgaaatccataccgatttcctcccacttccattcaggaatcttcaaaggctgcagcaaaccggcgggtttctgatgttctgccttgactcgctgacaaacatcacatactgctacgtattctgcgatttcacgcttcatacttgcccaccaaaatctttccttgagatcctggtacattttggtactaccagggtgaatggagtataaagtatcatgagcttctttcagaattgcatcttttaaatctttgttgtcggggacgcagattctctcacccaaccatacagttccttgctcatcctacaagaaaccgatagcttttcctcttctcatattctttttgatttcttgaatatcagaatcattaatttgggcttctctaacttgatcaattagagtgggcttcgcttctaaggctgcaacgaaacctctactgacaattcccaaatttaacctttcaaattccttgcataactccaatggcaactgtcatccttccgtagcattgcaatagcctttcctgctaagagcgtctgctacaacattagcctttcccgggtgataatgaattcccatgtcataatccttaattaattccaaccatctccgttgtctcatgttcagatccggctgagtaaagatatattttaaactcttgtgatcggtatacacctctgtacgagtaccgaaaagataatgacgccaaatcttcaacgcatgaactactgcagctaactcaagatcatgagtagggtagttcttctcatgcggacgtaactgacgagatgcataggcaaccaccttcccatcttgcatcagaacacagcctaatccaagtttggatgcatcgcaatacacttgaaaacccttctttggatcaggtaaaatcaaaataggagctgatattaagcgattcttcaactcttgaaaactctgctcacattcttctgaccacttgtacttcacatccttttgaagtaatcgtgtcattggcttagcaatcttggaaaaattctctatgaacctctgataatatcctgcaaggcctaggaaactgcgaatctctgaaactgtctttggttgtttccagttggttacggattccacattactaggatcgacggcaactcctcctgctgagatgacgtgaccaaggaacttcacttcagacaaccaaaattcacacttgctaaacttggcatacaactgatgttctcgtagcttctctagtgcaaggcgaagatgttcttcatgctcttctttggttcgggagtagataagaatgtcatcaataaagaccaccacaaacttgtctaggtattccataaacaccttattcatcaagttcatgaagaaagcaggggcattggtaagtccaaaagacataccagtacattcgaacaattcatacctagtggtaaaagctgtcttaggtatatcttcctcgttgattctcaactggtgataccctgatcgaagatctatcttggagaaaacggtggcaccttaagctgatcgaacaaatcatcaattttgggcagcggatacttattcttgatagtcacatcatttagtgcacgatagtccacacacatcctctaggtatgatctttcttttccacaaaaataaccggagctccccatggagacgaactcggtctgatgtatcctttctgaagcaaatcgtctacttgcctcttgacttctgccaactcattggctgccattctataaggtctcttatggatcggagttgttcctggtaccaaatctattctgaactctatatcccttttgggcggcataccaggtaaattgtctgggaacacatcaggatactcccggactacaggaatctcatccaaagttatttggttcagtcttgaccttaaagactcagaagacaatgcatgaacagttacaactcgaccatcattactggtgagagttacttttctgttagcacagtctatcacacctttatatctggctaaccagtccatccctaggatgacatcaaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgaagcaccagaatcgaaaagcactgttgcaggaactaagttaacaagaaacgtacccaaaatcacatctggagcaccttgagcttctgcagcagcaacatgattgacacgggcctttgatgctggtgcggtagagttgctctgggtagggacaaccttcacgcgtcggggcttcggacacttgtcagcataatgtcctaggtctccacagttgaagcacaccccgggcttgctgccttgctccttcttggcaggttgttgctgtgtcgaagctgcaacagggcgtggagcttgattgcggatgttgttgccagcattgtggttgaagaactgacgatgcggacgaacaacagacgaagaacctccctgtggcatagactggggtcctaaagtaagacgcggcctttgactattcccctgttgtgccttgaattgagcaatccggcgtttcttttgctccatgcgattgtacttgtcctcctggcgaatagccttatccactaacttctggaaatcatgataatccccagtcatgagtgggtaagaaagctcatcattaagtccttccaagaacttctcctgacgctcttcatcagtgcgcacatcttccggagcataacgagccagacgattgaactcgtgcagatactccgtaacagagcgagatccctgggtgagcgacctgaactccttcttgagagacaccactcccgatggtatatgcgtcttccggaaagcagcggtgaattcaagccaagtgataggttcagcagtagtcctgttcaagcggaagtgatcccaccattcagaggcagggccatgcagctggtgtgatgcaaatgagaccttctcctgatcggtgcactgaagcaaatccaacttcttctctatgtcatgcagccaatcaccagcttcaacaggattggtggtgctagagaaagtaggcggcctcacacgaagaaattctgctaacttgttctggggaggtgcatggttatttccctggttctgctggttctggagttgctgcatcatcatgttcataagctgtgcctgttgagccaggacctgggcaagtgtgggattctctccattgttgttgttgttattgttgttgttagggccattcccgttgctgcgagtgagcaccatctggcatgggcaggagcacaagaagagaaaccggggaaaactacttaggacagagaattaatttaagttttattgatcttaagtgagtttcattattacaaaactgaagactctcacaccactaaactcaccaactaccaaacactcgaaagcaaacaaacgcatgcacttacatcccaccactggtgtaaatcacatgcgagacacacacaaccaaacttaaaacaagcaaactaacacaacgatctaagacaacggtttgacaaggcattctagttcttccgggcatcggagttggttgaaggctcgttcggctcgtcttcatcatcttgagttgctccccactcgatcttggaatgggtgtgcttggattcttcttcttcatcatcacttacgttgacgaccggaggatccgctagggctggggtaacttctttttccaccacacggacctttggcgccaattggtagcgagggacaaatagagctctcttccttgcggtaagacgaatcctggccttctgcggtggtgcttctccctttaacgcggctagttccttctccaaacgatccaccttgtcttctagcttgcaaatcttaccacgattccgatcttcacgatcttgagctgctagcacaacctccgcacgggtttcatccatagcccgcagcatctcaaccaaatgccttgtggtagcatcattctcaattccctcagtctcaaggtagctgccacgatcacttccctgtggttggcgaggatggtagcgatactcagtgtcggccaactgatcactgtagcgatcgcggagctctcctatggcgatccttgccacctcctgacatgcatggatgtagtttcttcctctagcttcgaacatcactgaggggatatcttcactattactgttcaaggtgactttgactcggcacttttcttcgtgacgatcatgaggaatctgggcgtaaaaaggggcagtcccaaatcctatgacaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagtaaataaaataaaccaagcttgcaagataagttgaaatagttggaaacaaggtcacaaattttgtacttttgaacaacaggttccaaaagaaataaaagaaagttataaaatcaatatgctaaatttatttccttgcagcaagattaaattaaacaatattgtaaaacttttgctggaaaaaggagccattagtacagtaatagatgtacagtactaataatgctgaataaattttgaacgaaaaccactaaaagagattatgaagtgcatgtgctattagttgggtttaattaaaagataagggggaaagaacagttctactttttcaatatttttagagggcttctatgggtaaccatctggcataacctagggtcaagtcggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaaaataagataaacggcgcagacggctccactccacaggcagcttgaccagggctacacctaatccttcacaccatcagcatcactgtagaactcttcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaggtaataattaatcaatattaatccaacgctatacaacataccctgttgcataggcccaatcattctgaacaaccatcccggctgtacagttctatctccaaaccaggagctaatcaaattattaccagttatatcatcttttattatgatgagaggtgtgagactaaacacgaaagacattgttagacccgcccataaccgcgggcacggctattcgaatagttttactctggccagaggtgtaccactgtacccacaagacacagccccacaacatgtcaccatgtgccttaataccaccacggtacctcggaaaggagctgtgacagtacccctcgcacaacacaatccaccacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcatgaaccggtccttaattgtcatgagcacgactctcaaaaccatgtgctcacaacccaccattatcaggttttagttggcaagtaattaattaaccaatcacgattgaccatcgtgaactatcattaagcaatcattaaataatagtgaatcataagttatcccaatagtgtgctaatgtttctaagtatggctaagcaattatatctaatacatctagttgaaccaatatatatatagcccaactagtcaagttataacaacccaaggtatcaaggaataaagtaatcaagaacaaaagggctataacaaacaataggttaattccacccaatgacattcgaaaataaatgcaatagttgaatagaaacaatagctttaaacgggatcaacatgcttaaaggattgtttgcgatctgtgtgacttgccttgctggccttggaactcttcaaattcttttcctgcgaaaacggactctccggaaacgtcggaatctaaacagaaaagagcaaaaacaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaagggaattattgcgtcagcggctagggttagcggtggaccgggcgcacggcagcggttcacgggaacgaacggccgagatcgatccatccaaaacggacggccgagatcgaacaggtctacggcggctcacggcaaacggaccctgatgacatcagcggtgacgtcatctccggcggcggctcggcggctcaggcgcgcaagctcgccggcgaacgacggcgcttcggcacgaacggagggcaccaggacgtagagcacgacgcggcgaacttaccgatgaccaaagcaacggcggaggagcaacggacggcgtcggcgacgaggtcgaagcggcggagaccttcggcttgacgacgacggcggtgctccggcggtctacagcgacggcgaaggggcggacgaggaacgatggcgacctccccgagcgacgacgacgaccgggacggcggcggcgcacggctggagcggcggcgacgactgcggcacgagatccacggcgctagggctcttccgatggcgagagacgaaggcgagggtggcggcgggtagaggagacaccggggatccttttataggggttgaaaggcggcggcgaaggcccacggcgaccggcgacgcgaaggaaaggtttgggttcggagagagggagaccgatccgaatcgacctcgaatccacggatttccaaacgaaattagccgatgattccaaaagagaaatggtagaggagatcccgaagatcgtttcccctcaattgatttcaccggagaaggaaaggtgcggccgaatttgggaagcggcggcggcggcgcggcgctagggtttcggccggaggaagacgacgactccgacaggcgggacccacctgtcagcggcagcgagctcgcgcgggcggctgcggctgcggactgggccgacttgggccggggagagagagagaaggttttgggccgactttcggcccaaagccaaaagagacttttaaaaacttttttcaattaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccatttaaacaacaatttatatatttaggatttttagggtgtgacaataggactcttcctattatgggtatatataccgatagagaggtagggagatctgaatatatccacatatgagaaagtaataaagctgtgatgcctctccctatatccgtgttcattgtttatctattatgtgcttgtatgagagatcgttgtcgtctactccggatcagcaaataggccactagttattcaatagaaacaatgaaaacaggttgacagtgatttctctctagaatcttgtcgcccatctcggctaatcttctggttgtaatattctcactacacccttcacagatctactgccatctggcacatgatcatctcttcccttatcttgttgattaccctgcttttgaaaaccaatcaatctgtttccctctttccaaatatcccacaacacaaagatgaattagatcggataccttttctttgtgttgctcatccggcccattcgactgtccgcactagtttcaattagtgatctgttccctgatacagcggctgaaagaaaattctgcccaattcttttgccaaatccctgctccaactgctagtgagtatgagaaatctttcaaaaggtgttgcatcgtccccatgttccaaaacataaatatcaaacacaatagttcttgttcggtcatcctcgactttgtagtcactctgaaatccatagccgattgtagtacagcagccaagcaaagaatctttggttagattgtcctaggtttcccaaacggtttatcattttccttggactaaatgccatattacacaagggtggggtttgtagtatctaactctaaggtgcttagccagcttctatcactatgaactggccttgatacatgttgcggcctacaatacatgttgcggcttaaaaaccagtgctaattataaatattagtgccaatacgttcttagttataactggcactaatggacaagactacatcatgccagataaaaaactacaaaatggtcttagctacctattttattgtatctacctcatatagaaggagtaataatcgtggttttgctttcatacaaaacggtcttagctacctaatttaatacatccgcctcatatagatgaagtagtaatcgtggttttgcttgcataagtaatggtttagacaattgcaggcttgtagctgactcttgaagctcaatcctgtcaccacctggtggtatgctccaactgaacccctgcagaagccttgcaaatagcatcattgtaattgatgttccgagtgacacggcaggacagccacgcctaccagcactgaacgatacaaaacgtaactctggctcagctagcaccacagtaccagtatttttcagatgtcgctctggttggaattcgagtggtttatcccatgctctagggtttcgaccgagcccaattcggcttaacatgacatggctaccctttgggatcatgtatcccgcgacggtggtgtctgcgatcgcgacatggggtgggttgaatgggtggtaggggtggaggcggaacgcctcccggatacatgccttgaggtatgtgaggttgtgaatgtcggattcctcaacaagcctttctctaccaacaaccatatcgagttcatccactgctttcttcatgacctttggattgttcaccatctctgccagtgcccactctacagcatttgatgggttgtccacggtagcaaggattatttcctgcggccataagatcaaattaaaacagtgttggattttcatccttcaaggggcaacctctaatatgtctttaactctttatacaatcaaaattttcatgagaacttttggaaaattgacaacaatattaagtatgtactgacatctactgaggtcacaacagtcaaatctagactggacaaatatatagaaaacagaagaaatccagagatgaacactacaatgttaatgttcatatatagttttgatctgtcccttttgtttcttgatgcgtgggttgagtttagaatgagataatagatatgcattatactagacttacaattcttttcaaacattttcatagctatttttcaaaaagaaaccatagatattttgcacgttcactatcaaatcatcgtaacggttaattttaacttcaaaatgaatgaaacccaccatagtatatctttacctataacgaaccaaaggcctcactaattatttctaaaatataatcacttctagcattagaaatttggaccaaaacataagtacttcaagcatactatttttcttccgaggacatatctatatagtccaagtttgaaaaaaaaattatgtgacggtgtaataaagcttattaccagcgtttctgccttgatctcatctactgacaaaaacggtttcccttgtgcatcctccaaggagatcaacacgtccagaaaatcggcaacttctctcctcttatcaccttttgtcctgagagatttccattcttctatcctctccattatgataggatcgtgcagcctattgaatgtgttcatcaggccattgacaacctcctcatggccatccaagtcaagcccaaccagtgtcgggaagtagtcggagacggagaaggcgccgtggtagtccagcgccgtgaagagcgcgtcgatgtgagcctcctcatcacggccagggccgatattgccatcgccggagttgaagtgtctccggccaaacaccagcttcctgatgatgttgccacagaagtgtctcgttacgtgccggacgtctacagtgccatcattacagtggctgtagacgtaattgacaaggtggtcagcctcctcgacgcgccggccgagcatccgccgctccatggccggcgagaggatctccgacgtgagcacctgcctcatcttcctccactggtcaccggccggcgacatgatggtgttcttgtacccaaagctgaacgtccgcgacacgaacgacgatggccgggaggcgagcatggcgtccttcttgcgcaggacctcccgggccatctccggcgaggcgacggcgatcacgtggacgcgaccgaaacggaggcacaggatctcggtgtccatctcgtcgagcaggcggtggatccacctgaacaccggcttgttcatcagcatttggtgcatgttgctaaccaccggcatggtagctagcccgggtggtagcttgggttgttgcttcctcttggccgccatggcagctgcctgcttcttgatccgatagaacaacgcaacgagcaagaggatggccatggctattgacatcagaaaggtgaggacatatgcatggtcattttgggcgatgagttgtgatggcatgatggtatcgttgttcttgtgcatgattactgatttttttttgggagtgcagatagcctagctagatatatcactgattctgtggccaattaatttatagatggaattctaaacacgtgtggaatgaaacttcatcacgttttccttttcaataaagaaagaactattgcttttagtacgaaagagtcttgtacttgggtcgatgaacctcctggttatattctaagcgctttggcaaacgatgtaacaatgtttaatgtttaatgatcaataaagctagccgaatggcatttcctaaaaaaaaagaagaaagaactattgctagtgttcgcgtggtgctcggcttttgttgttccattcaaatattgacaaatgtcctggaaaaaggtgtgctctgtttgtcgccaactaattgacactagtcgatcgctattcatttttagaacttcaatcatctattctttaaattaatgtaaatgttccaaaatattgtatattatataaacatttttttgataaatgttatattttttaataatgtttttgtaatttagaagctatatactcccttcgtcaaaaaaagacaaaccctaggttttcgtgtttaacgtttgaccatccgtcttatttaaaaaaacttacaaaaaaaattaaaaagacaagtcacatataaagtattaattatattttatcatctaccaacaattaaacgttggatacggaaacccagggtttatctttttttttttgacggggggagtagtcgttacatttggaatagtaccattcaatactctcaaaatgataggaaagaatactaattactctagttcggtaatactagcaaagtgcccgtcgtctcgccggccgccaacctggcgagcacgctggcatgaaccagctcgtcgttggtgccactgatctgctcccactccccctgacatccgcgcttctccccaatggcagcccgatgaggagcggaaggaggaagatggggcggtaccgatctgatggacgggaaagggaaggaagacaagaaatataagggtctctgaccggatctcgatgtccatctcgtcgagaaggcggtggatccacctgaacaccggcttgttcatcagcatctggtgcatgttacccaacaccggcatggtagctggccccggtggcagcttgggttgcttcttcctcttgttcttggctgccatggcagcctgcttcttgatccgacagaagaacgcaaccagcaggaggatggtcatggctattgatactattatggtattattttgctcgcgcatatttgcagtactgggaaagaacatgtttatgtgtgactgaagagaggatagctagataactgattatg

SEQ ID NO: 60716 - DNA, 7934 bp, Oryza sativa
aggatacctagataactgattatgtggccaatttatagatggaattttataagtgatttgttcccgtccagcagaggtaggcgtaccaaatcctagccgtcaattgggacatatcagacggtgattgagatttctcggtaccgtgcagtaccattttagcccatatggtggtaccatcttttgaagagaggtgaaagggtagtatagacttttcatatgtaagggcgagatgttggcctctagggtgggcggtggggccagtgttgacggcggcatcagcggaaggcgaggtccggggccggcgttgatggcggcagcggcgagctgcggggttcgatggttcggggatgtgtgcggccggcggagtccagccccggcttcgatggtggcggtgagcactgagcagcagggtgcattgcattgccagcgacatgctgcaagattcgatcccggcgtcgacggtgacggcaggcaataggtgcgtcgacggcacgggctgcagggtccacagcggcgtgcggcatgctcggcgtcgacgaccatggcgagcggcggggtgtgacaccagacgaggtggtcgtggagagatcggacaccaagcaatgcggccgcggtggagttaggggcgttgccggccacgacgtcgaggtggccgtggagaggtcgagccagatgccacagcagcggcagcagcggcgagtcgttggactaggcgccggcgccggtggcaaggaagaatgcagtagcatcgatgaaggatattgggttgtgcatgatctggtttctgctaagatatgcatcgtcggtggcgtacggcgaagaagtacagatgaggaaggaaacaacgggcgcaagaatgagattttttcttttttgacgagaacccagaaacaagattgatttagtgttggaagaggtttcttactcattcccaatcctacccctaaatattggatagtcagatttgttttagtacgttgtggtactgggaccttgggttgggccgggtacaagtgctggatggtagcaaatcttatttcttaaagaaccttgctaatgttacatgtagtgctcgtgtttttgttcttccatttaaatatgcagaaatgtcctgtaaataaaaggagtgctctatatttgtttccagttgattgatcacaccagtcactatttatcttttaacatgaaaacaatacatagattgattgacggccgcctagacggcgactcatcgctagtccgtagcaagacgtccagattacatcctagtcagaggattttagtcgttttgctgcctaaatggtcccaatcaatcctaggcggcttggatggaaggatactgggcgtatttagatggcggagggtagcgattaggcaacaacgacttggcaatgagcagtggccaaaagttttggtgcaaatgtgcaatgcacggcgatgaaatatggaagcgtggggccagctgcattatagaatagaatggcattacgttatcttactacattcttacctgcttgtgaaccattctttagtgctgccacactcttcccctctacgcttaaagcgagagaaagctccccttcgtagataatccctcagtttcaggttacaagacgttttgactttagtcaaagtcaaattgctttaagtttgatcaagtttataaacaaaaatagtaacttttttaacctaagacaaatttattattaaaatatattcaattattgatttgataacactaatttaatattataaatattactatattcgtctttaaacttagtcaaacttaaaatagtttgacttgaaccaaagtcaaaatgtcttataacaggaaacggaggaagtactatataacatgtgttattttcaatcaatattttgtatttctatggaaaaattagaaaacacgcctagaccgtctaatctgcctagtcgtcgcctaaacagcctattctctaatcagtggctacccctgaattttcaccttttggtccttttaaaaaacttattttacaaatatacactccaaaatttattctataaatggccctttccgtaacgccaacgtcattggcgccgtgatctaacggaacaacaccaatgaagttgacaccatcccctccacccctggatggaatctaagtcactaatgtgatgtgggacgacgcaaatatcgttggcactgaggacctatttgtaaatttatttaacaagacctatttgtaataaaaatggttttatttgtaaaatatttacaaatagttcctcagtgccagcgttattggcgccaaggacctatttgtaaatattttttaattacaaatatgtttttttattacatcagtattgagtttttcggcccaaagcatcattgtaattgaagttccgagtgatacggcggggcagccacgcctaccagcactgaatgataaaaaccgtaactctggctcagctagcaccacattatcagtattcttcaaatgtcgctctggtcggaattcgagtgggttatcccgtgctctagggtttcgaccaagcccaattcggcttaaaatgatatggctaccctttgggatcatgaatccagcgatggtgatgttagcgatcgcgacatgggaagggttgaatgggtggtaggggtggatgcggaacgcctcccggatacacgccttgaggtatgtgaggctgtgaatgtcggattcctcgacaagcctttctttaccgacaaccatatcgagttcatctactgctttcttcatgacctttggattgttcaccatctctgccagtgcccactctacagcatttgatgggttgtctaccgaattaaggattatttcctgcagccataagattaaattaaaacagtgatggattttcatccttccaggggcaacctctgatatgtctttacttcccaaatacaatcaaaatttccatgaaaacttttggaaaattggcaacaatattaagtatgcactgacatctactgaggtcacaacaatcaaatctagattggagaaataaatagaaaacaagagaaatccatagatgaacactacaatactgttcatatattattttgatttgtctctttgtttctcgatgcgtgggtggagtttagaatgagataatagatatgcatatactagacttacaatttttttttcaaacatttccatagctatttttcaaaaaataaatcttagatattttgcgcgctcactattgagtcatagtaaccaacggttaattttaacatcaaaatgaacggaaccacaccatagtatattgtttcctataacgaaaccaagacctcactaattaattgtaaaatataagcatttctagtattagaaatttggaccaaaatgtaagcacttcaagcgtactatttttcttccgaggacatatctatagtcctagtttgaaatatatatatatgacggtgtaatagagcttattaccagcgtttctgccttgacctcatcaagtgacaacaacggttttccctgtgcatcgtccaaggagatcaacacatccagaaaatcggcaacttctctcctctcatcaccatttctcctgggagccctccattcttccatcctctccattatgattggatcatgcagccgtctgaatgtactcatcaggccattgagaaccaacgacgggaagtagtcggagatggagaatgcgccgaggtagtctagcgccgtgaagagcgcgtcaatgtgggcctcctcatcacggccagggccgatattgccagcgccgaaggcgaagtgtctccggccaaacaccagcttcctgatgatgttgccacagaagtgtctcgttacgtgccggatgtctacagtgccattattacagttcctgtagatgtaattgacaaggtggtcagcctcctcgacgcgctggccaagcattcgccgctccatggccgatgagaggatctccgacgcgagcatccgcctcattttcttccactgatcgcccgtcgacccaacggtgttcttgtacccaaagctgaacgcccgccacgcgaacgataccggccgggaagtcagcacggcatcgttcctgcgcagggcctcccgggccatctccggtgaggcgatggcgatcacatggacgctgccgagacggaggcacaggatctcggtgtccatctcgtcgagaaggcggtggatccacctgaacaccggcttgttcatcagaatctggtgaatgttacccaacaccggcatagtagctggcccgggtggtagcttaggttgcttcttcctcttgttcttgcccgccatgttacccaacatccgacagaagaacacaacgagtaggaggatggtcatggctattgatattattatgatattattttgctcccgcatatttacactactgggaaacatctttgtgcagtgtgagtgcagagacgatagctagataactgatcaggtggccaaatttatagctggaattcttaaagaacgttgctaatgtgacaagatatgtcatatgtcactctaccaacatgcgagtttaaattaaatttctacaggttgtaatttgttatttttgttacaatttatagaagttggatttgaacttgtatgtttgtggagtgatatatttcatattaatctactttgtcgattttttgaattgttttcataatcatttagttgatatgtaaaaaatgggtgtacatccatccaagtaattaaaatccatatccacatgtggggctcattttttttcttccatttgaatattctaacatggaaactagacataggttgatagtaatacatcacaaccttcacaacatccaatctgcacaatcagcatgaggaagacgtcgtgcccaagactatcttcattaaagcaaaaaaaaaaccctctctaaggtgaggacacatgttctttttccagttttaaataaattctttttcaaatctataaattattgtttaacttcaaaaattcataatttcctatccgtgactctgatctactccgttcaagtctttatttctaaattgagatccaccaaatggcactagtagttataataataataataatattttctttttaggagtttatttggttttctctgttttgcgcatagttgacaccgacggaatttattttggatgaggatttttgaagattttaagatgaggacagaggtaattaagttaacatttcatcatattgcttctactttccaaaatggtttgtttgcgaaattgcattgctagcgcgtatgttaatttgactggcctttgttcgtgtgacaaatcgacagatgtacccaataattgcattactactgtaggatattgatgaccccaaccctttgtcgctttcgggcgtagtaccaatggtcccactcacaccaaatttgtttgtcgatgtgggaaaatgggttgtgaaaccattttaaaatccaacacgtagtgtttgcatacatggaccgattccaaggattggtataagaaagagagtctcaccctaaatctcagtgtctccactttactattagattatacaacgtcgtcagactactctgtagcgaggctgtaggggttgtataatactccatcgggttttatatttcttgacgttttggataagattgaggtcaaacaattgtaactttgattattaataactttaaaagtattttctttaaaggaactagaatagcatatatagatttgtccttcaaagtaatataagaaaagtaaacatgcattatatattataataaaaacaaagtaaaagatatattttgttgaccgtatcattatcgaaaacgtcaagaattatggaaccagagtgagtacattattaaggacgaagctttactagagatcaaggtagaagaagggtaagaaacgtcaaaatatatttacgcttgaatactgaagtgtaaagaaaataatttcttgcatcttggaacaatgttgtgtcagctgctaagttagacaggggggcgtaccaatacttatgacttcactgatactgataagtctactgagaaccatgtgtgccagatttgcactatagtgggtcatacagctgatcggtgtcgccaccgtttttactaaaattataagccccaccgcctaagcatcttgctgactatgttgaggcagcttttttggaacttacaggggcgctgcgaaagctaaataaagcgagcactcggcaacttcaatctcacctctaccccgcactgaggtcaaaaccatctctcattcggggctatactactgagttgaccgattcctcgccgcccttctctgtctttacctgccgggagaagagtttgaggagcatccttctcgttccatttttgtgactctagacgaagagcaccactgccaacttggagtcggtggtggctagccgatttggggtttctggcattctccatggcagagaaggttgcaagcatggatcggacacgaccagaaccacgacgccggtggccacactcgcaccgacgacgttggaacaaatttaacaagagagttgtccccacttgctagaagtttatattttggggtcgagaggctttgtcatagaaaaaagtataacttccgacatgtacaccaactattagatttaagtatttggattgtttaaaccgatgaacccatcaaatctatatatataagaaaaacactttcctaactttgaatataaatcatttttctttgcttgacaaccaaaaaagaacaaacattaaaaatgacaatatatattacagagtaaatttcacaagcctagagagataaatctatctatctattattatatactaaaagtccatcaaatatactaaaactctcctaagatgacacgtggtgctctagttaattcctagaaaatctaaggaaaaaagagaacattggttttatttaatttgatggacccaatatcttttaccatcatataccgttacatttatctttaaaaaaaagaacttaagaacaattagaccgtacgagtctgcccaacgcacgtacgttcttccatccacctgcatgagaagtgcatgcgtgctttttccttgctcgtggctatctaatatcttctatattactaacttaatttcatcgcactccaaagactgcatgcacttgcaaatatggacaagacaatatccctcatgcatgttgatcttggtatgttttataaataaataaagaatcttcaatagttgtaaatattaaattatatattcaatttatgatctgtttgaaccattgtatacttaaagaaatcctaaaaaaatctcattaaaagtcaaaatatccaacttattttttgtaataaaatcaatggacccatacctataaaccgcattaaccataattatagcatcaatggacctattgactctcaaccaacttaattatatctctcaacatgtatgtggaggctatttacttaatcctgatgctttatgcttgcataaagatatgatttttttatgggtaaatgaacaatcttaggctgtgttcagcgctgagggttgggaaaccttaataccttggaagttgaacattaaattatagcccaaaatacctatatcacagaattaccgggaatgctacctaactttgctcaaatccaaataattcaccaagaaaagaagaagggaagaggggggtctacagggggtgtccttatggatattctactaataaaaatttattgcagatacttatttgtatgttatttattaaattatctaatcattagaaaaatgaacatactatctatggagtaaacaaattggggggctagccaggtgcatcccagtgtgcatgcatgctgggtatataaattttttcttagatgaaaagatcgggcatgagatagttacatgtattatgcctatatatgca

SEQ ID NO: 60717 - DNA, 1525 bp, Oryza sativa
cgtcgctctctgcccctcccctgtgcctgacgccgtcggcaagctcgagctcgtccgtcatcccctccaccgccaagttcctccccgtggtcgtcggcgagctcgagctcgtcccctcaaccgccaagctcctccccgtggtcgtcggcgagctcgagctcatttcctccgccgtcaagctcctccccgtggtcgctggtgccggcgaggttgagctgcttccgtgcctccgtggtcgccggctgcccccaaagctcacgagcctaacgagctggctcgagctttcaaacgagccgagccgagctgggtttctagctcgttaggataacgagccgagccaagccagctcgacatccacacctaggtgtgtgtggcaagagtacatttcctagctgtcactttattcgttagctccaggctcaagcgaagaacaaaagagcaaagaccaatgcatatctttaacacaagttcagtagctactagctacatcaaattccttcttgcagatcagcaaattaaatagttccccttaaaataccctcttttcaaaaatttcaaaaaaaattacaagatagattgatatgtaatatgtcactccccaaacaagcgatattaaattcaacttctacaagttataacaaaaataacaaatttttaactctaattagtatacatatactcacagttgaatttattatttttgttacaagttgtagaagtcggatttcaatttgcatgcttgtggagtgatatatttcatataaatctaccttgtcaatatttttaatttttttcaatcatttagttgacatgcaataaacgggtggacatccacctgagtgattagaatccatctacacatgtggggctcatttttgttcttccatttaaatgttcattcagaaatgtcttgtaaaaaaaggagcgctccataatcgtttccaaatgattgacgccaatcactattcatttttgaacatggaaacttgacatagattaatagtaactataccacaaccttcgcaagatccaatctgcacaatcagcatgagcaagacgttgcgcccaaaacctatcttcattgaagccaaaaaccctctctaaggtgaggacacatgttcctttccagttttaaataaatccctttttaaatctaaaaattatgtttaacttaaaaaattcataatttcctatgcgtaactctgatctactccgttcatgtctttatttttttttctatattgagatctaccaaatggcactagtagttaataataataatattttctttttaggagtttgcttggttttttctcttttgcgaatagttgacgctgacggaatttattttggatgaggatttttaaagattttgaagatgaggacagatgtaagttaccatttgatcatatggcttctacttttcaaaatgttttgttgggaaattgcattgctagtgtgcatgttaacttttgactggcctcggttcgtgtgacaaatcgacagatctacccaataattgcat

SEQ ID NO: 60718 - DNA, 24337 bp, Oryza sativa
aattagtatacatatactcacagttgaattttattatttttgttacaagttgtagaagtcggatttcaatttgcatgcttgtggagtgatatatttcatataaatctaccttgtcaatatttttaatttttttcaatcatttagttgacatgcaataaacgggtggacatccacctgagtgattagaatccatctacacatgtggggctcatttttgttcttccatttaaatgttcattcagaaatgtcttgtaaaaaaaggagcgctccataatcgtttccaaatgattgacgccaatcactattcatttttgaacatggaaacttgacatagattaatagtaactataccacaaccttcgcaagatccaatctgcacaatcagcatgagcaagacgttgcgcccaaaacctatcttcattgaagccaaaaaccctctctaaggtgaggacacatgttcctttccagttttaaataaatccctttttaaatctaaaaattatgtttaacttaaaaaattcataatttcctatgcgtaactctgatctactccgttcatgtctttatttttttttctatattgagatctaccaaatggcactagtagttaataataataatattttctttttaggagtttgcttggttttttctcttttgcgaatagttgacgctgacggaatttattttggatgaggatttttaaagattttgaagatgaggacagatgtaagttaccatttgatcatattgcttctacttttcaaaatgttttgtttgtgaaattgcattgctagtgtgcatgttaacttttgactggcctcggttcgtgtgacgaatcgacagatctacccaataattgcattactcctgtaggatgttgatgaccccaatcctttatctcgctgcaccccgtggttccacggtaaccattctctcgggcatagtaccaatggtcccactcacaccaaacttgtttgtcgatgtaggaaaatgggttgcgaaaccattttaaaatccaacacatagtgttggcatgtttgcaaaataaaagttgtttgcgaaaacttgtgatgcaaagggagaccatctgtattcgcttacaaggaccgattccaccctaaatctcagtgtctccactttactattagattatacaaccctattggagtactctatagcaggggttgtataatactcgctccggtttcatatttcttaacgttttggataagattgaggtcaaacttttgtaactttgattatcaataacttcaaaattattttgtctaaaggaactagaaaaacatatatagatttgtccttcaaagtgctgtaagaaaagtaaacatgcattatatattagaatagaaaaataaagttaatgatatattttagagaccctattattgttcaaaacatcaggaattatagaaccagagggagtatgttattaagcacaaagctatactggagaccaaggtagacgaagggtaagaaacgtcaaaatttgtttgcacttgtacatctactaaagtgcaaaaaagaatgtcttgcatactagcttgtatactgaaatgcaaaaaagctgcggagtatacaactgcactgatgcctaagctattacatcgttaattaactgtactgcatcacctgctgttgtctgaaactctgaaagaatagtgatggagcaaagctctgaataatattagtagcacgaatccaacgagatagacgacgaggatgatcagtcgatcgatcgatgcccaggcctgaatgatatgtccgatggattgatagatttcattcctgtcctggatcgagacgtttgtttttgttcttgtttctactgctgcaagctgctagctttgtttaaatatcatgatccccttttcttttctgatcggtgtttgtttaattgatagaggctatagctagtaacatgcatgattagagcgcgcaaggacgattgtgctttgcatggggaccaagcgtggctaatctctcatgtctcatctctcattgcgtttggagtttttctctacttatcttatccttgcaataatgatgatagatggtgcgacatgaaagattccttctctctgctgcttatctgcaggccaaaaatgttgctaggtataaggtctcttttactgataagaggggcccatctgtcattcactgtgagttgaaaatataaagaggatttcagctatatttcaatcgattgcttgattgagattcacttgtcgcttgtcagctacacatattcaaaactcagtgaattatcttctagctacactaattagtgtatctacaagtctcttatagatttgataaatggaactagtttgccattaacaccgagcctgtctggggcatggctagctggctgacgctcgtttttttggcctaagtagttatactaatctactagtatattagataataacaatttaggataatgatggtagtagataagatttttttaactaacaaattaaaaagaaatctacatatgaagtcacagtttcaaaattttaaacctagatttgaaaactttcaactcgaaatttaaatttttttaagtcaaatttgaaaaactttcaactcaactttgaaaactttcaacccagatttgaaaactatcaacccagatttgaaaattttcaactcggatttgaaaacattcaactcggatttgaagactttcaactcacacttcatttttaccattagctaccatagggtagatgctaatcacgttggagtgactagatgggaactaatattttattgcttaattgtactataattatactataatatatgagatcaatattaattagaaaattcctatggtttatatattcctgtattccactacaagaatcctgttaatccatgatggaaaatttccatcacggatcactgaaaaaccgtcaccaaacaacatctatgatggtttcagaaatcatcacggattgagcgtcatggattgacttgcgtgacggtttgtcgaaaaccatcacagattaacagaatcggtgacggttttaaaccgtcacgatagagcccgaggcctagttagtccagccaagcgcatttcctgtgacgaaaaataaccgtcacggatagctgccacataggatgtttttccgtcacagattatctgccatgtaggatcacggattcgaatcaccacgtatgtgccacatgtttgccaaggtggacaatgatgtgtcatcgatgccacctaggatttagcccatgtgtttttggtccaattcgggttcctagagctttcggcccatttatgaccaactggattttttttgttttgggccaatttgtttttttgtggtgtttttatggccttttagttatcattcatcccagttcaaattgggctactgcaatatttcagcccaactaaaattcggctgatgctaaatttagcaaaatacaaatatttcatccataattttagcaaaatcaattacctatcatcaatttacattctctcatcatcagcagcacataaatattctaaaaacacattacaaccttcacatctcatacaacattttttttagcatatctcatacaacataattaaaacctgttcaaaagcacatgacaattcccagcagccaccaaagcattttggccactcctccatcaaagtttcagcccagcaacctgatagtacaataccaaatgttagatttttttttatgagctagagaaacaacaagaaacaatctacagatacgatattagtttttgaatgatagggctactttgcaacaccaatctgtgtccccataatatattgcgctaacagaactcaatgtccctatccccaacccacctcatttcattggccaagcaaacaagcaactgacgctagactaaaccaaaaaaaatatgagagcaagtaaagtggtacaggaaagtgaactagaatgcataggagtatagcactaaatttagacactaaagttatgatacgagtaacttcctatgcatgcttcatttctacggactataggcatatagtatttaaacatatagatttgtatgcatgaccataaagatgagaatattggtcatggatgatagcatggtatactaattaatagtccgttccactgagtatatagacagttcctaacttcctatacggcagaaatcatgtgatgcttctacacatgtacaagcagatttacctaaaaaaacacatgtacaagcagaaggcaacaaatgataagcaatatgtttaatttattacttcatatggtgtcttattagatgcagtatatttggtaataaactgataatcctagctgcctctcccagcagaagtgcacaaatgaagtgttcctagcatgcatgtttgttacaatgttttgatctgaatgtcaatttgtagagaaaagaactacatatacaaattacaagtacagaatgtagatcagtaggggaaagcatgctaggatccacgggtggaaatcgacctcgaggttccacgggtggatcttcgagttgatctcgtggtcgacggggaaccgcgacacgccacggcccccgaccacatcggccatgccgtcgtcagcgaacgagaggaaggacgaggcggggctctcgtcgaatccggcggcggtgcgggaagaggaggaggagaggcgctggtcggggtcgctccaccgcggcacctggtcgagcgtcacggccggctccaccccacccacgcccgtcgccgccgccgccgaggaggccgaggccgacgcagctgttggcgagcgctggatcagagccgcgagcgtgagggtttggggaaagagatctggacttagatttggaatcggctagggttgaggggagtagcaattttgatgcgattttactagaataaccctggtatctgaaaacctattatacaagttacttggacaaaatggtcatttaacctggaaattttaaaatattaaaactttgaatcgaattttatcatattaaatgaatttatgtgaaaaaattattaaaaacaaagttgtataacttatcaagatctataacttttgttttggtcattttgctatatgactttgtttcaataatttgaatttcaatttcaaattatgacaacttcaaataatattttcaaaactaaatgattttaactaaaaaagtcatcaacaacaaagttgtatagctcatcaatatctacaaattttgttttggtcattttgctatatgactttgtttcaataatttgaattccaatttcaaattatgacaacttcaaataacattttcaaatactaaatgatttcaactgaaaatatcatcaacaacaaagttgtataacttatcaatatctataacttttgttttagccatttcttcatccaataaagtgatagtaacattgttcacaaaatttacacatctcccatatggtttcataaactataagagacatatgtaaaatttgtgaacaatattaatatcactttgtcggataaagaaatgaccaaaataaaagttatagatattaatgagctatacaattttattgttgataactttttcagttgaaatcatttagtatttgaaaatgttgtttgaagttgtcataatttgaaattcaaattcaaattattgaaacaaagtcatataacaaaatgaccaaaacaaaagttgttttctattttaatacttgatccgaaaaaggcccaagtgcagagagagaaattttaatttgttttctatttattttaatagagtaaatgaactttgtggtattaaaattagttattgagcttcgaaaattcacggtaaatttcaaagaataatttagatcacgtagaatatttaaaaaatatttcctttttgaacttctattttaccaattcgagttcttttttcctttttgaaacgccaactctgagttgctgggccacgctatgggcaacatcctgggcctactcgagtgacatttggacaaataaaaggcaaataaaaatattttaagtacacattgggaccaatagaacaagtggttcaaatggtaagacgcattcctaccgtcagctaagtgtgggttcaaatcccacatgttgcagatttttacccatgcgcaccatatttttttagtttgccatattatgcatcatatacatataacatattaacaaaactattttgttcaaatttaacaaatcgtattttgggtttgattcttcttgcaatcacatttttttatttttctttgcgctaaatatgttttatttttttattgttttgggctacctagagtatgacgaatttaaaatcatacattgtgacagtcctgataaaactgtcacgagttagtgtgccatgaatatccactgggctcatccgtgacaaaaaacaaaatatcgtcacggattacgtttgtcagtgacgatctgtaaatccgtcaccgagaatccgtcatggattaacaagtttcttgtagtgttccgaatgcttattaccatcaaattcctttgtttttcaatcctacgttttgtatatgcaatcctatattattcatgtgtttttcctattcctatgtttttcctatcctgtgatccgaacaagccctcggtgtctaacgatgaagaagttactgatctgaaccatttgatcatcgataagttaatggattcaccttttctttgggtgtgtgtggcaagagtacatttcctagctttcatctttattcgttagctccaggctcaagcgaagaacaaaagagcaaagaccaatgcatatcttcaacacaagttcagtagctactagctacatcaaattccttcttgcagatcagcaaattaaatagttccccttaaaataccctcttttcaaaaatttcaaaaaaaatgacaagatagattgatatgtaatatgtcacgccacaaacaagcgacattaaattcaacttctacaagttgtaacaaaaataacaaatttttaactctaattagtataaatctattcatttaactcacagttgaattcaactctattcatataaatctaccttgtaaattttttttgaatttttttcaatcatttagttgacatgcaataaacgggtggacatccacctgagtgattagaatccatctacacatgtggggctcgtttttgttcttccatttaaatgttcattcagaaatgtcttgtaaaaaaaggagcgctccataatcgtttccaaatgattgacgccaatcactattcattttcgaacatggaaacttagacatagattgatagtaactataccataaccttcgcaagatccaatctgcacaatcaggatgagcaagacgttgcgcccaaaactatcttcattaaagccaaaaaaccctctctaaggtgaggacacatgttcctttccagttttaaataaatccctttttaaatctagaaattatttttaaattaaaaaattcataatttcctattcgtaactctgatctactccgttcaagtctttattttttttctaaattgagatctacctaatggactagtagttattaataatactattttcattttagtagtttgcttggtttttctcttttgcgaatagttgactacaacagaatttattttggatgaggatttttaaagattttaaagatgaggacagatgtaagttaccatttgatcatattgcttctactttccaaaatgtcttactgcaagattgcattgctagtgtgcatgttaacttgactggcctcggttcgtgtgacgaaccgacagatctacccaataattgcattactcatgtaggatgttgatgacgcttcaccccgtggttccacggaagccatgctctcgggcttagtaccaatgatcccactcacaccaaacttgtttgtcaatgtggaaaaattggttgcgaaaccattttaaaatccaacacgtagtgttggcatgtttgcaaaatataagtggtttgcgaaaacttgtgatgcaaaataaaaggctttgtttgttgccctggttcccaactccccttctcgttttccgcatgcgcgtttttcaaactaataaatggtgcgtttctttgcaaaaagtttctatacgaaaattgcttaaaaaatcatattgatccattttttaaaaaaaatagctaatacttaattaattacgcgctaatggacctctccgtttttcgtgcgggggacatgggttcccaacccaacttgccgaacagagcctaaatctcagtatctccactttacttttagattatacaaccctgttggagtactctgtagtaggggttgtataatacttgctccggtttcatatttcttaacgtttcggacaatattgagatcaaacttttgtaactttgattatcaataactttaaaattattttgtttaaaggaactataacaacatatatagatttgtcattcaaagtgttgtaagaaaagtaaacatgcattatatattataataaaaaccctgtttctactgctgctagctgctagctttttttaaatatcatgatccccttttcttttctgatcggtgtttgtttaattgatagaggctatagctagtaacatgcatgattagagcgcgcaaggacgattgtgctttgcatggggaccaagcgtggctaatctctcatgtctcatctctcattgcgtttggagtttttctctacttaattatcttatccttgcaatgatgatgtagatggtgcaacatgaaatattccttctctctgctgcttatctgcaggccaaaaatgctgctagattgagaggggtccatctgtcatatatataaagaggttttgagctatatatttcaattgattgctagattgagattcacctgtcgcttgccagctacacatattcaaaactcactgaattatcttctagccacactaattagtgtatctaagtcatagatatgataaatggaatcagtttgccagtggcaccgagcctgtttgagctcaccagcacccggttgccaaagcagagggagagaaaccccaaacataatattggtacgatggtactaccaccatcccattttaagcacagccatgagttttcatattcaactttaattgttcgtcttcagttaactgcccagcatgtaccgagctcatcgctcgattcacacagtacagccaccacggagctcgtggtcgcgggaggggagatgcaagaggatatcgtcgccggggcggggaatatggcagaggtcaagcggcgttcagtagtcaagaggcggcgatggggagaggggagaggccgcatctttccttccccaaagatacaatgcaaaacaaggggataacgggcccttctagcactcaacatattgtcggatcagctccacaaagctcatcaatcatcaataattgcatgaataatcgacaaatctacctaataatggcattactccagtaggatgttgatgaccccaaccctttgtcgcttcaccccgtggttccatggtaaccatgctttcaggcgtagtaccaatggtcccactcacacaaaacttgtttgtccatgtaggaaaatgggttgtgaaaccattttaaaatccaacacgcagcgctggcatgcttgcgaaaacttgctatgcaaagggacaccctttgaattcgcatacaaggcgtgattccaaggattggaagaagaaagaaagtactaccctaaatctcagtgtctccactttactataagattatacaaccccgttggactactctctaatagggctgcgggggttgtatgatactcactccggtttcatatttcttgacattttggacaaacttttgtatctttgattgataataactttaaacgtattttgttttaaggaactagaacaacatatatagatttgtccttcaaagcactataagaaaagtaaacatgcattatatattataatatttttttgaaaagattatttattatagagtaaattgcacctacagtacaacaacttgacgggtgtgtgcgatatagtgaaagaacttgagaattgaacgttcgagtgcaacaacttgacaagtgggtgcgttctagtacaagaacttgacaattttacatccaattatccttaagaatttttgttttcttcaccttcctaaatctcaaccgaaatataataatttctacatccagtttaattaactttcagttattagttattagaataaaaatataaatatgcttatatataaatccacgctagtatattgtcaaaataagtacttaaaaattgaatatgtataaaaaaagtgctccaaataattaagttgtcgtataacttcttaacttattgtatcaaaatcgtacgtatcatgcaagttgttgtatgtatgcaatcacttataaagtttttgtactaaattacactttcctgtcaagttgttgcactagaacacgtatttttcaagttcctgcaccaaattgcacccacctgccaagttaatgcaccgtgggtgcaatttactctatattataatatctaccaaacatctaagagatgtactgctggaattcccgaagttgaagcacatccacctaaagcatctccccaagctacaacagttatgcgagatcagcacaagatgtttgctcgtgaacttgagacaatcaagttgagggtatgctggagcctcaggagtatcccagctattgccgacagtcgtcatcaagacagtcgccctgtcgtggactaagaaaaggactggtgggaaaagttggagtgggatgggctagagggtggccaccacccttccctgcgtgggccatgccattcgatgtacaacaagaagaccctacccagagtttcaattctctggtgaggcgacatatatatcaactgctaacttatcaaggtacatatgaatatatagcttcctctaccttggtattattctttaattaacttaattccatgtttgtatcacactactacaaaaatcgtttttctgtacgagggggtcggtaggttccatgcggcccgcttgtggcagcgcctgcaaaaaccgcccccctggggcgggttgattagccgcatgcgatgatcggccatatatgctcctccaggcccgagcttgaccatttgaaaacgaagctttctctctcctaaagcaagcaccaattagggggggaggttttcaacccgaaatttttacttgaactctatacgaaaggtgaagaactctctatcctgcttcatttggctccatttttgttatatttcgttggtggaaagtggagtttttttaatattttgacaaggtttggtctaactattttttgcaaaatctagcttcaaaatatatgttttgatgggcaaattttgcatgtaatcaattgtacatactagttacatgtattgttgtatttttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagtatctaaatttattgatcaggctaaggtgcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcggagaattttataatcgaagacatgtcgcgtgaaagaatggttgtcgatgtttccaccgatagtgatgatttcgatggtggttttgatattgaggatatgctacgccatgttgaaccagaggtgctagcgggcaggtcacgaggattggagaattggcaggcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttataagaatcactgcatattataccgtaaagaatatgcggaattggaatgttgcccaacgtgtggcacaagtcggtataaaacggggaatgggcccatagattcagagtgtacagatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacaactatgggatgagtttaagcgggagcacttcaatctacgtgcgatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagttgcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttcttcaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtagtgctgccaaatgggaagaccgagattcctcctgcttgttactcgttgacatttgaagagaaaaaagccttctgtaaatgtttacaaggggttagagtgcctactgatttcgcatcgaacatcaggaagctagtatcaatgaaggatttgtccatttcgggatacaatgcgcatgactgtcataggttgctaacggtgttcctaccaattgctataagggcagtcaaaccagtccatacaaaggtggttataacaaagttgtgctactttttcaatcgaatttcgcagaaggtatttgatcctttggaattaggtccgcttcagacatttgccgtcgagactgtatgccagcttgagatgtatttcccaccatcatttttagatatgatggagcatttgatcgttcacatcgtccctcaaattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttctttgataatgattacaaaaaggtgtccgcggcacacaatagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcaccgcacaaaacagtgggatccgtgtcgaagcgattgacacgagtggagaaaagaggtcgtattatgggaccattcaagaaatatgggaactggactatggcctaaacatcctgatccccgtgctccgttgtgaatgggttaaagacacaataggggtttctgttgatgactacgggctaacgatagtcgatcacagtaaaacaggccacaaggatgatccatgggttttagcagagcgtgtggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcaatgaagcaaatatgtcgtacgttcaagcagatggtgttgccaaggttattaagtcatagttatttcgtaacctttagttctcattatatttcaaatgtatgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttagaggaaaaaaaatatgagtttttttggtaaaaagatctttctatgcggctggcttaacagcccgcatggaaagatctttttcgcatgcggccggcttaacagcccgcatggaaagatctttttcgcatgcggccggcttaacagcccgcatggaaagatattttttccatgcggtcccttaagccgcccgtatgcgatgatctgcgcctatatatagggagcgcggggagccaaaattttctaagtcccggctcccgcgaaaccctagccgccaggctgccaaaatttcccaagtcgccgtcgccgtcgtccccgccaccgccggctcctccccaaagtcgccccgccccacgccgtcgccgccgccgccgtcaggacctctcccccctcgcctttgccgtcgccgccgccaggacctctcccccctcgccgttgccgtcgccaccgccaggacctctcccccctcgccgtcgccgtcgccgccgccaagtcgccgtcgccaccgcacggaactctcccccctcgccgttgccatcgccgccgccaggtcgtccccgccgccaagtcgtccccgctaccgccggctcctccccgaagtcgccccgcccctcgccgtcgccgacgccactgccaggacctctcccaccccgccgtcgccgtcgccgccgcacggacctctcccccctcgccgttgccatcgcctccgccagttcgtccccgccgtcgctcggtaacatttccttttaaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgtttaaattgggacttatgttaaattgggatttatgtataattgggacttttgttaaattgagatttatgtataattgggacttttgttaaattggcacctatgttaaattgtgacttatgtttaaattgagacttatgttatattgggatttatgtataattgggacttttgttaaattgagatttatgtataattgggacttttgttaaattggcacctatgttaaattgtgacttatgtttaaattgagacttatgttatattgggatttatgtataattgggacttttgttaaattgagatttatgtataattgggacttttgttaaattggcacctatgttaaattgtgacttatgtttaaattgagacttatgttatattaggatttatgtataattgtgattttcgttaaactgagatttatgtataattgggacttttgttaaattggcacctatgtcaaatggagatttatgtttaattgtgactgatgctaaattgggacctatgttaaattgggacttatgtgaaattaagttattgggacttatgtgaaaataagttaaattgtgacctatgttaaattgagatttatgtataattgggacttatgttaaattgagatttatgtataattgggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctccttaaaattccggtagcaataagcagccagacgcttctagtgaagaaacgtggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattgtgtgcagatggtagtccgacgccgctcgaaacgtaaagccgggaggaacaggacagagcaagaagttgagatggacaccgctacgtctgcacctgaacgtacggagacatctacaagtgcagacgggagtgggaaaaaaagacgtggtgagagaagcaagaataaattacccaaggaatcttacaacgtgattgctctcgatcaggatgggaagcccgtcgaaccaccgatagtgcggtccaagttcagcaacgcctgtggcactctagtcaggacgcgttgtcccattaatgtcaagttctgggaaacagtggacgacaacatcaagacacttctctggaatgagttgcagaagtattttgtgttccctcctggatcagaggtcagggggagagattacgcacttaaaaagatgggagatcgatggcgacattggaagtccgatctaaatcgggattatgttcagaagaatctcccaccgtttacggattatggacatatatcgcaggctgactgggacacgtttgttgcggatcatacaacagctgaagcattggctttgaggaaaaaaatgtccgagctcgcgaagaagagcagatatccccatagattggggtcgagcggatacgctggtcacgtcgatcaatggcgggagatcgagcaaagatttgccgtggccggtaagcccctgctggtagaccccatggttgaacgtagcaagaactgggtttgggcgcgcagcacaggtcaagtctcggataagggagacatactattcgagactccagacatagaagaagtgactactaatttgcagcagatagtcgagaaagaaagatcaggacagttcgtcccacggagggagcgagatcagcttactgcggcgttggggacggttgaacactctggacgtgtaaggggtttgtcctcaaagacaagttggaaggtcgggtttccacaagacgcaccaagttataagaagagagacaaatacaaagaacaactatcggacaagatctatacacaagtgaaggaacacttctactcgttggcagctgaaaacccgacagcctttccaaggttattccctgatagccagcaacccacacaatccgcacagcaaacaactaatgtacccagcagtgtaggctcagtgcagacaactatcttccatgtggatagtataactggaccaactccgtgtagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattcaacttctcggtgatgcagtgaatcagtttatcttgtggcaccgcagagacataatcctgagcgcggccgttcttgcagtaggatcttcaaccccatcctcatcgcaggcaatgactgctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccggtcccgcaaccagttcaagcctctcccacctccccagctaaacagcatgctcccccggctccgccctcagttcaaacctctccacctacaccccaatctgctctggtagaacaagtgcacataccagatggtacaacatccgaaccgaagtctaatactttggaactgagtcgtataattccaaagttgatatcgacatacgacccaaaggagattgacaaggataaggagaagttcatgttttcagctttcaggaattctgagaagagaaaagaacttgctcacgtcttgtcagactcccagaagtcagtactagcggcccaagatgaagtgcaatcctggttatctgccgatgtgcctaaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctgaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagagaggactgcgagcaattggttggcaagaccccggaagaaaaggaagaatatgtgaagacattgcacaagaggaagaagctagaagtagcaacatacttggcaatagcaatgttggcgcacgccgataaagatgtcttaatggtcccctaccagttcacgtaagctctctcttctttttgtttaattaatttatcttcttcggaattttctatctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattattgaacagtacatatatactaaatatatctactaagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccattttattttcctttctgtgtgcagatccccgaaatcccatatattgcacaacgattcaacgacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgcaataacatgatgaaaaaactgtgccacttgctattatatatttgtatgtaaattacgattgaattaatggttatgtattacatgtttgttactgcggcacttgtcttatcttatatgctactactccgaaatacgataataaatccctcaataatttaatattaattacgaatcaccaaaatgctagaataaatattattttagctattcggaaattgaatttcgcatgcggtctacttaagacgcccgcatgcgaaaatagatcttcgcatgcggtcttcttaggtcaaccacatgggaaaatatatcttcgcatgcggcttcttatatggaccgcatgtgaagatctattttcgcatgcggccgtcttaagtgaccgcatgcgaagatcgatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgtcatgtgcaatatcatctacaaataagtcatatatatagtatgttcatctctgctaattgatatttaaaatgtaactaataactaaaaacgatgaaaattgaagtttaatcactagtatagaaccggccatcccaatcaggctatccatgacggaggcaagaggcctgtcacaaagaaagtcatgtttgtcgggccgcaaaaagcctcgtcaatgatggcccgagagaggcagaatcttagtcccctagggtagggcccgtcacggatggccatcaaccgtgacggggtgcggttgaagcctgttaaggtcatccatgacgggccgcaataaaggaccgttaccgatgaaggtcatccgtgacggggcctagtgttgaggcccaacaaagatgaagatgaagcccgtcacggatgaactatcgggctttacttgagacccatcacgaatgacccatactataaatacccccctagacttcggagtaacagtagttgcgacccgacacagatgagggaaaattttccgaacaacctcatacgaagacttaccctatatgaaagttgtagatctcgatgagacctataactttaaaattgacaatatttgaattagatcgtttatatgcctaaatatgcattataagtaatgagatatattctgagaaacataattttgaatttttcaaatgatctccgatggaaacatgccctatagcaaagtcaaagggtttgatgagatctacaactttgtaattgacaatattttcaactttgtaatatgttttataagtgatgtgatctatttctaaaatattttttgaatttttcaaacaaacttggatatgagacatgccatacacaaaagttgtgaaactcgatgagatctacaaagtactttgtagtagaaagcattcttatttgaaatcatctaaagtttcaaatttgtgtttcatattaggacgacaatagtcaaaagaataaaatctgaagacctatcaacatgtagttatagttgaaatggtgagattagtttgcttgtgttgagaggtcctaagtttgaatcctactattggcatgaatataaaagtcccttgaaaaatcataaacttctagttggtgacgtgtgagttgtgccatggttggaatgtcctagtaatacaaaaaaaaatatttttaggtctttgtttgcatttaaaattaaaaagttgttcattctcatccatgaaggttcgtaattacaagccattatggatgagtcatctgagacgggtggtaacttaccacccgacaaagatgagtcatccatgtctggctggagaacctatctgtgaagggtttgatttggggcccgacagaggtatatatgtcatccgtgttggaccatggcccgacacagatgatagcttcacatcacttaccaataatcactgaccatgcacattttcgacatagatgagggtattgccccgttatggatgaccggtttcgtagcagtgaatatatctctttgggcactgttagctgtgttccttcatttgatgcaccaatcagttgtatacctccgtggatttagtgacggatcgatgacgtactgtgtctggctgctttctccagcatgtttcagttattgcatttgttttctaaagaatgaattggtgtttcatgcgcttgcatgcatgcacctttaagttgcattgtacgtgcttgatactatgttaatttgtctgtgtcctaatgacgcaccatacatctgtgtgtgagatttagtttgtcaattgatgtatacatatgtgctttgtgttcctacccaccagggcctagaactccacagtgtgagagactgagagcattttgttgcaaaagaatattggagataaactatgtactatgtgctggggggggggaattgacggatggcgactgagtgcttagggtttcaagagagggcgactccagtgggagagtcctcgtcggtcctcccccgccggcgatcgccggagaagggtctgcctagaggatacacccacgcggatatcctcacggtagctgcccgtggtccagttagttctggcgcaaaaatttcgggtgaatttgcacacgaattccggcccgagagacctagcaatggcggtgggagcccgatggctacagtgcagcccagagtcgcgagaggcccagcgagttccacgatgatgaattgcggaaaaaaagtgggtgagattaatttggaggatattttccccaaatttcgccccactgagccgcaaaagtggatctggatcaagcgaggtgaggttcgccctcttctagggttcccggcgagagacgacgagatccggcgttttggcgacggagctcgtcggatttggaaggtgcccgagaagaggtgtgatcaccgcaccttcgcccaggttgtgatggagcgtcgtcctcccaatcgcctggattggcaagccaacaagcgacgagcgacagagcaaggcggcggcgattggggtgcacgaggcggaggtgactggggggcgtgcggagctcgcgaggaggaggaactgcatcggcaactccttgctcaaaaccctagggcgaatcaaggtgctcaatggaaacctcaagggctccctggtaccgatggagagaggggggcaagagctcctaagatcaagtgcttcaagtgtggtcgtgagggccatcaccaggcggcgcgccctaacccttccctctgctactcgtgccatagctcaggtcatatttcttcccaatgccccttgatgatgagaaagggtgttaaactttgtggttttggcattccgggacaggggttctatagtttgaatgttgagttgtctgatatgagattgctaaagcccctgtgagaggtattttgactgtgcttttgggatctggatctgttgcaaaagtcattgctgaattgaaacacctgtttgtgggtcttaattgggattggcgtgtgaaacaacttaatgagaaagagtttttaatcaacttcccatctgatgaagtgagaagtaaaatttcaacatgtaagagttttgatttcgaaacatctgtgatcaaagcaagtgtagttgagactggtatgactgaggaggctgtagatgagctggtagcagtttgggtcaaggtgtttggaataccaaaaagtttgctaggactgaagaatctgtgaaagctattgtggagctagttggggagtttgaagctattgatggggctagcttaagaagggatggtcctataagagagttgcttgcagggatcctagagaacttcacttctccatccacctgtatatcagcaaagttggttatatggtgagatgggaacctgaaggata

SEQ ID NO: 60719 - DNA, 1685 bp, Oryza sativa
  unsure (1)..(1685): unsure at all n locations
ctaatgccataatgattaaaaaaaggactacttttaaaaccttactgggactactattttttatatgatacaattttggacatacataaaagtaattttatctaactcccaacacaacatcaagccacaaaaggacatgaatatggactgcaattcgaattgaagattgtgctagtcaattacccagtccagtagcatgacgtcatcatcattggctagacgagcaaggtcaaaggcacgttgtcctgtaataagctccaaaagcataatcccataaccaaatacatcagttttctcagagataattccagttgaaagatattctggtgcgatatgcccaattgttccacgtactgcatttgttcatcggtatccatgtgatccattagtttggccaaaccaaaaccccccactaaggcttcaaagtcttcatctaatgaaatatttgcagctttgacatcacgatggataatctttgggtcacaatgatcatgtaaataggacagtcccctggcggaacccaatgcaatcctcctccttgttcgccaatcaagtggaggttcatatggcggccgttctataatataaaacccaaatcaaccctctaattatctgaaagatacagggatgtcagactagaaaaaaaaaaggcaacgtaactctaagacgtgatgcaacggttccattagacatgtatggatagacaaggaacctttttgttggcgttatgcagaatccatgaagacgcatcaggtttctatgcacaggcatctcaacttgtgtttgaaagtgccatgttctccaatcaatgtttgggataacccatgcttaaagcccggcttatataatcctctttaacagctactactgagccatctcctaatcttcctttgtacatgctgccgtcgaatcgaccacgttgaagaacattgctatcgctaaagcaatttgttgcatcttctatttcccgtagtgaaaaaatnttatgctggcgaggataggcctcatctggaccctgaccctcaaactcttgacttgtctcaccctgttacacatggcacaaaaagaaaatgaaatgtgaggatgattattattgagaaaacagatagcggaacttcgcttccagtaatcccttcttggcagctactgattgctttgtatgatccaatctcacattttttacttattaaaagcatcaggtgaggtacgtcctgcaaatgttggaaggaaacaggcacagagccacagctcaagaaagagagcgacaagccaggagcgaattaattgtccaattaaacgataagatattgcacttttgcagcatccaagaaacaaatagtaataataacaataataggatttgaaactaagacgatgaattaacaatcaatgtctccaggtctggtcaagaacttaccaataaacaacttccatgatcatactctaaatggaatctgctagttggatgattgggaagcttctcgatggcagctttgattaggctaacaacagacctggtgatgctattgttcatatcttgttctggatcataaataccatcagagcaaatgttgccccaaataccgatcttgactttggtaagggcggagaggtgctggatgccgaaatcagaagcaccattcaggcaatccattccatgtaaacggaattccacttggaagtta

SEQ ID NO: 60720 - DNA, 874 bp, Oryza sativa
gcaacttgcaaataactgaacaaaattaactgtttatcctaggctgtagctacaggtccatcacctaatgaactatgaaatcatgtgggtatgatcgatgaatataattgtaacaaaaaaatggcatcatttttaacacgatgatggtgtttagttttgaagttatggagtgtatttctttcgtgcaatagcgcgtgtgcttgcgtcgactaacatgagtcaggtcataagaaatcttggtatggtagtctattgatttgtaggaagcttggaataaatcttagtcaatagtgaggacttggactaccactaagggaagagctgaaagacacatggtagattgacattggcatcgtttgattgacatcgtgtagaaggattgatgtgacatgtgactcattagtgttatgttgctcgaaattatggtagcagaattatggacttacaagaatgttgaccttgccgtcgaacaaagtacgtaccttgccggcaatctcctctttgtcggtgcgcaccaacacgttgcagacggagacgatgatagtgaggcttttgatcatccactcctcatggtatatactcagctccgcgtcaattggtgcaggcgtgcattgttgcgccgaagcccacgagctcctccacgatgaagcggctgcacgcgtggttgattctataatggacaatttggtagatagatgttatgtagcgtgttggtgaataaccacttaggggctgttcagattgatgccattttcacccataccattttttgacaaagttgccaaaaaatgtctacgtttagtttgttgccaaatttgataaatacaaaagaaatcctgccaaaattttggcattgccaaaatttagtaaggtt

SEQ ID NO: 60721 - DNA, 40901 bp, Oryza sativa
  unsure (1)..(40901): unsure at all n locations
tgtcctcctcccccgtcgtcatcggaggcagcgagtgcgcacacgcgcggcgagctgcaagcgccgccgtcctcctcccaccgtcgacgccgccctagtgccctacacatcgtcgcctcctctccctctgatgtgtcgtctccgccgccacccgcctccacctcgtcgccctattgtcctcctcctcagcgccgcccattgcagtccacccccgcgcgctcgccgcccgccgccggcgagcaccagctcggccttctccccggcgcttccctctcccttcctctctatccatagcaagggtattgcagtcttaaaactcctcaaagtggcaaaataacctaaagataacctattgagtggcattttatccttgctattctaatgggtggcattttgttgaaaccacacgaaaagagtggcatattgtactttttctctttaacgtactcctatatcaaaatttaaaaggctatacttatattaagagtaaaaactacatatatttatccaaattatcataaagctatatatttaacatggtgtatcataaaactacagatttaacactaaatttatcacaaaactatgaatttaaagtggaatatcataaaactacatatttaataaaaaattatcacagaataacaaaacttgacatttataacccaaacataaaattagtgctaaggatttaaaccctaaaatcttaattttgcgataattttattgttaaatatacgacgaatatgatgatttgaactgatgataaatcattcatacgattgaaaaataattttctccattaaattagggtacagtcacttgcaacttgttcattatagttgattgattgaattaaggcctggttcagttcccaaattttttttcccaaaaacatcatatcgaatctttggatacatgcaaagagtattaaataaactaattgcacagtttgtatggaaatcgcgagatgaatcttttgagcataattagtccatgatttgcctatatgtgttaatgacggcttagttaggctcaaaagattcgtctcgcggtttccaggcgagttataaaattaatttttttattcgtgtccaaaaacctcttctaatatccggtcaaacatccgatgcgagttccaaaatttttcttttcgcgaacttaaacagggtctaagtcccacgcttgagttatgtctaacattgcgggagatgtgtctgacatcccgttagttgaagtatccttttgcagtttactttgattactggagtagtacattctaccttttgaggggtatatgggtcttctggtcaccaccttaatttttgttaaagtgacaatgatcccttatattaggtccctcggtcaaaaaaaaaaaaaacacaacatagaaggtagtaatgtgatatcttctaattgaacaaatctggacaactaggagggtcctcctaggttgcttttttacatggagtgagtatatatttagactagaaaaaaatacccgtgcgttgcaacggataaatgctattttaatcttattattattatatgttttaaaatctactatgagaactcgtttggatcatttatttagaaaatcatgagccgtaattaggagtccgatcattttaaattagcatgcgagttttttaaagagattttttatatgattcctcctatatttctaaaagcgaacgaatttaaaaaccgactcaaatacggatttatattttcaaaaggaacaaacttaaaaactgactcatacacggatgatgtaccaagtactagcaaaaatatcttcaatatttataatagtagagattggtgtaatatgccgagagagtaggttaaaccgttcaaggacaaaacgaaaattatgttgcaacgagaaataaaaattccaattcatgcctaatttttcagttctcaattaatgcataccaatcccgccatagatgcagaagactgctgactactgtacgtttttgggaacgttctgcccgtattttgcctgaaaatctcgctctctatttactcacaaatactctctccgtactcgtaaagtaagtcgtttaggacagcgacacggtctctaaaacacaacttttactttttgtttctataaaaatatttattgaaaagtgatatatgtatatttttatgaaagtatttttcaagacaaatctattaatataatttttacattttcaaactcaataacttgagagttattgatgatttatattctcaaggtttgacttaaacaatatcctaaacgactttttttataagtacggagggaatatttgacatgggtagaataagattcagccaaacgttttaaaatctttgacaatcaaatttatactagagtaggctcataaaatctaattaagtccaaaatacttttcaggaaaaatctatgaagataattattaaaataaatatctaaaacgctatttatggtgaaagtttcgaaagtttaatcaaatgttgtcatatttataactagaggagcatttcgaagtaactgttcgttgcttagtgtgatcataaactaagaaaacacaatctaagacaaataaaaagaacaaataccatagatatgcggaaagtacgcatactcaaagacaaggttttcaatgctttatttgatcgaagcattagagagaactgcctcatctttccacttacgagcataagctaaaatttaaattttaaaacttaattttagaattaataatatgggttttcactgtattttattaacgtgtatataaaagttttacttgtaaattattattagtaatctgtaaattatttttaattactaataagacatacaaataagtatatgcataagcagcataaggcaaataatgagcttgcaaatctggcgaatttttctgaagtgtgaacatggatgcttctgctatcatttaggttgcgttcgatttagaagctaaatggttagcttttctcagcatacttgcatataattaattaactactaactattataaaattgagaaatagatttgtttaattttttaaagaaacttatataaatatgtacaaaatatatcgtttaatacttcgggaagtgtgctaaagaaaaacgagatagttgctggatacaatgagacttgctactacgggggtgtttatatccaggggtgtaaggttttaacgtgccacattgggtattatttagggtgttgcatgaggtgttcgggtactaataaaaaaactaattacaaaatctgtcagtaaatcgcgaaacaaatttattaagcctgattaatccgtcattagtaaatgtttgctgtagcaccacattgtcaaaatatggagcaattaggcttaaaagattcgtctcacaaattagtcgcaatctatgcaattagttattttttagcctatatttaatactttatgcaagtgtttaaacgttcgatgtgatagggtgaaaaatcttggggtgtgatctaaacatggcctacgtactccattcgttttatattgtaagtcgctttgactttagttctagtcaaatgtttttaagtttacccaaacatataaaagtttttaacacaaaataaatatactattaaaatatattcaatattctatttaatgaaactaatttgatgtggcaaatattgttaaaaattttcaaaaaattggtcagaccttaaaaagtttgattaaaaaaattaaaacgccttataatatgaaacgaattaagtgctactccaaccatttcgcgttacaagtagatttgactgttttaaaagcaaacttttttaaagtttgaacaaatttataaagaaaaagtgtaacaacacttatagcgctaaattagttttgttacattggacattgaatattgttgattgtttttgtttaatttttttaaatatgctatattgttttataaagaagtttatcaaatctaaagaagtttgacttaaaaaagttaaaatgacttataatatgaaaggaatgtagttgcattttagttgaactcaacttttaaaagtagttgagttttaaattttaaagtagttgtattttagtacttctataaattttaaacgtagctgcattttagtacttcctccgtcccataaaaacctaatataaggcctcgtttagttggggaaaatttttcagtttggttgtcacatcggatatatggacacacatttaaagtattaaacatagtttaataacaaaacaaattatagatcccatcaggaaactgcgagacgaatttattaagcctaattaatccatcattaccaaatgtttcctgtagcaccacactttcaaatcatggcgcaattaggcttaaaagattcatctcgtaatttacacgtaatctgtgtaattgttttttttctatatttaatatttcatacatgtgtgaaatattcaaaatattcaatgtgatatgtgaaaatttttgttttggaactaaacaggagtgagtgggaatgtgacaccagagcgtatccggataaatgtatatgcgcatatggtttttttttatgagtgaatacaagcttgcctaccatttgtcacagccggatccgtggcgcaatggtagcgcgtctgactccagatcagaaggttgcgtgttcgattcacgtcgggttcaaacccccgaaccatatccgggtttatttttctttttttcaattttttttaccttttcccagttttcattttggcgcgagcctttcccgccaaaagaagccccctcttccgcgctactgccctaatcccgccgccgcagccgcagccgcagccgccgcctcattccccgccgtcggagatcgccaccccgaaccacccgcgccgccgccgtggttagcgcgacaatggctgcgccgcccggtgaggctccgctcaccgccgccaccaacatcgaggtgcgtttccatctctctctctctctctctcaggcggttgctgcccctctcgccggccggcgggcgccgctgctgctctgggattaacttccgttctccttgcagccgttctatgtcctccacaagggcggcgccgctgcctcgtcgtcctcctcgtcggctccctcgctgccgtcgtccggccgggcgcgccgccggatcgacgtttccgggctggcatctcccaaccccaaacccgggaagagatcccgcgacgacgacgccgctgaggacgacgacgacgacgagctgtacgagcggctccgcctcgacgccttccaccgcgtttggtccaagatccagtccaccatcaatgtgcaaactcaattcccccatattccatcgattcgtttactactcactcgcttaattcctcagcaattgcagaatctgacgagtgcgatttctcatcttgggattgatccaattttcgattgctcgtgtgggcaggaggttcttcgggggatcagcctcaagctgttcgaccaggtgctgcgatgggtgcaggaatccttctccgcagtccgctccattgcgagaccttccgcagccgaggtgcggcagccataccctctcctcaccgatgtgatctgcaggaagataccgacggcttttgttctcaccagtgagaatccgccatcaatttgttcagctggttggtaggtgtggcgaagaattgctcggtttgatggtttgggcttcttaattttgcagagaatgcggagttcgttgacgacatcacgacattccgggatcttgcagagtatcttgagtccaatggatgtcacctggccaagctgtcggcgactgaattatcggaaaaaaatggagttggttgttgcttcaggagcttgttgaggcagctactttcagatgttccagatgtgagtgacatggcctgctctcaagtcttttttagctgtactttacttgagagtttgagactggagtgcatagccttacttgttgtctgttctggttttgtcactcgaataggtagcggatatatttgcacttgcatcttggtactctgcagctgagaactatgatcagcctatagtcgtcgtaattgatgatttagagcaatgctctggtgatgtcctgggagagcttgtgatgatgctaaggtaaaatttatgtttcatagcattcaatgggtttaaacaactgcggttacatcaaacatgaagtacataaaagttgttttgaccacggttctataccttaatatggttgcttaacatatagcccctccgttctgaaatatttcttgttgtttagttcattttttaactagccaacgtcatacaaaaagaaacacagggagtatttgtttttatcttctctctctctctctagaaagagaggaaggatcctctcccatttctattatcagaagcaaaacagtgaccacaccatccagattacaagattaaggctaaaacagaccccaccttttagccctggatagcgtgatcccactattttcagctaaaaagtttcaagatgctaaaattttgaacgcaatcatgaagctaaactagagagcaactgctacattttcagattacagttcctaaatcacacataacaactcggtttcataaaccctccccggtttttgagccaaaacacagcattttactttcataagcatccatgtcttctgtcttgccatcatgacacttccccttctatcccccttctagtcttctacttcagccttcttgtcatgcttcattataactgatgatagcataaaagcataccaatttgttgtatgatatttttttctctgttttggtgtggaactcaccaatcccttgtttaatcctcttttagaagatattcttcttacaattaagaaaatgaacctggttttatctttcatttatatccttagtttcacctaataaaatttatagtcttgggtatgattttaacctgaatattctatctgttgcagcgagtgggtgattaaaattcccatcttctttgtgatggggattgcaaccacccttgacgcaccaaggaaactactctcatcagaagatcttcaaagattagagccgtgcaagctgaccttggggtctccttctgatagaatgaacgcacttgttgaggctatccttgtcaaaccatgtgctggattctgtatcagtcatgaagttgcagttttccttagaaattactttttcaagcatgatgggaccataacatcttttattagtgctctcaaggttggttcttcatgttaatcttaatctcttttcactgatgttaacaagttgttatttatgtttttccccttatttttgatggatgctagtactaaatcaaattttatgcagcttgcttgtagtaagcacttctctgtcgaacctctgagcttcttgtgcatgggaatgcttgaagaggatcgtgaggtctgttttattttcttccaaacataattcaatgttagctaattatgttcttctatcactaactggaaaataaatatttttaagtttccatatctttcggtacaaactaatatcttgtattgacatggatttatttctttctgtcttatcccacagaacttctggcatgataagtttaatgcactaccccaagaattgcggaaatatgcatctggtctcccgtcatgcacaaggtacaatactgactttaaagattttcaccagtaatatactttgtctaaaaatttccattgcagggaaaaggactcaaccaagtctggcgacaatatggttgacgggttgtctgagcttatgaatattcaaaaagattggagttcagttctcttggtaagttttctttgttctccagaactttcttatgtttctagaaaacagagttgcccagctattttttttctttaagactcagattttcaagttcatttgtctattgaccttgtgatgtctaaataaaagctaacgaaatgtggtttactcgtgatctaaacttgatgggtaccaacaaatgtgttaccatttgcaattagagacagtggaattctggattatcacttcctttgtacttatgaatacttggataatatcatgcaagcctttttttctgcttaagttatagagccataccatcgaataatgtatttcgtatgttgtgattatgcagtgcttgtatgaagctggaaaacatggtaaagtgcaacttttggatattttctgtgaggctgtaaaccctgacctgcacactcagaaggcacccaatctaccaaatgagaagtcaggaactagtagaagatttatagatcaggtgatggatacaataaggtatgttgatgggagttggtttcaggtttttggatgcgaagcttctgattcattgctctagattatctagcggcatttagtagggtattgttgattaatatccattgtagcttataattactatgggagcaaaggggaatttgggattgtaaaattttgggggcagcgacataatagtaccgactgatggaggtggaccctttactgtaatgcttagctcctcttgatgagtgtgttttattggatcaggtaccttccagtggaaacactattttgtcttctagaagtttggagcatccatctaaacgggatggataaggtatgcttattgctaatttttgtagaaaactttttggatatgctatgaactgccataccatatgggttcaagtttcagatggccactttacttggttgctgtctgcaatctttattcaaaacattctgaagggagataattgcttttggtcatttgatgttcgaagtaataccttttgtgtcgagatggcttgagcatttgtcacagtttttgttttgaccaagtcagataactcattcctagtttttaccagttgaaggcttctggcatagagcctagtgtactaaatgtactttttaaaactgtggtgtgactctagttgagaatgtgttcattctaatcccagataacaaacaaggtgaaagagcttcagtccaccacaatcagtacagacagtgtgaggatcacaaaggataagtggcctaggtacttcctgctttattccatatttcatttaaaaattttattagccaaacaaatattaagaatgccaaaacaagttgcaatagcataatgaggttgagtatctctagtggacgaatctgtactgcatttttcagtttcgattatctgaaactggctgaaaatcattttcatggcatatcaggagatcaacaaatagtactggaaatagtacagtagcactgaatgataaagtggctatgctgttggatgatgttaccaggtaaatgttattataagattgaatcaactaagtactattttaatcttatataacttactagatctatttattcagatgattagtacaattgaactgggattatctttctctattttgtttgcttttcaataacttaaagttctttcagcatctaatgcctagatatttcaaacaggaaatttctggtctctgttgagtgtttaccttttcatgaaatcgtctgtttcaagaatgttagcattcttcaatctgtaagtttttcctttacagaaagaaagccggtaccattatgtactacttacttacataataatctataactatcaaattaactgttttaaattctatcacatctcattgtaggctttaattggaaatccgagaagaatggtccagcttgatctagtcaagtcacacaaacatcttaaatgctcttgctgcaggaagaatggaattgctgtgttggcatccatgcatgatacatcaattatgtaagtcctggaaagtattcttattgagcggcgcatctggtggaaatagccatatggtgaaaacttaatcaattggcatactaagttctaatgtttggaatctaaagctcaaaataacagacgtcattctgttgacatagcatgccatgttaaccatcctttatcctgatgtgatcattaaacccattttttaatgtatttttatgctgacacgtattatcctttttaatcttgcaggtgcaatctagcccaagaatatggtgatgtaatcaaccttcatgactggtacatatctttcgatggcattatcaatagcgtgcattcaaaaatcaaaaggaaaccgcacacatctccctcgaaaaagaaatcaaaacccgttgctgcggagagtgaagccatgatccagtatccttgaactaacctttttattacaatttaatatactaaacgtccacaaatatatttgtacagatactagggcagcatttcttgtaatcattaaatccaggtaatccttgactcattggttccagagcaaggttttgcagagctgtcaccgagctacagatcaccggacttcttcggatgccgagcaagagaaggccagatcttgtgcagagaatcgcattcggcctttgagaccttcaacgctagtttaccaactgcaaaccagtgtttttcagacttgtgatgctcacagcttttgcacatggcggttgctgatgaatgatgatggcatgtgagtttatatgatgttatcgtgcaaatggaggaaatatggattattcagaaaccccaacgacggctggaaacttgatattcggttgacaaaatgaagcagctaccgttgcccatttggaatttatgactgcttgtttgcactgcatactggatattgtcttttattcttgcagtcagtagcattagttctcggctttgttctctgtacatctgatgcagcctaactcatcaagcttgtaatttttgtaattcgagtatgtgaattctgacgcactaacaatccatacgagtgcccttcaattttcgtaaaattgatctcgatatactggtagtaatcagcgtttcaaaagtttagacaaatggttaactaacttgcatggcatcaataacagcaagtcagcaacagcatgaaagctgcaaagcttcatttcagtggagcaattgccaatcatcactacttacaacaattagcaaccatccacagatcgaaaaactaccgttagcatagactatgaacccctttgtctatgtcccataaatggattattcgtacttctaactcgactgacgcggagaggcaattcatcttgtccaaaatgcaatcatatgctcgagcaattcagaatgaacagtagatctcgattagttacgcatgcatagtaaagtacaattaccaatggtctgaacagaactaaaaacatgcagccataataaatatgaacattatctaaaaaaataaatatgaacattgacttacaaaaaaggagtaaatttgaagacataattctatagttaggaaaactgaaaattccaacggttttcgaacacagtggcctaattatcgaatggatcatctccgacacctccatctgcaccatcgccgtcgccgtccccaccgccgtcgatcaacatcggcgccgccgccacctcgttgaagctaacaatggtgtcgtcctcaaatttaaacacgaattcaccatccattatttgggatatcatttcggctactcgttcggaatcaaactccgcggcgcctagctctagctgtgcgtcgccgtccgcgccatccgtcagctcctgcggctgatgatgctcgtgctgcgcctggacgccgccgccgtagtcggcgagctccgggtggtcgtagttgccgccggcgtcggccggtggtggcgccgccggcgagttcttcggcggcgccattggctctggtgggatcgccgcgctgggcaacaggtgttccaacgtattacacgacgcaggatccgccatcccgaggtagccgtcgtgctgcaccggcccgccgatcgatgacggccaccacgccgtcggcgagctcggcagcgccgcgcagctgatcgtgctaggagacggcggcgccgcggcaccgtacgcgacctcgtactcgtcgtaccagtcctgcgggagctccgacgacggtgctgacgcctgtgacgtcgaggccatgttcgcctggtccgccatggacgtcatctctccagccaagcccggcagagcgacatcgccgccgacgacccgggcaggccaggcagctgcagtggcagtgccagcggcatcgtcgacgacgacccagccaggcctggcaattgcggtggcagtagcgacgttgccgacgatgatccggccatgttcagcaatggccgtggcggtggcgtaggcggtggcagtgcctccggcgtggagggcttgtccgtgctcgacgccgcggcggcagcgttcaccggctctgtgtcctccttccttctgatcttgtacaggcggtacacggcaaggtcctcaagcttgtccaaaatccacaaaattaatttatcaagccaaattagcacaaattgaattcgatcaatccgcttgatcatgaatactccctccattttatacgttttatattataagtcattttaatttttttctaatttaaacttttttcagtttaatgtttgactaaataaatttatagaaaaaatatggtagtatttcaaaaatatatatattatcaaaatatatttaatgttagatttaatgaaactagtttgatgttttagatgttattatatttgtctataaacttgaagtttaactatgaaaaagtcaaatcgacttataatatgtaatggaggccgtataatggaatgttaattacaagacaaaacacaatatttagacggagttgctagaaatatagtcgatttttttcagccacttacacagtagttacacctcatttacaccccacttacatatgcaattagtatgtaattttcgaatttacatatgtaattttagtacttacatatgtaattttgagacttacattgtaaatacactaaaattacatatgtaatttatgaacttacaatataaatacatgccgactatttttttataaaaagtatgacgccataaatatagctacaccctatttagatatagatcgtaatgtaatgtatttgcggactgatttgaatttaaatataaattaccaagtactacctggtttttggagctaggaatgatcttggtgtactcgtgcatggcccagttggtcttgacagggttttggtcgccctcgaacctacgctcgtagaacaccatggtgagcttctgaccaacatcgatgccgccaaccttcttgctcctcaccgtcttgctcccaccagatgccttccacgtcccaccgtttgccaccctcatcggctgcctcttgttcctagccttcgctgcgaatagcctcctgctaaagaagtagatgcatctgtcctccatgttctcgatatacgtctctgcacacgccatcgccggagaagaagaagacaatgatgaacatggttttaaatcctcagttatagctgctgctattcttcggttataaatgttaaaagaagggtccaactatttgcttttatgtataatttaactgtaataactccatttaacccactataggtattgctgtttgagaaacccaaccgctaaatgtcttatcccactatttaaaatactaatgacgaaggaaacaacaagagaggggtagagtgacggtggcggcgaagcgggcgtaccacggaggagggcggggtggaattcaagtatcctgatatgctcaaagacgttattgagggcgccggggacctcacctcggacgagcttgcacatgaggatggcgaaaagctctaggtccatggggacgaagtagaaaccgacaggcatgccgtgccggttcttgccgtactccggcaccaccttctccttccccttcaacttcccattgttgttgttgcttccaccgctgccgccgccgtccccatccgccggctgctcgcgcgtggtgtgacgaggactgcgtatttgaggggtggcgcgagatgttctcttctttttgtgggagtgaggcggtcatttgattcgaattcaatttaggggaacgtttttgatttttttttaatccaatacatgaactcgccgccatcgggcatcgggttgcggacaacggcgtaagccatggagattgggctgacgttggcagatcatcacgaaggtgagactgacggtgggctcgccgccgccgccgccgccgccgcagccgccacgggcggagggagagaagggcgggtggaccttgcggtggtggtgattcatggggaccgcggcggctcggtcgcgcgcgacgccgctcctggttccatggcgatggcggtggtggaggcaggccggcgggtagagagccgccgctcgccaacggcgaaggggactatatagggcgtgtgggtagagagttttcttctttcttttttttttcctttttctttctttctttcgtttcttctttttaatggccagacacgtgggcctgatgggccttgaatttgggcctatgctaaccaggagttccaaaaaaaaaaatccaaatttgaataaaattcggatttacacgttattatttagaacaataatgtaaatcattattgttaagataagtgggaaaacaagtgttcctgcttctagtccgaacaggctgcatgcaacccaatcgaattttcggttagtggatccatgccattattgctttacccatttcgaaaaatgtcattactattaaacgacctgtatcattacaattcgagagctattttgagatatgctagtacttacccgtttggtgcattcattaaatttctgcgttaattggatccatgtcattacaaatctgtcattttggatgaatgacactactattctcatcgattcgtatatgtcattcaaattcacacaaaatttaagctgctcttggatttcattatttagttgcaaatgtctccagcaatggcccttttaattgttgtcaatgatttttttttatttcacgcaattattgtgacacttgggttgctgaagttagttacataaattgtccagctctgattgtaaactgtcctttggcacttgtaccacactccattttcttgcagacgcatactaaaggaatattctttgttgcagtggtagtggctcatcagcacggtcattgatgatatctcttggtctgaaggatcattcccaggtattatttgaacttaccttcatatatgactgtaattctccatgtttttctcctgaatcttgccaaatcagcaagcatggtcgattgtactgtgcatattagtgtgttctgaggttagaccccgttattttgcattggaatcaatagtattctcgtgtatgtatatgaaacaattttgttacttctgcaggcaacaatgaaatatattgtttccaccataattgagaaccgcctatggtaatactacctccatcccaaaatgtttgacgccgttgacttttttaaaaatgtttgaccgttcgtcttattcaaaaaatttaagtaattgttaattctttttctatcatttgatttattgttaaatatatttttatgtatacatatagttttacacatatcacaaaagtttttgaataaaacgaacagttaaacatgtttaaaaaaagtcaacggtgtcaaacatttaggaaaggagggagtagtttaatttgcataccgagctggggttggaatggctgggcacatgtctattcacttcatcaacagagatgttgacatgattagtgctgagcaattaacactctcttaccaatctagaatttcgtaactatgatttcttcggagtcgatgtatgacaaactagttatataaccaaagttatagcgagaattgcactactagctttgatgagtattccatctacgaacttctgaatgctaatggttgtattatgttgctttgctaatttgtggcctaaaattggtgaaagcaaagcacttttcaggggcatatttattcggaatttcaaggtcgcttcttttttgatggaattttgttaataatctataccctctctagagcaacacataacttgtactgttgtggtgcagaggccaggagtatcctaagaacaatgtattgactgataagaaagcccgttgttggctgcaatataataggtgaacacgtcacttgtagttagcgttataactaaggtatacaatagagatatcctatgcttaatgtaacataaatattctattgtttttatgggcccacatcttctcctcttctctttctttttcccaaccttgcgcggatgcaggcaacggacatgggcggacacggacaatggcgagggcggcggctgcggcggacacaggtgatggcgtgtatgtcactacggtggatgcagacgaaggtggcggccgctgtggacaagggcaagggcgacgacgacggctgcggtggacgaggacgacgaacacgggtgtggacggtgggacggacgtgggcctccgccgcggaggacgaggacagtgggatggaagcgagcaacggcaacggatacgagcgaggatggcaggacggatgtgagggacaaggacgtcgaccacaggcgaggatggccggacggccgcggacgacaacggcggtcgtagtggatgaggacaacgaccgtggcggacacgggtgtggatgtgggatgaatgtaccctgccgtgcggaggatgaggacggcgggacgaatgcaagcaatggttgtggacgcgaaggacgaggatggcgactgcaggcgagggtggtgggatggccgcgggcaacgtcggtagcaaccaaggacgagaacgaccgcggaagatggtgatggcggacgaggatgaggacggtggccgccacggccgtggatgagggtggtgggacgatggcggccacggaagatggcgacgatggtgacgcagaaagacgcgcagaggaacgagaactggtagcgatggtagcattacgggcccacacctcgggtcgcgcgtgtagccaggtggttaattagtcgcctgcccattctctcttttcctctcatttttccagctcaacaaaaaatcctatgtggacctcctaccgccctttattgtacatgttcttagtgaaatagtaaaattaccaaaggtctatacgaaactaaaaacatggagcaaatagtaaatatgaacattaacttacaaaatcgagtaaaatttgaagacaaagaatttatagccagggaaacttgaaattccagcggttttcgaacgagggccctaattgtcgaatgggtcgtctccatcacatccctctgcaccatcgcaccgctgtcgatcatcatcggcgccgccaccacctcgtcgtcgtcaggaaagacttcgttgtacttaaggacggtgttatcctcgaatttgaacttttaccatttcggcgattcgttcggtgtcaaactccgtgccgcccagctgtgtgtcgttgctgtcggccatggcgccgtagccgtcctcgccatccaccagcaatgccggctgcggctcctgcggatgatgctgattctcgtgctgcgcctggatgccgccgttgtagccggcggcgtcatgcggaggcgagagccggtggtggtggtcgacggctggtggtggcgccggcgagctcttcttcggcgtcatcggttccggcgggatcgccgcggtgggcaacaggtgttctagcatgtaccacgttggatccgccgccatcctgaggtagccgtcgtgctgcaccagcccgccgttcggtgacggccaccaccccatcggcgagctctgcggcgcctcccagctgatcgtgctaggagacggcggcgtcacggcgccgtacgtgatctcgaactcgtcgtaccagtcttgcaggagctccgacgacggtgtggacgcctgcgacgtcgaggccatgttcgcctggtccgccatggacatcatctctccagccaggcccggcaatcgccgacgacgacccggccatgcccggcagctgcagtacaggcagcgacatcgccgacgacgatccggccaagcccagcaattgcagtggcagtagcggcgttgctgacgactgtccggccatgtccggcaattgcagtggcagtagcggcgttgctgacgacggtccggccatgtccggcaatggccgcggtggcgtaggaggtggcagtgccgacgacgtggagggctcgtcgacgccgcggaggcagcgttcaccgattctcttcgtcctccttccttttatcttctacaagtggtacacggcaaggtcctcaagcttggcaaaatccacagaaattgatcagcccaaattagcacaaattgtatccaaaattcaaactcaaacaacaaaatcgatcaatccacttgagcatcaatcagttaattacaagacgaacaaaacacaatgtttaaatatactctctctattttatattatatacaagttgatcttgactttttctttttgtaagtataactttataagtttaaccaaaacataacaataattaacattaaacaagcatattatcaatatatatccaatgtttatatttaatgaaactgattttatattgtagaagttgttaatttttataaattttattaaacttagagagtttaacttgaaaaaaaaatgtccaaatgacttataatataaaatggtgaaagtagattgcaacgtaatgcagattgatttaaatttaaatttcaattaaattaacaaggactacctggtttttggtttttggagtcatcaatgatcttggtgaactcgtgcatgccccaattggtcttgatggggttccggtcaccctcgaacctgcgctcgtagaacatcatggtgagcttctggccgatgtcgatgccgccgaccttcttgctcctcaccgtcttgctcccactagacgccttccacgtcccgcccttcgccacctgtgtcggccgcctcttgttccctgccttcgtcgcgaactgccacctgttgaagaagtagatgtacccatcctcctctttcccgatgtacgtctctacacatgtcatcaccggagaagaagaagaggaggaggaggacggtgattgatgaaggggacagaaagagagaggtagagagggggcggcgaagcgggcataccatggaggagggcggggtggaattcgaggatcctgatatgctcgaagacgttgttgagggcaccggggagctggccgcatacgagcttgcacctgaggatggcgaagagctccagggtccttggggacgaagtagcagccgacaagcatgccgtgccggttcttgccgtgcttgggcaccaccttctccttccccttccacttcccattgttgttgccaccgccgtcgccgccgccttccggtggctgttctgcaatggcgggcgagttagttggttagagttgtagtcaaccaggaggagagaggattaattagtcggtgagatagagagagagctagccgagtcgtgatcagtcgcggtggcggcgctcgcgcgcggcgtggcatgggctgcatatttgaggggagggcgtgaggcgactgtttggttcgaattcaatttgggggaaatcgaaggggagtaagagtaggaatacgatgtaaaacatgatgtgagagaccggctgctatttccaattgtggcagccaggcggacatactatttggtgtataatgttttgcacgtatgtcaatactaatactccctctttttttttttaaaaaaaaactctcccttgacgccgtccgcgcgcgttgatctcctccacttccacttccgattcccacacacgttctccggtcgctcgtacgctttcctttcgagagcatatgcgtgcagcatcccgtttctttatctgtttgttacagtattgctttggcgctcgatcgattcgctcccgatcttcccaacgtcggcacctccgatccgcctcgatctcattctcagttaatttctcacgcgccagcagccagcagggcgccaatcaagtaaccggcgactcatccctcctctcctcatcagaccgatccatgaatcacaaaattcagattttagccaatgttctagcgctgctagttttgaagttcatctatgagcttgtgactgctaatggttgtacttatgttacgttgctataatttgttgcctgaaattgttgacagcaaatcacttttcaggaccatatctgtgttcgcaagtcagcgatcccaaccggaacagtgcgcacgaaaaacggagaggcaattagcgcgtgattaattaagtgttagctatttttttttcaaaaatagattaatatgattttttaagcaactttcgtatagaaactttttttaaaaaacacaccgtttagtagtttaaaaagcgtgcgcgcgaaaaacgagatggggaagttgggaacaggggtcacttcttttttaattgaatattttttagtaggaaaaagtacgaagtaccccacgaactattgtggtcgaccgaattacccggttgttgacagaaaacacgaggcctgggagatctgcttaactccagtgcaggtccaaagctcgcattcgaatgtatgagtgtgccagttgatttgatcctgtaatcaacaagaaatagaagcaaagaaaccgcagttaaatctataaatgatagccgatcggctaggtaccgatgacacatcatttatctttgagccgatgtcatatgaatcaatcggcgattataaataaatagtaaggaactaaatctattcgatcggctgtagatattaacgatatatagttcttatattaatatatacttaaatcaagtgattgggataggtcggtcatcgtgccgagacagtataaatcacttagatcgaaatatatattaataacaggattatatatgtctatagcataaccgatcagatagatctagcgtgtatcggctaatactccgatactactctacatcaagatattaaaataggtataatgtattaaacagaagcttaatatatttagattgcgacgatatcttgacacagagggcggatttaacatgtcagtgaaacatatagagcgaatatggttaaatcagataagattggctgaaactccgatactactctaatcggtaaccagagtacaggctagagattgatattctaagcatgacttantagatcaaactcaactgatgcaacataaagtacgaaaagaagacaatatctagacatcaagccggtggaagttcatagagtggtagatatcttatataatctaggtcaacgtcgctatttaaccaatcgggtgccttcctgttacaagatgttagccgattgtaggttagatgacgatattgtcgaagattatgtaagatatatgataacttgacgaattacatagccaagattagagtatcataaagatggaagcactaatcccgagaacataattcatcataacaagttttacctcttgttgaagatcgaaaccgatgcagctcaacccgaaagcaagaactcgtcaaaataaaactaaagcaaaaaggtggcgatgcgccgagattgtattgaacgtgtatgttgttaattacatagggctcggggtctatttatacccgagaattacaagatatgcccataccggacacgactattatctctaacaaactctaagataccataagtctttgcggcagacttttgcccgtatttatctataaggaatttacataagatatcctaattaatagatacaattgccttcccaggactctatccgtgcgtggcaatcatcttgaggtacattaacttgaacccgatgtcgtgtacaagtcatattgtcggaatcggctgtatcagcttacttagcccgactcaaacccagccgatcctaatcgtagccgatctggactccagccgattcctgctctgtttccgaactcgatctccgcctccgacttcgctttgatcaaatcttctttcctgacacaaatgttaccaaatttggtcgttaacacatgccccccaagtccgggatatttgataatgttctggatttgccatgtaccggctccgagcaagtttcgcactccgccgcttttgactgttattccagcactttaaatactaaccgttacccccgagaaatctcacgccgtgacttccgttttcaccgctcaagcgaaacctcttctctctcttctccggtgattcccccggtgcaaaggcgatttctaggcgacttcctcctcaacgagatctccgcccgcaccaatgtcgtcttctgccagcccatctggtgcgctatcagccgaatacactgaggtaagttctcatcggctaaatccccttccttagcagcagatcgattttctcctacctcatattgctttccttctcttggttgcctcggatttgtagcatatttcccaccaagtcgcaattcccagtctgacgcatgaaaaccactactttctcggcccaatcggcaatcctgaccccaccgagttcattattggtgaaattaataggatccccttcagattaaccaacccagatctaggtcactggaagaatactttcaagtcctggccgtctctagagaaagttccaccagaaaagagctggactacatggttcaaacgtgtatcagctagtaagagggtttactgggatgaaattggaatcggccaagcacttgaccttactatagcaaactcggccaaagatgaacccctgatggcagctgcttcctacttctggtcaaacaccattaatgcctttttgttcaatcaagggccgatgaccccaactctcatagatatcagcatgatcacgggtctggatgtcacctcatcagccaaccctatgagcttgaacacaaagaaccaatatgacttcaagaccaaaagcataggaggttggtcaggctatgtagcggcatatatgggtcagggctcggtcacccctcaggaacatgtggcctttttgttaatgtggctagaaaaatttctgttctgtggatcaagttgcggccccacaaccaactggcaatttctagctgaagctctagaaacaaagagacaaatctccttgggcaaaattctcctcggctacctataccagatgttgaacaatgcatcggctaagatagccgtcggctcagtagttggagcaggtggaccctggtggctgctacaaacctggttaaacctgatagttatgaaggttgtcaatcggccatccgtatcagaagctaaattcccaagactagagccgattgtaggagatgatggagaagagagtactcatcggagatgcacatcatacggagaatacgcttctacgccaactgatgctggggcaaaactatcggctgaactgctcaaagattggttctgcagcttctatgaaggctttcaaaaagatgctcgagtttggtttctttatgaagattctgcagaacttgaacacccattggacttcagattcgaagacatcaaccatgaaatataccaatcatccaggaaaattttctcggctgtaattagcccatgcatccttcctgttggcattcattaaggaagaaacatccaagcttacgaattctatcatccaatgagctcagctagataacttggaatgggccaactcccaatcggcttattctttgccgacaagatccaataccgaggagaaatttcatcgaccttaatgatggatcggctactcaaccttcaaggatgtcaagcccagaaatttagcccaaattttcagactattttgtgtgttaaatccctgtccaggaccagccagggtacacaaaacgacaagtaatatacagttccaaatgtaaataaagcgtaaaatacttacagaagaggcacttagtcctcacaccgaaacaaaagcagcagtagcggaaaaggcgatcctagcggggcttcagctccactccacaggcaaaactcaactagggtctgagccttggtcttccaacttcgtcttcagcttagaagcactacacttctgaaaaggggaaataatagcaaggctgagtacaaccaccgtactcagcaagccacaccaatgatgcaaacgtgcaaagggatacaaggacggtttgtggctatttgcataaaggcggttgtaaaacattttatttagcaaacagtaaaactgttgaataataaaggtaaattagatctccactgatcaacgctacaccacgttgaacaggcccaaccaacccacctgtactacagtgcattgactcgatttattaagtgtgagactattcacggtgaatctggtcgatcgcccataactgcgggcacggctattcgaatagttttactctggccagaggtgcacaactatacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggtagtgggtggtcccctcttgtgccgtggcgaatccggcagctggacaaccggacaccccggcctacccaactccatcacgcccaccctcgccaccggtgcctaggaaagggtcgagctatacttcagatcaagcagttacccactcccgcttgtggcaagcgctgtaagtcttctagggtttcccgtgaaccggtccttaattgccatgggtgcgactcacaaaaccatgcacccacagcccaccattcagtcgcattttagttggataattacgaccatgaaacatggccagatgtctcgagcacgcagctcaacaagatactagaatgtctaatactgtaattatcccatcgactgagctagtggtaattaagcatggctaatcatatagttctagctaggtcatcaaagtaacataagctaagcgatttatcacccatggttgacaaagaacagatatcaagtaaacatggcacaagcgagcagataggtaaaccctgatcccatgtaattagcaaaacatgcatatttatttgcaaacggtaaaacatttataaattgggaacaacatgctcaaggggaatgtgtgacttgccttgcttcttcacttggattttcttaactcttttcctcgcgaccgcgatcttccgaaacgacggattctacacgctggcacgcaaaatgaggaaaaaccctaataaaaccaagcaaacagtacataaaaagtaaacaaacatgtagaactcaattttagatgaattttgcaatttgaatggcctaattcggagttcgaatgaattagatatgaattttagaagttttgagccatttaaatagatttctataattattaatgatttattgcgcaattatcaattattttctcaaaggaaaaggcattcgctgacgtcagcaaggggcgccggcgccgacacgcgggccccgcacgtcagcggcacaaaggggcgggcgcacggtggactcggtccaccgcggcctagcggcaccgtggacccggaccacgggcagcgaacagagcggcaaggggcgggctcgccggccagcccgacaaggcggcggcacacgcacggacggccgtcggcgatggcagcacgacgcggcgccggacaagggaggcagaagggaaaagggaggaaggaggcctcaccgtgcgccgggcggcgaagggcgacgagcgcggcggcgagctcctcgggacgattgcaggatggcgctcccgcggcggctccacgggcgggaaacggcggacggaggccgggatgacctaggagggcgatggaatgattaggggaaagggaggaggcgcgaggcggtggaaaaaaaagcggccggaggccggcaacatggggagtagctcacctcgacgggaagtagaggactccagcggtgaatggcgagggcgaaggggcggcaccagacgaagaagccgatggaggcgacggcgcatattaaggtggtctgggacggcagcaggaggcggccggaggcggcaaatgcaacgtcggcctcaggttggcggtgggggtggtttttcggtggtggaggggataaacggatcggtggccgggcttgcccgcgcggcagcgaagccggctgcggtggtggcagggcgcgggtgcggctcaggtggcgacgacatgcggctggaggcggtttagggtggtggtgactcgggtgcatggtggaaggggagtttcggcggaggtttgtgcaaatggagcggtggccggtgtgcggcgaggcatggcgaagccggcggtgtaagcggcgcagcgcggcggtggctacggcgacggcggcatccagccagagctcgccggaaagcggcggagcgcgggctcgcgcggggagcacgggagaggaaacgaggagctcggggaggagagggaaatggaagaggagagcacgagggtgctttttataggctcggggaggagaaatcgtggccggacgtgacggatttgaagcggcaacggccggcgacgtgggcgacatcgtgggcgaagtggggattgatttggcgccaaaaattggggaaaagtgggggattttgtggaggaggtggagggaaaccgattttatgcggtttgggcgcgagggcgtgagcgggaggagccggaatcggcggcgacgtgggcggcaatggcagcaatggcagcaatggtggtttcggctttggaggccgaaggtagaggaaggacctgacaggtggggtcgtcgggcccacctgtcggggagggagagagggaggagagccagggggttatttagactttgcgcgaggggaaattgatcgggccgagaagggaggggtcggcctgagagggagaagggaaggagaggggcgagtgggccaaggagggggaaaagatcttgggccaaaagcggcccaaagacaaagaggggaaattttatttgttttctttttattttaattgattaaatgaaatttgtgctattaaaattatttcttaagctccgaaaattcacgggaaatttcagagagtattttagggcacaaagaatattgcaaaatattcccggccaatgatttttaagggaaaattttaattctcccattaattcactcgaataaattgctttaacttttaatataatgatttttaagaaatgcattattaaatgatttttaaacccgaacgaaaatcggggcgttacaaaggaccccctctgggcagtattgacaacatagaactggcaatgttcagaagtaaaaactttgacagatggtggggtgaatggaagctgcatttattccaccaagcagcttcaatgtatatgacagacctcttcccagatgttgtccctcaagtaagtctttaactccacttgatttaaatagctgtttggccgattaatctcaactaatcctccttttgatttgtagacaacagaatcctctcctccccgtcaaagcaacagtggtaaggatatccaatatgccccaggtttaattcctaacggaggtgggctatctcctccggttattggatatgatgcccccaagacctcagctcttcttcaagggctcatcagggaaccagccgataccggcaaaaagaggaaaaccagatcatcggctgtaagcatcacagccccaactaagaagaagaagacaaagaaaaccaagccagccgatgatctgcctaccctagatccatccattgaacaagctctggatgaagagatatttgaagatgaagttgatcaggccacagccgaagtaagcgatactgaaagaacatcatcagataactattttgtcttatagccgatcactcccaggtcttgtaattgcagaaaaagaacactacggtgaagaagaaatcggctgcaacaacatctaagccagctccaccggtaagatagttttaactttcattggttaatttccagctgattctgactaacacttgtttccttttagccttcccctcctccttctcctcctgcacaacaatcgtcaagtgaccagaccccttcagctgtggggagtcatcacatcgaggaggaagaacaaccagctgctcctgctatcccagtaagtttttctttgtctcaacaagcattcagatcggctatgcctgtttaacctctaactgcttctaaatcattgctgcaggtcttagccgatcttttctctttcgacattggagactaccttgatgaaggagaagaagataccacaagcaaagccttagcccctttatctgatgatgtaaagaaaactctggaaagtatcttggatcggctagaagcatcatcactggatagcttggtggttgattgtggctcaatcagggctcggctacatgagattcaggctctaatcccagatgagttagccgatattcttaccccagccgtttactttgagcaacaccaattcaaactggaaagatcaactatctgaaggcccaatcaagtctaatattgatcggctcgaggctcgcaagattgaactcttagcacaacttgaagaatgcaacgctgagctggacatggaacacaaaaaactagccgatctcccaaagtctattgaagaacagaaagcaagactcaaatcggctatcaagcatgttgctgatctgaccaagtctctgaaagttatccctggaaccaacgctcaggatgcccaagccatagaagaagtagagcagattaggcagaaggctatatcggccatccagcgatacttatctcaataattgttgtgtaataaaacttagaatttttgtaatcggctaacactttactgtcttaacaatcctttgtgccgattaatatgactttgaaatatgctaaaaaattttgcactgcattttgatatatatgtgcccccctagttttacaatgtcaagagcattgataaaattatataacaactaagggcgatataacaatatcggccattgtacatcggcaaaccacaaccgattacaccatgaaaaacaactaagggcgatataaccatatcggccatctcaaggcgatgtaaacacatcggctgtcatgcatcggcaacacgagccgatcatgtgttaacccaaacacttgggtaatatttcttcaaatatttgccattgagcgctcgcccatagacttcgccatcaagcccttgcaacatatatgctcccttagacacaaccttataaatctggaacggtccttcctaattcggcgaccatttgccgaatttattatcacgagtaccaatcagcaaaatcaacttccatacaagttcaccttccgaaaaatctttaggtaccactttcttattataatgccgagcaacgcgttccttatccttggtaacctttgcaagggctcgcaatcgcgactgaaccagatcctccctctcatcggccataaggttgtaatactcatcggctgttaaatcgttttgtaactccgtccgtcgagagccgattctaacttcccatggcaaaacagcctcatgtccataaacaagtttgtaagaaggaacttgaatcgatacatgacaagccatcttataagaccacaatacttcagccaaccgagtatgtcattgccaaggataatcataaattttccgcttaatcaatttgatcaaacttttattagacgcctcggcttgcccattagcttgtgcataataaggtgaagaattcaacaacttgatacccacactatcggcaaactgaacaaactcatcagacacaaagattgaaccctgatctgtagtaatagtttgaggaagaccaaatcggtagattatatgctcctgaacaaattgaatagcatccccagaatcaactttcttcaaaggaatcgcctcgacccacttggtgaaataatcagttgccaccaatataaatttatgtcctttactcgatggtggattgatcataccgatcatatcaattccccaacctctgaacggccatggcttaataataggattcatagccgacgccggtgctcgctgaattgctccaaacttctgacaatcctgacaccccttataatatctgaaacaatcctccagcattgtcggccaaaagtatcctgcacgccgaagcaaccacttcatcttgtgagccgattgatgagtaccacagatcccctcatgaacttcgctaattgcaaccttagcctgatcggcactcaagcacttaagtaatactccatcaatcgtccgataataaagctcgtcatccaacagtatatactttaatgccttatatcttaatttcctagaagccgactgagatggattactcaaatactaatgcacatcgtacctccaatcatcggctgatatcgctgcaatttcaactttaacatctttgatcattggcttataccccaacgccccttgagctaaatcattagcttcaagattttttttcttgagatacatgctttaaagtaaccagccgaaactctttcattagttccaagcacttctcattataaactatcaacgtatcgttcttgcattcatattctcctgccaattgactgattactagcaaagaatcccccatgatttcaatgtatcggcttcaacttccttgagtaattgcaaccccttgagcaccgcttcatactcagcttgattattggtcgcatatggtttaatagtataagcaaactcgaaacatgccgccctaggggaaattataactaagctgatgccacaaccatgagtacataccgatccgtcaaagaataaagtccatggcactatctcaaccgagccgattgaatcatcacgatgctctacaataaaatcggctatagcttgtcccttaatcgctttcggtgattcataccgaagatcaaactcagtcaaggaaaatatccacttcccaactcttctctttaatattggagccaatagcatgtacctgactacgtcggctttgcatataacagtacactcattagataatagataatgcctcaaccttgtacacgaaaaatacagacacaagcataacttctccacaggagaatactgagtctcagcatccaagagccgtcgactgagataaaatacaactcgttccttcccttccaattcttgaatcaaaaccgagccgattgacttctcaccagccgataaatataacctaaacggtattcctttctgtggaggaatcaaaacaggaggagagctgagatactccttaatattatccaaagccttttgctgctctgccccccaagtaaactgctgattggcttttaacctcaataagggtgtaaaaggttccaaccttccagacaaattagaaataaaccttctaacaaaatttatcttgccgatcatctcttgtagctctgtcttattttccgggggctgaatcttcttgatcgcattaacgctcctttgggttacctcgatccccctttcatgaacaagaaatcccaaaaactggccggccgacacaccaaaagcacattttgtcggattcatcttcaagccatatttcctggttctctcgaaaactttccttaaatcggctatgtggtcctccacttctttagatttgacaaccacattgtcaatataaacttcaaccagccagccgattaaatcatgatatatataattcatggctctttgatatgttgctccagcactctttaaaccaaaagtcatgacgacccattcaaataagccgattgcactagggcatctaaaagccatcttatggatatcttcctcagccataaagatctgattatatcctgcgttcccatccacaaaactcaaaattttgttccctgatgcggcatcaaccagctgatcggccactggcattggatattcgtcctttggtgtagctttattcagatctcgaaaatcaatgcacaccctgaccttgccattctttttaataactggaactatgctagaaactcattcagcatatcggcagggacgaataaaaccggcatcatacaaccgtttgatctcagctttaacaggttcaagcatattggctttacatctcctcggaggttgctggcatggtctaacccctggcttgataggtagtcgatgttcaacaatcgatcggctgagtccgggcatctcataatactcccaagcgaagcaatctctaaactcttttaggagttctatcagcttggttctaaactctggagacaaattttttctaataaatgtcggccttggccgatcgcctggacctatgtctatttcttccaactcatcggccgacatgaaatcttgaccttgcttgtcatcgagatcatctactgtatccttggcgtagacatttgaaccctccacgacgccctcaaagtaatagcatgggttctccatcttcaattggctgtatatcagaatcggacacttttagaaaatctccatcccagacttttccagataaacaatcaaggccatccatctcccaaagggctaaatcggcactggcaacattgactgacctgtcggctggcacgatctctgtcttgtcgccttgccattgaatcaagcattggtgcatggtcgaaggaatgcaacaattggcatgaatccaatcccttccaagcaacaagctgtacgaaccattcccattgataacaaaaaacgtggtaggaatagtcttgctgccgactgtcagctccacatttagaacacctctggtttccgatggattaccaccaaagtctttgagcaccatatttgtcttgatgagagcctcggtgttcctacccagcttcctaaacgtagcataaggcatcaaattcaccgcggccccaccatcgaccatcatcttagacatcgtcttcccattgacgtagccgtttatatacaatggtttaaggtgtcgattctccgtcccctctggtttctcaaatattgcctgttctggtgacagaaccaacttagccgatccttgccaacatcttcgcctcatcggttgcagcatcatcggctataggaacctgattcttgacacaccactcctgtcttggctttggtttcctcagtcgatggttgatttcctcttcaacctcctgaaaacgctccctgttcctcaatctctggacccttcttttctgattcttcgtgaaaataccagaaggacaccattgattcttcctgattacctcatcctcttggccacaatcttgattcatcggacccaatctctgatgaacaggaagtcttgcctgccttagccgattacctctactatatgaccggctcgagctctcgatgaaatcactacacccagggcagttttcaatggatggcaacctcatcccttcgttccagcagaatctgaagaactcacaaccctaatgaggatcaaaaccatcgtcgtattcttcataatgcttctcctgctgcttgtcatacttccactgatacttgttgataatcctagccgaattcacttgaaaacctgttgcacggaccctatcggctgcttgactagctgtatgcaccatattaacaggaaaaggattaccatcgaccttcatcggctttttggaatcgtcaaacctaatcttgcccccctcaatggcaacctggatttgctatctaaaaaccttgcaatcgttagtagaatgagatccagaattatgctatttgcaatatctcttcttacctaattcctcagccgatgggatcgtatgaccagcaggaagctgaatttgcttttctcagagtagtaaatcaaaaatcttgtcagccttggtgatatcaaaatcatacttttcctcttttccaggactttttacccattggcatggtatgacctttttgctcctcacccattcggctgcagctatttcagaatcatcttcctcgtcatccgatccatacatgtatggacaaacatgattttcttagagcttctcctgacttccgccaacctacgctcatgcaaggttaccttctgtatcagatgcgataagctatcaaagtcttcggacgagaatttctccctgattggaggaatcataccctggaaggccaaatcggctaactgagcattagttaaactcaagctaaagcatttgttcctcatctccctaaacctctgaatatactcgtgcacgggttcatcatgccgctgcttgatcgctgtcaagtcggacaacttcatctcatgaaccccactgtagaaatagctgtgaaattgcttctccaaatcggcccaactattgatcgacccatatggcaaagaagaaaaccaagtaaaagctgatccagacagagataaccggaataacctaactttcaaagcgtctacagccgatgcttcatggcactgagcaaggaatcggctgatgtgctcataagtcgacacgccctcttgtcccgaaaacttggagaaatctggaactttaaaccgattggggagagggactctttcaaaccactcaggataaggctgccgatacaagcttccagtctcttttggtttaagcccaaattgttctctcattacatcggcaatcacgtcggcccacggtcgttgctgagctgctccttgtggctgttgttgcatagactcgaactgaccatactgagatgcgaactggggctgagccaatccccctagctgatattgggcttgcagggaagggggctgatattgatagctcaagttacccccttggtaattatgaagattcggctggatgttgcgcaccaagtgctcaggaaccatctgaggcatcactgtaccatccggctgtgcatggtgaaccaaatgttctgggatgacctgatttacaaactgctgtacaggctgaccaccaggtactgcgaacccggccgatgcattcaccgaccccgggtgctgaatcggctgaacgacctgctgtcttaacggagtctgttggatcggctgctgaggctgctgccttggtggcgtctgctgagctggttgtacgacctgttgttggattgattgtacaatcggctggattggtggtgtctgctgaatcggctgctgctgcactggatcaaaaataggtggaggtggcagaaacatggcagcgacttgatcttgggttatgtcacgcccagaaatttagcccaaattttcagactattttgtgtattaaatccttgtccaggactagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcatcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcagttatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattgggatcaacatgctcaaggggaatgtgtgacttgccttgcttcttcactttgatcttccgaactcttttcctcgcgaccgcggacttccgaaacgacggaaactacacgctggcatgcaaaacgagaaaaaactctaataaaaaccaaggaaacaggacataaaaactaaacaaacatgtagagctcaattttagatgaattttgcaagttgaatggctcaattcggagttcgaatgaattagatatggattttagaaattttgagccatttaaatgaatttctagaattaaaccgaattattgcgcaattaataattaatttctcaaaggaaatgacaagtgctgacgtcagcaaagggccggcgccgacaggcgggccccacacgtcagcgagccaagggggcggcccacggtggactcggtccaccgcggcacaggcgcgggcgcaccacgtggacggccacgtggcggccacggcggacatgcggcagaggtggcgccgacgtggcgccacgacggcaccgacgcgggcggcgccgaacggccacgtggatggcccagattcactcgaggtgaatcgggcggcctcaggcgggcgcgagccggctcgccgaccggccgaccggggagcggcggagtgcggcgggaaaagggagggggagctcaccgagtagcatacgacggaaggaggtggccggcggcgagatggcaacgcgaggcggtgacggcagagctcgggacggacggaaacaacgacgctccgacgacgggcggcgctcgggaagaggcggatgagcggcagctgcaccctaggatgggaggggaggtgttagggaggacggagcggcgacatggccggctggagaggaagggaagggaggaagggctcaccggcgcacgggaatctggacgtccagtgagtttccggcgatgggaagagatggccgaggttctcctcgtccttgtggagccgagggaggcaacggcgtgggtcggcaatgactgtagcagcggggcgacgcggctggagtcggccagtggtggtggtggctcgggttgacgggggaggggtggttacggtggcgatttgggaaaacggagcggaggccggggtagagcttggcacggcgttgccgacggcgcaagcggcgaggtgcagcgacgactaacgcggcggcaacggccggctgaaggcggtgtgtggcggtagtggctcggcctcgcgatgggagggtggttccggcggtggaggagggagatggagtgaatgccggggtgcggtggggcgctgtgatgctataggtggctgcggcgcagcgcggcagcgacgggagcggcggtggcgggcggctggagatcgccggcgagcggcggctagagggagcacggtggggaggtgtctagggggcgcggggtgctcggggagaggggaaaacggatgaagggaggcacgtgagtcgtttatataggtcccggagggggagaacgtggccgggagaggcggatttgaagggggaagaggcgccggcgacgtgggcgagtggggtggttcggtgccggttttggagggggggaaaagtgggggaggagagtggaggaggtggggtgacgcggtcccgcggtcggggcgagcgcgcgggtggaggaggaggcggaatcggcggcgacgtggggaggccgtggcggcggtttcggctgagggagccggaggttagggatggccctgacaggtggggcccacctgtcggcggctcggggggaaggagagaggaggagacggttgggggagaagatgacaggtggggcctcgggttgacggggaggcaaagcagacttgagggagagagagagccgagcgggccgagggagaaggccggcccgagagggagagaggggggggggaattgggccgaaaggggcccaaagagaggagggaggtttttatttgttttctttttattttaattggttaaatgatcttcgtgactttaaaactatttctcgagctccgaaaattcacggaaaattccggagagtacattagggcacaaagaatattacaaaatattcccggccaatgatttttaagggaaaattttaattctcccattatttcacttgattaaattgcttaactttttattcaatttctaggaaatgcatcattaaatgatttttaatcccgaatgaaaatcggggcgttacaaatctaccccccttacaggaatctcgtcccgagattctgggatggctagaaagaaagccggtgctgatgggcggtctgactgatctgcaccttgaactgccacattctgcttcgaactgattgattgactggttgatcaaacctgcacgattgaactggctggattcgacctttctgttcctttgctttgccaaaactggaccgactggttctgcttgaactgacccagtctaggactgcggatgctcctgaaacttacttagtttggactgaactgttgaggttagcaattttggtaacctgagaattcaccacgctggctataagaggatgaaaatggaatctggcatttataaatcatttaccctatgtccgcttcgactggtcccaattcaaataacaagtaattccaggaaaacctgcttgacctgtctttcgtctgaactgcaaccatcctcgatgctacttctctaagctgaactgttgacctggcctcaagggtgtacattagaattgaacctgttgacttgagattgggagactctgctagtggctcgcaacggactcctttaattactaaccaaattgctgcactgggttgaacattcaagtgaaatgccgacgaggtaaaccaaaactcatctctgagacctacccccttacagtgggtagtcttactttcgcctgactgagaacctttgaactgttgtccttgaaaaaaatgaccaacatttctcggatttacagatgccctgactttgaagactgaaacttcatcggtccatcaaattgaagcaatggcgatgcactttcatcccgacaagatttggaacttaagccttagttgatgataggaaattccacataaaagtgactctcatttagctcatggacacactgactcttgactgcaacacactactgctggagttctttccgctacacttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatatgttgtgagtagacttttattcttcaagttgcttaagcaaacaacctagtatggtcgcatccccaccaatgatgcaaaccatacccctacacacaagcaaacaacacacaatctagaaagctaacggaactactcttctgggaaagattgggtttaggtcatctccgagaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttcacaaagaaatgccgaagggcgagaggagacaatttgcaagtagggttttcagaaaacttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctgatcgaccgcccataaccgcgggcacggctattcgaatagttttactctgatcagaggtgtacaactgt

SEQ ID NO: 60722 - DNA, 15697 bp, Oryza sativa
tcatataatagcatatatgttttctcaatgtattattcaaatatattaaaatgacaacataattttaaattttatagtaactttacgaaactactcatgtgtaatattcatattgtattatatatatatatatatatatatatattagttattaattatttttaatattaaattttagttatttgtaaattatatttttatatggattctagactcgtctttcaatatttcttttttaattctaaattttcattatctgtaaattgtatttttatatagactctaggctcttcttccaatattatttattttttaattctgaaattttattatttctaattgtatttctatgtggactctaaactcatctttcaatattctttaatttttaatttcgaatttcagttacttctaaattgtgtttctatattgactttagactcttcttcccatattttttttaatttcaaattttagttatttataaattgtatttttatacgaattctaaactctacttttaattttattatgtttattccgaattttagtttgttttaaattcctatatggactctatactctacttctaatattccttatttttaattccgaatttatattatttcttaattatatttctatatggactctatatatactctacttataatattccttatttttaattctgaatttctattatttcttaattgtatttctatatggactctagtctcctcttccaatattccttattttttaattccgaatttcaactatttctaaattgtatttctatatagactctgtttttctttttctccgattaatatgagaatttttaggccgcgagagcgaacgtggagggtcctttttctattcctttaataagttaatagattggcattagttccaaaagagaaatttttcgcgcatgcaaaacgagaaaacttattaacacatgattaatctaatattactaagtatgaacttgaaaaaggatttatttgaattttttaaacaacttctatatatgatttttttttaaaaatacgtctttgaaaaatgtgctaatagaaaacgagaaagttgaagaaaataactagacctaagtgaggatgaactgtataggtttataggatttctggtgaatgtgtgttaaccgtgaaatttggtaaacccaaagtcatcatcggcctagagtcagcatcggcttcatagtcctggaatcggccgatgagaattatcaagttgccaggattcttgctatattcggttaaggaaattaatctattaaataaagtttatccagaagagaccgagttcaagaaagatgcggcatgacagtttatctattaattaggaatactctattaatttccttttatctttagtaaagtatgtttagtgtccgataaagactttatgttttccttttatctttatgaaagtttctctcttgtccaacaaggactagtatctacccatgggtataaatatgtacatccggggtcattgtaaactatctcaattgtaaactatctcaacgatcaatacaattactctcggcacatcgccaccttttttaccgaggttttttacttatcattcggtggaatttggcacctgacacggggctgcattagctttcgatctccggcgaaggggtaagtcatacgttccgccggacctggcaattgtattgcttcattggcgtcgttaaaggctacatcaatacattcgacctcttgattgctctggttcagttgatatatttgcctacctatctatcatatatcttagttaatcttgtcttagtatctcaatttagccatattggtcgattctcctttagggtttatgccggtattggctaaatcactttaccatattagattagctaaggtatctaccaccctgaaaatcagacaaaggcttgattatctagatattatgtttctttttatatttagtgttgcatcagttaagtttgatctactaagtcatgcttagaaccataatctctagcctgcttcttgattgccaataagggtttcatcggggttttagccgatgagttatctggacgttgcatcagcttataaagagtacatacaagttggatttagccgattacgacaaatgtttcactgtttatctaatcgtttggattttatgacatcagacctctagccgatgtattctttaaccatcggattagggcttattctatcatatcattattagccgattggtttctactggattagattgttgtcttattatattaccatccgccgattgtctttatatcattatttacatcaagtgtcagattctacattaaccatatagccgattgttcaagacctatcgacatcggctggtatcagcatcggcatcggctggaactaatccatcggcttatcagctgatcggctcatcagtcgatcggctctttcatctgatttttatatatcttgtcagttgcaggatcaaattgactggcacgcccgcatcccatcaacctttagatctgcactagagctaagcagatctcccagaccaccgtgttttcacatcaacaatgtgtaatgcctctagcttaaagtcctctttacttcactttttagtttttacatagatcagttctgtcctgctgctcgttggcggttgcatgtcactttaagccgtggtatttctgacggttgtattgctgacttgctgaggcaatagaaccacggaaggagcccttttctattgttattttccttaacaagtaaattgtgttcgttaggttgtcactgttttcaaataaacaaattcagcttaaaaaaacagtttggatttatggaccaaagccagcaggttattatcaccagttgccaacaattaccttttttcttttctcactccaatcagtttttaattgcggtcatgtcacaataaacgatgcattaactatgaagcattcagaaataaaaatgaaaccacttgtgagtttcgactgactttccttgggagtatagatttgattatgtcaccagcaccaataggctcacagaaaccttgataaacaatccttaaagaggattaggtaaagcatcccaaactgacagcacttctaggtgcatgattggagaaaattaatctaggtttgaagaatgatgaccattttttctactccgtgtttctcttttctatttcggcccattgattggcttcaggtaacgcttgtttggctatgaatgtaacatagatattatatttgagaaaatctattgtatacccctgaaattttagctaatcccttttatgtccctgaattttgcttacttctttgtataccctaaaatttgattttgattccttccatacccctcccatcagttgaccatctaatttctataaaaataaccattttaccctttggatgaacacaaaaaattatgaattacattattaaaaatgtaaaagtttgtcgcatgagactattatagttacgagtttgttgtgcaatgcattatttatcaaaaaaatatttttagataatgaaataaaaaaaatattttttttaacaaaaggaggatcattcatagaaagatgggactaccaatgctcacagtatttttttaatgaatgctcggtaaaaaagaaatccattgtcctattaaaattttagataaatattttaatttattacatttttttattttcaaaatttatgtcaaaatttcctgctctaattatttagtctcatcagttttataaaatgcacatattgtgcactcaaacaaaatttttaatcgtttttcaagtttgtattcaaacttaaagcagcaaaagcgaaaaaggcatttacaaccaaacgtaatagtgaaatgaataaaaatgtaatggtagggacatggaagggatcaagttaaaatttcaggggtatagaagagattgggtaaatttcagaggtatgaaagggattgagtgagttttcaagggtacacagggaatttactcattatattttgtgttgtgttcagacctttaaaatttctttgtacagaagatgcatcaaaataacgacttcgctaaacatatggtgacctctctctctctgcacgaaatcggtcaaatttgcttttgtggggatcactagcttacagcgtggcccattaattaacagctgtgtttttttttgagagggaaagagaggagctctgcctatttcatattaggagaagagagaaaaaactagagtttttacaaactaggttacaaaaggatcctatgggatccctctcgagaggttgacaaaggaggtgtcaacaattttaagacaatgcaaagcaactagaaggaggatatgagaactactcatctatgttgtgtgctccatcataggctttacacatggcgattattgactcgacaacttgcattactgtgctgtaagccccgttaaagatcctagcatttctttgaagccaaatgccccaggttgtgtagatgaagaggccatcaaagttccttctctgttctttcgccatctctctcctgcaggctatccaccatcctagcatgtctccattgaaggaggaggccagaggcatatgaaggcctaccttctgccagatgaatctccagatttgctttgcaaaggagcagtccatgaggaggtgagtggctgtctccggttccacacctcaaagagggcagatgtgactgttgtcccaaccacggagatggagcttgtcggcagtgaggatcttcctgtgtatcataagccaaccgaagaacttgcatttgttttccacttttgccttccaaaagaaatccgacctgttatcctggatgcctccgacgaattgtatcctatatgcggtgtttgccgagtaggttccatttggagaccaccgccatgtaatcgtgtcatctgtttcttcttgtaggacgacctgttggatttgatgccataggaggatgaattctctgacttgtgttgtggtgttcattcttctcatctgtcttagccaacgattgccctgtagctcctgtgccactgttttgttttttctcgttgcaagctggtagagggaaggggttagctctttatgggataacccatcgagccatctttcatgctagaattttgtcctgtggccatttcctaaggtaatcaccgtggaggccctaaaaagctgcttatctgtttcatcacaaggaaggactgatccctgccaaggtttgtccaccgccgtccattcttgccagagccagcgtagccttaaggaacggccgaagcgttcaaggtttgttatgcctagccctcccatgttctttggtctacagaccctcttccagtttactaagcagtgtcctccacgtgcctgttctgatcctatccagaggaaaccgcgtcggattttttctatcttttttagcccatatcttgagggggaagactgtacgatgataagttgggagggccgaaagggtggatttgatcaggaccgtccaacctgtcttattcagcaatttccctttccatgttggaagccgagctgaaaacctgtcaatgagcggttgcacatccgactttttgagctttctgatgtgtagagggagtcctaggtaggtgcaagggaaggccttcctctgtgctgggaaaggggagagaatattttggaggtccaggtcttcacatcttattgcgtagacttcgctctttgacagattagtgaccattcccgtggaaattccaaagttatggagaatcgtctgtactgtatggagttcctgtttatctggccttgtgaacaccactacatcatcagcatataaggcaacatttaaacgagcggtccacttgtgaaaagggtgaaagaagccctcttcctgtgctctcgcaagtaatttctgtaaggggtcgattgcaaggatgaagagcatggaagaaagggtcaccctgtcaaagacccgttccatgcaagaagttgttacctgctttcccgtttagggggatctttgatgaggatgtagataggatagaaatgatccatccaatccacctgtctccaaaccccaggtatctgagtctatcaaggaggtatggtcagctgaccgagtcgaatgcttttgcaatgtctagtttcagaaggatcaccggggttttgcaggaatgcagttcgcgcaccatgttgttgacgaaaaggaagttaatcctggatgtttcttccctttatgaaggcactttgattttttgagatcaactcctgaagcctaggggccaatctgtttgctagtagttttgagaagagtttcccaaaggcatgaatgaggctgattggcctgtaatcacctacctgtagtgcttcggtcctcttaggcaagagggcaatgtaggccgagtttagtaaccaaaggctttgagtgtcatggtttgccacctgatttatcgccagaacaacgtcttcctgtatgatctcccaacatttgttgaagaaggcacctgtgaagccatcaggacctggggcattatctgatctagcttggaagatcacttgttttatttcatcttctgtgaagggatcctctaggtcagttaggtcttgactctgttcctgtaggaagctgtagttgattgctgtggaacgggatctactttcacctaggtgatgcttgtaaaaggtgagcaattcattttcttcttcctcatgagagtgagccaccccattttcagtcataaggtgttggatgaaattttttcactttctcgcacttgctttgatctcgaagaaccaagtgtttgcatcacctgcttttatccaagtctgtctggatcgttgacgtaatcgtctagtcccagaagtttctattttaggaagcgtctgaacgtgagctctgcaggggacatactgcgttcctcctgagctaggtcgagcctgaaaatcaattcgctcgcaatgtctgttctcaatttaattccacggaccctgctcttgttccaaacacttaaggcctttgccgtcctagaaagttttgtgtggaggcgcttgattgcatctgtcgtgtgtactgtcttgttccaagcttgttggactgtatctaggaaatctgggaggcgcaaccagtacttttcaaaacggaagatgttactctttggtctggagggatttgcagtgagtaatagagggcagtggtctgagaccaaggtagagatggctgctaggaggcaatttgggaatctctcctcccatccctgtgagcaaaacaccctgtcaatcttcgttaaagttggggactccgtttcactggaccatgtgtaacgctgaccatttaatttgatttctagaacttccagatgatttagggcagccctgaaggcttgcatcatgcccctattgagatttgcattgtttttatccctgtcatgcacgatcaggttgaagtcccctagaattaatcaaattggtttcattacctgctttagttgttttaattcttctaggaattctctttttgcatcatcctgttgagggccatatactcctgttaagctccaggtggctctatcttccttctctgtgagtgtggccgacactgtgtaagtacctgtgtgtgcatcctttaactcatatttgttgtcatttgccgccagtaagacacctccccttgtacctgaggtagaaggaaaacaaaagttttctgagaatgttggccctaataacctattgaaatttgcctggtcgatgaaatctaattttgtttcctgcaggcaaacaacagtgcagttgaggtctctaactaaattcctgaccacctgttgtcgggctggggagttcagccccctaatattccagctcagaatagcacattcatttgtaaacattcattttgcttggtatttatctgtcagctggatgaggacatggacagtagaatcaatcggctgaacctgtacagcagaacctggacaactgaacatgtagtggagtgcaggatcaatcagtacaaaggaggcagtggaagacacttttagtttcttcattagtagcatcattatgcttaagatggggctagcagggtacaagggagcaaacagcctccctatcatcacctgacacaacccaaaaactccaaaagcactttcctgccagcaaactacaacctctgggaaccatctcaggtttcaaacaactagaagctaagacagacttgcacagattagacctaagaaacggcataagaaactagggacaacactgatacattagctagtcacacacacagcacaagtcactttggcttcttgtcatcaccaatggcacagccggccaccagggtagagaaagcatcgatcacttctgcggacaggggctgcttgaatagcttcacgtattttgtcatcgcttgatctgttttcttgccatctggggagatcaagccagctttcttcatcaggtcttcctgggcacgatcaccaggcttggccggagcgaggcgagaagcaaccttctttgccagccgtgcgctcctttggagcctggcgcgcttgcacctggcgagctggggtcggcagcggcggaggctggacctcctggaaaacatgctcaaggaaagccgttagcttatcgtgcaaatcaggcggttggacctgttccggcggctgggcctgcggctgttccagggactgctctggcggcggagcgatgttgccaaggccaacctcctccaacattgggtcgaccgacagggggatcgccatcattggagcatcgaagccggcgatggagttagctagctggtcaacttgtagcacagtcgcaaaaggagtagtcagtggaaaaggcacaatctgcgattcctgtgggcgaaactccgtcagcccctctgacggcgggggagggggggaggctgtctggggtaccagcgggcgaggggctggcggaggggactgcctgttgcgaggggacctggtgcgctcccttctaaccggagacgtcgccgcccgctgatagccaccataggaaccacccctgtggtctggtggcctggaggaggagcgcctggttggagccgtcgtgcgagcagggggaacatcccaacccgaaggccggcgatgctcatgcgccggcggagagcgggagcatgagtgagagcggttgcgtcctggtcccagcctcgccgccacatgttcgcgaggggcgcgctgtccatccttgactcctaagctccaaatgatatcgtgccgctttggcacctcttcagtcactgaggccgaagagatcatgccactgccctggctactagggctgtagccccagactggctccatcggaggaggactggagtcaagcacttggtcaaggtggatcagcacctgataagtgagaagcttcgacgagacagtccgtctgcgttccagccctgactcccccaggtcctcaagccagaaggagtcaggagagttctgcagaagcggctcctccagctggaagtgaaccgccttcgggatggcatcaggatcctcggaccaaatccaagcacacaggcaggcggtcttggtctccgtctttggctcctcaagatcctggaccaggcaaccctcatcgaggatgcctgcaattgtatccacagaccaagtatggctgggaatgccctcaaagcagacacgcacgctaaagcgccagtctaccaactctgcctgaactcgcacggcttgaccgagaagttgatgtcctcaatagagaacggactcgccgccaccacgctgtcactgagagtgctcaaggtgcaggtgaggaggtagacacctttagggaaaaccaccaccgtaagctcgtcccgcgggagctagaacttggtcacaatcaacctattgatctaccctgcatttgtcacaggcatgttacctgtgatccggaccacagccgcagacctggacagtaagccctcctcctcacggaccgcagtcgaccacggtatgcagcgctgaatgctgtccagccggttggctaggtcccctggacgcgccattgtagggaggggaggaacaccaggcagctggcaagtggaggggccggcgctaggcgaggagacaggggctgcttctggtgaacctgtttcttctgaactgaagcccctgggcagcggcgagcacggtggccagaggcaaagcagaggatgcacctgggtgggtctctacagtccgcaatgcggtggtccttggcgaggcagcaaaaacatcttccagttgccttccttttaaagagttccaggaaggagatcctgctttgaattggctgaggaggctcatggtaaacctgcttgttgcctggtaggtggtgaggagtgaagactcgagcgttgaaagctttctcagatacgctgggatttgaattgaatgctggtagagaaggtttcttcctccatcaatgcttcggcttcacaatctgccatgcctgctgcgaaggatatgctgggatttcgttgggaatgcgcgaggcggaagtcgtcgcctgtaccatcagcgcaggaggcttctgagagtaactccccttacctgcacagaggaggcagctggcggagtaactgctgtagccacggctcgacgaaggagcaccagagggtgcgaggatccagccgaggtcgcggagccggatgagagcgcggaggtggcgccacctgctcccttcaacgctggctcgagcagatccgccaggagcatctgggggcggaataaatatgtcctcctctgaaccttcacctgaaagggagccgagactgacacggaaacggcgatgtgaacggaaagggggaacctgcaaaggggattgggggacgccggtaccgaattggaggccggcggtggggtgggtgctgggatcgcagtggcccccagtgagggcgggcggggtgggggtggggaactcatcgtgaaacttgctagtggcctgatactactcctaatgtgcctgatatacgttccttcccacacaccacttaacttctctccctaacacaacaaacaaacgagtatgggcttgaatatgaacagatgcaccaagtgaagcatgttttatgtgcatggagtcaaatctggtttagtttgatgatttaatattctatattttctatccttgaataattagggcggttttccgtggagatcgagggcaagaaattgtggagattttgcttgttctcctacatagcgtacgattcgaaatttacattataatatttaaaaattaaatatcgaggatgtgcacagtacaccaacactgaacacaaacaatgaacacgaggttcattgacacatccacgtatcgtgaaatctgaatgaaccaacccgtgagctctctgtcaaacaattccttacctacgtactatttgccactctcttaaaatgccagtgcttaaatgccactctcccaaatttcattcctaaatgccatccggatccacatgtcagcctcactttccattcaaacaaaagtgatgcgggacccgatactgagtgagactggcatatgggcccggatgatatttaggaatgaaaatttgggagagtggcatttgagcactgatattttgagagagtggcaaatagtaaattacgtgggaggctgaaagaacagctctatatgcttacaaaatgcaacattttctttctagacacatatctacacaggatatggatgacgtataactgctacaaaacaagaggcgagggaggcaggttacagtcagccgaacggagaaagtgctttcaataggaaaacgatgagaaggttgtaaataattaattaatattgacagttgaccccatagaccttaatttctttcatgacaataaataatagagccaccaattcctgtggcttctactacagtatctaccagctcagtgcatgctcagcgtcgacaagagagagagacaagagatcgatcgatcagccatggtgggcgcgcttgcgagcgcttccacgggggtgatgaactccgtcatcgcgaagctctccaagctgctggaagacgagtacgccaagctcaagggcgtgcagcagcagatcgccttcctgcgtgacgagctccgcgccatgaacgccacgctccgcgtgctggccgatgtagaggaagacctcgacccccccgtgaagaggtggagggacaaggtccgtgagctcacattcgacatcgacgactgcatcgactcgtttgaggtccgtgtaataagccatcagcaggagagaggcgagggcctcatcaaggggatcattctcaagctgaagaagctgagagctccccatgagattgccaaccagatcgaggcactcaaggcccatgtcgtcgaggagagcaagcgacacaagaggtatgatcttctcaagccatggtccagcagctctgccacttttactatcgaccctcgactgccggcgctctacgaggaagtagataagcttgttggcatcaaagggcctagggagcacatcattgaatggttgaccaacaagaggagtgatagatcaagagaagatcttaaagtcgtgtccattgtgggttgtggcggtcttggcaagactactctggctaaccaggtgttcaaggaaatcagacaccaatttgattgttcagcctttgtgtctgtgtcccggaaccctgacataaagaagatattaagagacatgctgaaagaagtgaacagtcttgacaacacacaaccatggtctcctaatgatgatgagaggcaactagtcaataaacttagagatacactccaagataaaaggtatgcaaacagccatggcattttacatgcatgattgtggaattaaaattcgtatttgatcctagatagatatagcagatgcttacatggtctaagtaacattctttgataaggtttaatgcatataaatattgcatcagtttttttttaaaaaaaaaattcttcaattgttgtgatatatgcgccccaaccgatttgaactctcaatgtaggactaatatattcccgggtattatgttcacctccattaatgaatgatatgatgccctcagcggctcagcggcaaaccgtatgtgcaactgatatccagaaccacggcttgtacatgatcgtgttgtatgcccatccagggtcctatatacacgtgcttgtgtagggaaggtttaaacgctaataccaattgtaacatccctagcttccaaaatccacattaacctagctcttccatggagcaggtccatgtaaatagcgccgtacccaagaatttgaggccctagcaggatttacgattctgagatggccttccgttttgggcatacaacaaatttccttttttataaaccaaaatttgaatacaaattcaaattcgtaaaccaaaatttgtagattccgaacaaatttcataaaccaaaatttgaatacaaattctctgagtttaccgataagcttgtgaaaaccggtcggctttggcgaaattccgagcgaaatcatcgaaatttcaatcaataactataaatagaggtaaactaaaattgttttccttttttaattcgttattcttttctttcctattgtaaatttcagtaaatacatggaatacatcagtttttttgaaaatttatatcccaataggttctatgaatatcatactatttataagattttatttgattttttccttttttatcaatttaaatttgaatttggatgaaactcatcgaaatctcagacggcttctactttcgagcctcgtcgaaacctcgaaatttcgcggaatttgaccggttttcgtcgaaattatgaacatatataggatggagggactaagaaattaattcacaaaccatggtagcactttgcctaattttgggaagaaagggttgtgacattcagttttctgtagcaagtacaaaaaaaaatcttcaatgtttgaaaagcgtgttcttatcattaacatgaactacagttatttgatgcagccctgattaccattgtacacttattggagaaaagaaaaacaatcttgttataaccagattagtgaaggagaaataagactggaacttgaaaaatagaatgagaaagtcctgaaacatgttgtaacacactggcttggattgaaataaatttgttttgaggcccctaattttagggacctgcagggtcgctcatcttgcacttgcctagatacgagcctacacgtacccctagcatccaggcacacttttatcatcattttgtgtaaaatggtataattcagaggtagagtactaaggttggaactcatgactcgagtttatatgccgcccccatcacatctgaactcaccatgtggactaatcccaccaacatgtaccagacgctatggccagatgggccaactactacttgtacaatttgtagcatcaccctccctgattattgtctcactatcttacttttgcacggtgtgcaatacgctttgtttcaccattcccttccattggggagatttgcaataataacactgcaaacattaatccctacttaattaacaaggaaattagtaaattaaagtaattaaggctaatgcaagaatatactccatccgtctcaaattatagggcaccccttttaaggaaaatcaaactcggtagcttttgactaataatcatactaactatatctatactaagtattatacatgctatatcactaaattaatattttaaagtagtttatgtgatgctaattttatatttgtggggatcatagaatgaaataaagtactagacaaagtatgttattgaagaccgtgtaaaaaaagtatagccttataatttgggacggatggaacattagtctcccatgctacaataatcgatataaacttccaatcgattttagtctactacattacagattaaatcatatatagtctatatgtagttgtatgtattttatatgtaagcttatatctcactaggcttgccttggcttaaaaaattttctagatccgcccctgctatgatctatcttgaacagctagccatgcaaagaatttgtattattcaatggtattcagatcttccaaattatttctgtgcacggcatgttggctacttggctgagccaatgaatggaactatgcaatataggtagactagacttaaatgcatagcagatactccctccataaaaaaaaaagagtaaattgcactagcggtccttaaacttgtaacgatgtttcacttaggtccacgaacttgtaaagcgcacatcgagattcctaaacttggtttattgtatcatcccggtccaaagccgcgtttaaccatggtcttgcctacgtggcgtgccacgtagacgatgacatggcacaaattttaattttcctttttttctccccatcttttctctccttcctcacctcgtgtggtcggaggggacgcggggcaggagcggcgcgggcgtgctcgggcgccggccgacgggaggagaggagcggcgcgcgtgcgcggccagcggccggcgagaaaggagcggcgcgcgggtgtcggctggcgggaggagagaagccgcagcagcggggcagcagggcgagctcgtgctcagcggcgtaagctcgacggcgacaacggccatgtgagggcaaccgccggagtggtggggcgaagaggccgaggcgcgcacggggggtggtgt

SEQ ID NO: 60723 - DNA, 4486 bp, Oryza sativa
accaccttcctcctgagctgtgcaacctccctcccgtgcgcgcgcccggccgtgccgccgcgctcggccaccgccccgctgcctcgtgccacgcccggcctgggcagcctcctctcccacaccgagctcccctcccttatcccaccggtgcccctctcccggcgccatgccaagctgcgccgcgcctacacgccgctgtcgcctcaaccgcgtcgtcgcgtgccggctgcctcgcacgcgaccgcccgcgccgacgccactgccctgagctcccccgtgccggcctctcccttccatcgccgccgcccgtttccgctcgagccaagacgacgccgccgccgagttttcctctcctctcgacagtcgctagctcctctctcctgcaccgccgccaggtcgccgaccccggccacagcctcctcgcaccggtcggcaaccgcctctccccgcctctctcctgcgccgccggcaggtcgccgaccccgcccacggcctcctcgcaccggtctcgctggctccctctctccctttgcctgccacatatgcatctagaggtggaggaaggagagaaaaaaggaaaattaaaatttgtgccatgtcatcgtccatgtggcgtgccacgtaggcaagaccacggtcaaacgcggctttggatcgggatgatacaataaaccaagtttagagacctcgatgtgcgctttgcaagttcgtggacctaagtgaaacctcgttacaagtttaaggaccgctagtgcaatttaccatggtttccgtgtccaactttgactgtccgtcttatatgaaatttttttataatttgtattttcattcttgttaggtgataaaacatgattaatattttatgcgtgacttgtctttttaattttttttcataattttttcaaataagacggacggtcaaacgttggacacggaaactagggtttttcttttttttttgactgagaaagtagtatcttaccaaattgcaggcccactagtgataggatattactaaaaggtttcatgaactctcttgaacctcatcttgccatttcataaagagtcgcatttaattctaccaaagtgatttttatagtccttgtttagccaacctctcctctatagtatgtctgctgtccagactctgttccacagaaccagccatgtaaagaatttgcatttcggtggcgcccaacattttcaaattgtctcattgaaaattgttctcgctgcccctaggaattggagtctgtaaactgtgctgtgtattccctgctcagggtgagcttccagacgatgctgttgtggcgttgtcccaatggggccatattgtgtatcgaggttcatagctcaacttattgtcgaaggtgttctccccccgtaatttggaatgaatttaattgatctcatacacattcttgctgaggtcagggtccatttttggttgaatttttttgtatggtccattcttgaaataaatttctgaaaagatccaaatagtcaaaatttcagcaaagagacaaccacttccctcttcctgttctttcaccttcaccatagcaaaatgcctaatgaaatcataacctttaagcactgattcaaatctaaaatcctgcaggtacttagttgtaatagatgatgtatgggctacagaagcatgggaaactattaaacttgcattgctgagcaacaactgtgacagcagaataatcacgacaacacgtaacactgctgttgcatcaaagtgctcttatcatggaggctatgtttatcatatggaacctctcagctttgtcgactctaaaaggttgttttttaaaagagcttttggttcagaaaacctatactatcctcatctggaagaagtttctaatggaattataaaaaaatgtggtggcctaccattggcagttataactatttctagtttgttggctgatcagtatgcaaaagatgaatgggtgagggtgctagcagcaatcggttttgcacttgcaaaggatcctaatgctggaaatatgagaagaatattgtctttcagttactatgatcttccttaccatgtaagaacttgtttattgtacttaagtctatttccagaagatcacaagatcaacaaacagcggttgataaacagatggattgctgaaggcctcattcatgaagaagagggaagtgcatataaaaccggtgagcattatttccatgaactcatcaatagaagcttgatccaaccagttgatgtccaatatggtaaaccagtggcatgtcgggttcatgacatcatttttaatttcataacaggcaaggcagctgaaaagaacttcaccactttattagatacaacagagttcaaacccatcccaattgacgaacctcgtagagtatatttccagaataacagaaaggaaaacgtcatcatggcaacaaacctgagtctgaaaaatgtccgatcacttactatatttggttactttgtgaaaactccatcattgttggatttcaaagttctacgtgtgctagatttaaaagattgtagaaagttacaaaaccatcatcttactggtatagaaatgttgcttcatctgaaatatttgagtctcggatcaaggtatataactgagctcccaaaaaaactcggagaattacgatatttggaaacactggacataagagagactatgataaaatcccttccatcagcaattacaacattccagaggttagttcgtctacttatcaatcatgacactacatttccagatggaattggaaggatgcaaagcttggaagagttacaaacttttgacatttttacatactcatcaagaaattctttacaagaattcggccagcttacaaaactaagaaagttgagggtgacatggaaccttgataactcattagaagatcatagaacaaccatagaaggttcaatgaaacatttattatctctatgtgacctacattatctccttatctggaatgattgtcctggcctctcactggattcatggtgccctgttactctcagtagcctccgggagttccagatcgaatacggtagcatagctaatgttccgaaatggatgaacatgcttgcatgtctcacagaattagatctcactctgtgcagcacaaaacaggaagatattgatatccttggggagatacctgcctgcttgtctcaggctcactacttctcatggcaccaatggaaggatcttcatcagcagctacaatgctttccgatgcttgaaatacttctttcttcacataaatatgtgtggaacattattggaatttgaagaaggatctatgccaaagctccaacaccttatgatcaagttcaatgcacatagatggaagtgtctgaatgggggctttgatttaggcatccgacatctctccaacctcaccatggctgaggtcattattggtacagattatagtcatggatgctataacccagaggaagagttaatgaaaagcagcaccaattttgctgctagtttgatccagtctgcagttgagacacttcccaaccgtcctgttcttcgttttcagttacagcgtgaagcatgcatacagtttgaagagaggagtgtgaattatgaaatagaggtcaatctaggcgaagtaagagatgttggcaaggtggatcaaggtgaaacaagagttggatcaactaaagagccactttacacgatatttgaggtattaatggattttatcgatcggttcaccatcaaatagttatttatgtttgttttatgatgctttttactactccctccgtttcaggttataagacgttttaactttagtcaaagtcaaactgcttttaagtttgaccaagtttgtagaataaagtagtaacattttcaacccaaaacaaatttattatgaaaatatattcaattattgatttgatgaaactaatttagtattataaatattattatactactccatactcataaaggaagtcgtttaggacaatgtttaagtcaaaccttgaaaatataaatcatgaataactctcaatttgttaagtttgaaaatgtaaaaattatatgtatagatttgtcttaaaaaatactttcataaaagtatacatatatcacttttcaataaatatttttatagaaataagaagtcaatgttatgttttggagactgagtcgctgtcctaaacgacttcctttacgagtatggagggagtatttgtttataaacttggtcaaaacttaaaatagtttgactttgaccaaagtcaaaatgtcttataaccagaaatggagagaccagaaatggagagagtacttagttattttttataatcatactccatccattccataatataagacacaactacattttaaagttgtttcataatataaggcatgtatgcaagcatatcattaactagcacatctttttcactaaaatattattatgtaaatttaagtaaaaaaat

SEQ ID NO: 60724 - DNA, 1091 bp, Oryza sativa
gtttggaataccaaaaagtttgctaggactgaagaatctgtgaaagctattgtggggctagttggggagtttgaagctattgatggggctagcttaagaagggatggtcctataagagagttgcttgcagggatcctagagaacttcacttctccatccacctgtatatcagcaaagttggttatatggtgagatgggaacctgaaggatatcttccttatgaaaacagacagaatcctccagatgaggggatgacagagatgataaagatgatgaggggttaggagaggacatgaaccttgatgaggaatttaaacaaaataccccaagaggtagacaagctgcagatggacgagcccaacaggggagtaggttaggtgctcattctgctccacctgcttttaaggggaagtcacaagtaagtcagggaggaaaaactatgaagaaactagcttccaaaaaagactccttgctgactgtgatggaaggtacagagatatctattatcacttcagagaggaaggctccagaggtatgtgccaatatacctatggtgaaggaatgtaccaccatggtcctttggcaggaagagaacttgcaggaatcccaagaaatccaagatccagtggtgcaatctcaggaggatgttggggggtttgctgctgatatccttgtcttagagagctttcttttggatgatgataatgagaggtgccagataccaacagactctgacattgagagaatcagagaggaagaagaaaaagaagaagaggatagttttcaggaggtttcacacaagaagaagcacagggagaagagatctgaaccggcagtgacctccaggatgagtctttagcaaaacagagatggttgatgtccctataacaaaaagagctgatttttggattttaaaaaaaaatttgaagcttccagatactttttctaacccttttgctatattttaaattttagataattattgagttaaataaacattgcccatagtttctaatatagtgcttggtagctctccttaagagatagataacaccatagaaactttgaaagctaaagaggtggtgcaagct

SEQ ID NO: 60725 - DNA, 783 bp, Oryza sativa
atgggctagagggtggccaccacccttccctgcgtgggccatgccattcgatgtacaacaagaagaccctacccagagtttcaattctctggtgaggcgacatatatatcaactgctaacttatcaaggtacatatgaatatatagcttcctctaccttggtattattctttaattaacttaattccgtgtttgtatcacactactacaaaaatcgtttttctgtacgagggggtcggtaggttccatgcggcccgcttgtggcagcgcctgcaaaaaccgcccccctggggcgggttgattagccgcatgcgaaaataggcccattatcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcctaaagcaagcaccaattagggggggaggttttcaacccgaaatttttacttgaactctatacgaaaggtgaagaactctctatcctgcttcatttggctccatttttgttatatttcgttggtggaaagtggagtttttttaatattttgacaaggtttggtctaactattttttgcaaaatctagcttcaaaatatatgttttgatgggcaaattttgcatgtaatcaattgtacataccaggtacatggaatggtggaattttttttgggaagccaaagccatttaaccttttgtatgaaatacctgcggtc

SEQ ID NO: 60726 - DNA, 745 bp, Oryza sativa
tgaatatatagcttcctctaccttggtattattctttaattaacttaattccatgtttgtatcacactactacaaaaatcgtttttctgtacgagggggtcggtaggttccatgcggcccgcttgtggcagcgcctgcaaaaaccgcccccctggggcgggttgattagccgcatgcgaaaataggcccattatcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcctaaagcaagcaccaattagggggggaggttttcaacccgaaatttttacttgaactctatacgaaaggtgaagaactctctatcctgcttcatttggctccatttttgttatatttcgttggtggaaagtggagtttttttaatattttgacaaggtttggtctaactattttttgcaaaatctagcttcaaaatatatgttttgatgggcaaattttgcatgtaatcaattgtacatactagttacatgtattgttgtatttttttttgggagacaaatgcatttaaacttttgtatgaaatacctgcggtctatttttttatctgtaacttttttgcctttatataattagatggatcggtcgtcatggatgtatgagatgcggagaacgcagccgatatttattaagg

SEQ ID NO: 60727 - DNA, 774 bp, Oryza sativa
acgccgcctagctagaaacacacatgtaaattaagccaatagagggtcaattagaagaattgtttgactaatcttgcctgaattttcgttcttaatcatcctcaacaactcttgttcctcctctagaaaattaaaaaacaacttttttttcctcttcagaacctgctgataagtaaaacaaataaacaaacaaacaagctaagaaataggctcgatgaagtacatttcagcattcagcattacacgtgggatcaaattgaatggttaactaccacgagcacacagagagacagcaagagtccaaaaacccaagctattatgcatcgttaattaattgtactgcatcgcctgctgtactgtctgaaactctgaaagaatagtgatggagcaaaaactctgaataatactagtagcatgaatccaacgagatagacgacgaggatgatcagtcgatcgatgcccacgcctgaatgatatgtccgacgatggtttgatggatttcattcctgtcctggatcgagacgtttgttcttcttcttgtttctgctgctgctagctgccgctttgtttaactgatcttgacacccttttttttttctgatgggtgtttgttttgattgataagaggctactagtaacatgcatgattagggcaaggacgattgtgctttgcatggggaccaagcgtggctaatctctcatgtctcatctctcattgcgtttggagtttttctccacttaccttatgcttgcaatgatgatgatcggcgtttg

SEQ ID NO: 60728 - DNA, 3448 bp, Oryza sativa
gggagcggcagcgagggacggggagacggagagcgagggggcgctcggcgcggcggcacacgcgctcacgcgcgcgcggcgcgcgggcggggcggagcggggcggagggagagaggcgctcggggcggctctcgcacgcgcgggcagcgcgcgggtgaggctgagcgggggtgaaggagcgcgccgggggagggagagagagagagagaaagagagcccgggagagagagagagagagatgggccgagcggaattcggcccatcgaaccccgggggaggcaaactaaactttgcggagggaaatcgatttggaaggatttggattcggatttgaactcgacgatagatcggggattgagatcttgagatggcacgggcactagacaacaagcaaggaaacaaatttcgcaattagggtttttaagagataattttcccgctaggcgccacgacggaacgggcgctacacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacactcggtacgttccccggtccgcggttttggaaattcatttagttcgcaagcaccgacccaagtgtcgggttttccaagtcttttgtaaaactccagttttacccaagttgttactcagattttaagtttgaaggcgaccgtcgatactcgcacagagtgcgcgagtatcgaggcgcaactgggtggttacaaggggacatggtatagcaattaacaatggaaggatcaaatgcgacaaattaagtaagtccgccaatctgcttcgcagatgggacaacagattaagtgtgatcctatcaatgcataatattttgcaagcaacataattgaatttcaaatataggctcaagatgttcaaaggtggcttgccttgctcgagatctggagcttgatcctcaaaatcctcgcactgcgggtcttcgggctccgaaactacacgcgaaacggggcaactcaacaaacagcgaaaataaagccctattaacgacctctaagcgtgccattagatagatctcgagatttgatgaattttggaagttgaacggagtcaaacggatttacggttggaaagatattgaatttctaagattattggatttttggtctaaaggaaaaggatttaattaaatcccttttttttggaaaagaaaagaaaagaaaaggggagagggagggaatatagacttccctcgggcggctagggcgcggcccgagagaaagggcggctcggccgagcttaacgggccggccggcccaagaaggtggcccagagcggcccaagacgcgcgcgcgcgggagggaggagagagagagccggtggaccgggctcaccatgcgcggtcccgggtgggacccgcttgtcagcggctcggctcaccgtgcggagggagtacgcggctcatgcgcgcgagcgggggagggacgcggtgcacgcgcgcgtttcgcggtggacgcggatgcagcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcggagcgaaccacggcgatacgggcaaaagctagcacaccgggcggttgttcgtgatgaggggagacgagccaacggctcggattcgccagagggagttcgacggcggcgaatcgcggcggcgacaaccggcggggagggaagagggaaacgccgacgaggtcacgagggaccgattcccggcggtgagagcatctacgcggtttcgggaactcgatgctagcgtcggattggacggagctacaccgagcgaggctggcgacgtgtgggtgctacggagctcgagcggcgacggcggcgagcacacggcgagcgacggcaacggtcggggcggcgccggctaactacggggagtctactcgagctactaccgaaagctagggggaggagatggagcgaggaggaagaacggagggaggcatcacgaggtgaggaggggcgctgtgacgagaggccgacggcgcgggagggatctctccggcatcgggccggttaagaggaggaagacgagcgcccggagtccccttccgcgtcctagtgcgcaccggctcctccggcacacacgcgacggctgcggtcggcgagagggacggcaatggcgcgggcgagaaacagggaagaatgggagaaaagggaagggagggcgcttgggtttatagggggcggcaatgtcagtttggaaaccgactttggcggtcaaggcgcgagctgtcgctccggctagcggccaaaacggcgacaggagggagggaggatgacgccggcgggaggaaaaggggaaaaaggagggagagaaaggggggctcgcccctttcttctttgggaaaaggggaaggggagcgggggcgtcgaggcagagggaggagggctcggcctccgtcccttggcggcttgcgcgcggagtggcggggccgaggcgatgacgacggcgatgacggcggggcggtttggagcggcgcgacgacacgggcgataggcgcgggctggcgcggtagagggtgacggcggcggcgaccagatggtcggccactcggcacgcgcgcgcggcttgcaatgggagggcgcagcggatggagaggcgcggctcgagcacgcgcgctggctgcggggccgagcggctgcaggcgcggcagggcagcggggccgggcggcgaccacgcggtgcgggcgaggaccacgcgggcgcgcgcgcgaacaacagcgcgcgggggccggctttgcgagcggggagctcgccagggagaggagaaggaaagcgaggggaggaggcgctcggcgcggtgactcacgcgcacgcgcgcggacagagcggaggaggaggagcgctcggcgccgctcccgcgcacgtgcgcgcggcgcgcgggcggagcggagcggagctgagggagaggggagaggcagcgcgccgg

SEQ ID NO: 60729 - DNA, 2143 bp, Oryza sativa
tccacggccatccccgcgagccccactgcgtgcgacgagcgaggcgggggcgctgcgggcgggcggatctgagggacacccaccgctgctcgccacccagtcgccgctcgctcccgccccctgcgccgcccttcctcgctgccgcctcgctgtagccgccgccgccgccagatgcagacggcgacacgctggcgcacggggatggaggcgcggagcatgggtgtcctccttggccacgacggcgacgccgacgcggaggccgtctcggcggcaccttcctcgatagccacgaccgccgccgtggcggccgacacggcgaagctcccctccatcgtggcggccgactacatctgtatgacaacaattaaacagacacaccataaaataagtatgccaagaagattgttttagagagaaacatcaaaaatgcattcgtagtgattacatgaaggctataccttcagcattggcaacaatgtttcccaggtcacccgcatgacggacttcatcttctggtgcaccgtgcgtcaaattgtttgggttaaaatgtggtcctgcaggacaaagttttgccatgtaatgtgagggtgtgtttggataatgggaaatgtgaggtgggattgagatttggaaatgaatgagggttaggattaaatgaaagagtgagaatgaatggttaggatttaaagatgtcttttagtggttgggaaatgatttccctgtcccattagctaaacagggcctaagtagacaggccttagggcacccgcaacgcgcttgcctcgcagcagccgcagccaccgccgccgatatatgcagacggcgacgcgctggcgcacagggatggcggccgacacggcgaagctcccctacttcctcgctgccgcctagcctgatcccctgccgcggccgccgttccgtgtcctcacctgcgccgcccttcctcgcagctgcatcggctcctccgccgcctgccgctgtggcgccgtgcgcgtttagagagtgagaggagagagatgaacacagagagagagaagagagggggggaataatgttataggggtatgacaggtgggtcccccatttttttaataactaaaatgctgactggattcccacgggtaccccaggtagcccaaaactcccgtggattggattgaggggggtaattcgtccggtttgcatagtttggggtaaaaaatatccggttttatggttcaggggtgtaattcggacaatacgatagttcggcaggtaattcgtacttttttccaaaatgaatcggaatggacaaacggaacgatatgcattcccctcccaagaaaaagcacacgcgcgcacacaatgaccgaagttgctaattagcattcgaatgatgcatcattgggtgcgttcgaatgggtgaattcatttggctaagttgtttcacgcaaaactagataagttattaactattataaactaaaaaaaattgttttggagttttttcataaaacgtatcatttaacagcttataaaatgtgtccatagaatacgataaagtagcttgccccgttatccgtaatgggaattgtttacaggactgcagctgctgtagcagccgctgacatgtgggaccaggtccacctatcagcctggcttctgcaaatacagtactgcaaaggatcatgtctcgttgcccgatgctgaatcaaacagactgcagtatacgcttccaccgtcccacgaaccaatgaagcatacgctcagtttcaagcttggacacgaaaaatgaagggcctcaaatcactcaaatcacccaattctcaacacttatatgcacactggtcagatgtattctgcatttctgccagcatcaaagccgagttgtattttccccggagaatgtaacgcggaaaaaaaaaagcccaacaattttgcacaaggtaaaaaagaaggagcaaaatattcgcccatgcacgcgcactagcccttggcgtgcgcaacgctcagctcaagccgcaacaccttcgccgcggccgcgccaccgaacagccgcggcgcgcacagcgcgcggagcacgccatccccgcccgcggcgaacgcgaagtcgcccgtgccgcccaccacccgcagcacctccgggtcaccgcactccccgcgc

SEQ ID NO: 60730 - DNA, 3613 bp, Oryza sativa
acaagtgtgatttagattggtataaatttgagtacttcaagtgctgaaaatctgatctcacttcttcaatcagagcacggcatggagagtttgtccaaggaacgggaggcaatgatgatagcgttgggcattttacaatctcaagctcctttagtgtagggaattgagtgctgtccatctttgaatatggcaactctataagttctgggcaatctcttactatgaacacttctagctgagagaacacacgggaagcatcatttccggtccatttttctagtcgcggtatgccaactagctctaacctttttaaattccaaaagctttggccttctatacaactcaaggatttttcactgtgctggttaaccaaccataactcccctataggtgggaatttgttccagtctagaccatgcagactaagagattgcaggcctttgattgacaagttaaaacctaaccatgatgggcaagtggcacctccatgcccttcaatttgtagctcttgaagattgttatgtggcttaagactttcaagaatatgttcatcttgggaacaatcctttgttgaccaatgtaatattaacttgtgcaaatgacttttgtttaaaagttttgcttcgtccgccgcctgtgcattttcaagattataaatgcctagtgttccgttcagctccaactgtcctaactgtcttaatgcaaatggctcactttgtcttttcactttaaatctccttagttcttgtaaacattttaacttacccacattagcaacgtcagagtggagattgtcatcggggacaagaaaatggcgtagccttacaagattatctatatctcttggtaaaccaaagtgaccattgcattttcgtacatcaaggatcctcaagtgataaaaccttgaaatggtgttgggtagccttatttctggaaaatatcccctaataatccttaagtagcgcaagtggacgagatttgaaaagttgtgcaacatattctccactgcatatgatggagtagacaacaagatgacgcggagtgattttgcgttacttaacaaatcaccaagaggactgataaagcttccatggaatcgtccaaatagcataaaagagtgtagcttttcaacatccagtctcttacttagtgtgctgaaatccgtcttgatgctttcaaaagtcactctatcatttacatccatgtcatctatcacaatagacaaatggcgtatagatggtggaatttgcacaaaccttacgttagaactactgacagcaagacattcacaggatgaaaccttcaatgctaactcatgtagtagatcatgcatactgtaataaggagacccatcttcattcacattttttttgaaaaatccataatcaaccaaatcattcaaataactcaacccaatatcttcagttgttttgttttcatcctgggaatgtaaaatgccttgccctatccacaagtgaatcatctcctcactatcaaacttgtaatcttcagggaacaaagcacaatatgtgaaacattgttgtagatggaaagatagatagtcatagctaagcttcaaagctggcataatatcattttcactagtttgtgattcccattccttactttctaggaccctcatccaatcatccaaatcaaggtgatttctcagcaatctacccaccgtttttgctgccaaaggagagcccttaagttttttcactatcttttctcctgtctcaagtaagttagcatgatcatctattgatttgtcatcaccaaaaacacatgcttggaataattcccagaactcttcaggttctagcccttccaattgtattggtcgatcaaatgttttcaccatttctgcaaccactggaaatcgagtggtgactagaattatgtttccctttgtcattgcttttctgaggggagctaagaactttttccactcatcctcattatcacacttccacatatcatccaagacaagaagaagcttcttagatttcaatctttgctcaattgaatcatccatgtcgacatatttctcatcatccttgagtttaggtatccactttgagatctcttctttcaatctatacagattgaaattgagagagacgcatacccaaaccttaacatcaaaatggttatgtacttccttgtatatgtgctgagtgagagttgtcttccctattccccctggaccaacaattggaatgacggtcaaatccttgtcacagtaatcaccccgagtaatgtcctcaataattctacttctatcacccttcctcccataaaattcagggtctataatccctgaagtagttacaggacgattcatagcaacgttgcttggatgaactagcgtttgccctggtttccttgaaaattcaccattgatactgatggcaatgcatgattccaacagctctagattaaggattgtagagactttggcacatacgggcttcaattgttcgacgatgtgcttcattcttgtggacagatccaccctatcgaacttcagctttggtgttttcatggtagatatgtgcaaggcaccggagtcatcacaattgtcaagaccaggtgcaaaagggaagcatggaaggtgtttaccaacgagatggatggtgctctgagcactgcaagcgaggatgcgcatgcagccgctgccagcaacagcctcctcttcgttggcgtggcgactcgcttcctcgtcaccaccgcacgagcaagaggcagagaggtaccttctcttgatgtttctggcagtgtggtgagcgttgagcacaaggccaaggagacagccgctggcatgctcatcggcggcctcgtaggtgccatcgagctcgtcctggatgcggaagtagtcgagctcgtcgagcacgtcgtcggcatcataggcgaggccacggagctccaggagcagctgctgcagcgcggggttgctggtttctctgccacgggtgttgtgcagcatcccctgcgcgtagagcagctccatcttgatggcgccgacgtttggcccgagctccgtgctggccgcccacgcctccacgaaccctcccgacagcgggctcagcgccttgccaaccacccaccgcgccgcgttcacggccgccgactccattgatctgtctggtctctactccgctagctaagctgaggagagtgggagggatggaagagctgtggactgcgagagaacaaagcagtccaggagtagtagagaagggaatggtgaatagcgagcagacagtgaagtgaaggactaccaaaccacggcagaagtattgtttgttttctgaaccctctgttcgaactttaccaaatggtgttctcaaaaatggatttaaaaaaaccaaagtcgtcctgctcttcttgaatctgatgccattccgtgccatttggaagataagaaaaaaactaaacgtctaatcagcccccaaaaccataattagaacgcaatagtaaaggacaggcggtacagccaatggatttacttaaatctgttgcgattgcaaaggtgcataatgccagattcgccactgttcattcagtaaactaccgggatagagcaatttgcctgcatgtgggatgtggc

SEQ ID NO: 60731 - DNA, 845 bp, Oryza sativa
  unsure (1)..(845): unsure at all n locations
agctatatctagtctgatgcctgaggtcgactctagaggatcccatggttgcggttgaggattacattctttgtggttttcttcctccgccctccaagtttcttctccttgtcttgaatttttatggcctttccttgctccatctgaaccccaattccatcaccttcctcagtatcttctcttatctttgttaggcctacattggggtagagccatttcttggtctctttcgcttttactatgagttgcgctggatggaaccgaaaaaggtatccagatgtgtcggtttccgacttcgggatggcctgaagtcgcgatacatccccttccagtgcccctcttctcgtagcaaatggcgggcgaggtgattctatctccagatagagaactcggatccagtcttttgtgttcctgaggagcaaccagacaagattccggagtggaccgccaaacctgccctaactccctcccttcagtctttcatcgacattatcgatgacctncgagtacgcgggttgttggggtatgaagtcgctgccgactttcatcgtaggcggatccaaccgctccaggcccgagcccatatggcctttgattattcggggccaaaggacgcgacccgggtttctcctcggggtatttntcttgtatttagaattcattctttatngtgcatgtnctnctgacttatcgagtgcttgttctcgatcctacaggtttgaacagcgaaatcgtggagcgccgtgccagtcaagtgatgatcagcggtcctacaacggngaagcacaatcccgtncccattttgcaagaaagggaaggncnantgcattggctgcgaacaaaag

SEQ ID NO: 60732 - DNA, 2089 bp, Oryza sativa
atttggggatttgttatttttagtaaatttgtactccaaatttatctgaatgtggcatcgcacgagtaacataatattcccagatactctttctttgaattacttttttactttttaaaaaatgtgtaaatgagatgagagagaggggtgtcggtgaggctccatgctagtagctgagtttgactgaattttgtacgcaagggaaaggtgtgagatattaaattcatgtgtagccttttcatgtgaagcaagcacaaatgtagagcacaaatgcggaggtgccggctgcaactgtgcaatgaattgcgtgacatttttaattccgggcgttacgtgacttgtgaagaattagtgggtcactagtcataacagtggcagtagtgtagtagcaaccgttaggcttaattgtgtagtactagaaaattaagagtttgatgtaaactaatcagtactggtacttaaatagagtaggtgttgagctgagcaagcatacagtcagatatatgagtatgcaacaacattaattaagctttaatatatgacaaatatttcactagctttatcatgaaaattgctttcatgtttaacattttcttggtactactcatatataagtggtactgtggtagagaaacaatgatcaaaacatagaattgctcatatgtagttttaatatatgaaaatgaatcggagcatagtttgtggtaatgagtgaggagacgattgtttaccgggattggtgaggccttaacataaaggtcaacacaatcattaaagcgggtgggccccccctctgcgggccccaccaactttctccccccccccaaaaattttcgccaagtctgttctgtctccgggcaacggctggcgcccccccagaccgcggcgccacggtggctggcgccgccctcctcccccaatcgaagcccttctgtgcgcgggacattaactatccctgtcacatatgcaattctgtgcgcgggaaaagttgcatgcatgcagctgcccgggagaagtttgcatcgaacagtgacgacgcgctatcaatggtcgagatttaatccctcgatccgatggctgggacgagcgtccgatttttttctcctgatcggacgtccgatccgtaggtctctcctcttctttctccctgtaaagagaccgcaacagcttctgtaatagtgttggaaagtcttctcttaatatagtcaactgtcgtagttaacagtttaatacgattggtggtggggggggggggggcattagagcaagtgtaatagtagagctaattatatagatccacattagagttaatatgtacagtagatgagctatacatatttaatgcatttatcttgaaatatagtagcaaaatactcaacctttgctttggacaaaataaaatatattataatatgtaatagacaaaagaattattgtgtaagaggtaattttttctgggcctgtattctttttctaggttcaataggattcttagtggttggggctttcagttatcttggtaagaatattatatctgtacttccatctcaacaaattcttttttttctacagggggtcgtgatgtctttctacggaatcgcaggcctattcattagtgcttacttgtggtgcactattttgtggaatgtaggcagtggttatgaccgattcgatagaaaagagggagtatcacctgtttgcatttttgaatatatggtattcacgtgttttaactaaatatttagattgtttcataatattagaaaatatcattggtaaatttgtaaaaactataaaccgtggtggagtgccagatttactatcaccaccactagagacttttaaatgagtatatatacgtagagagttagcttttatatgaaagctaatcattttaatttttcaagttctattctccgaataactttataattgatttaggcttagtactccatattaaacttgaactcatcatcgtcatgtcggctgacgacccagcaaaactccggtccaaagccggagggcatccgcgacgacgaacacgcacttgtacttgctatatagctcattagcttgtactccctgcagg

SEQ ID NO: 60733 - DNA, 9394 bp, Oryza sativa
cgccgagcgctcctcctcctccgctctgtccgcgcgcgtgcgcgtgagtcaccgcgccgagcgcctcctcccctcgctttccttctcctctccctggcgagctccccgctcgcaaagccggcccccgcgcgctgttgttcgcgcgcgcgcccacgtggtcctcgcccgcaccgcgtggtcgccgcccggccccgctgccctgccgcgcctgcagccgctcggccccgcagccagcgcgcgtgctcgagccgcgcctctccatccgccgcgtcctcccattgcaagccgcgcgcgcgtgccgagtggccgaccatctggtcgccgccgccgtcaccctctgccgcgccagcctgcgcctgtcgcccgtgtcgtcgcgccgctccaaaccgccccgccgtcatcgccgtcgtcatcgcctcggccccgccactccgcgcgcaagccgccaagggacggaggccgagccctcctccctctgcctcgacacccccgctccccttccccttttcccaaagaagaaaggggcgagcccccctttctctccctcctttttccccttttcctcccgccgtcgtcatcctccctccctcctgtcgccgttttggccgctagccggagcgacagctcgcgccttgaccgccaaagtcggtttccaaactgacattgccgccccctataaacccaagcgccctcccttcccttttctcccattcttccctgtttctcgcccgcgccattgccgtccctctcgccgaccgcagccgtcgcgtgtgtgccggaggagccggtgcgcactaggacgcggaaggggactccgggcgctcgtcttcctcctcttaaccggcccgatgccggagagatccctcccgcgccgtcggcctctcgtcacagcgcccctcctcacctcgtgatgcctccctccgttcttcctcctcgctccatctcctccccctagctttcggtagtagctcgagtagactccccgtagttagccggcgccgccccgaccgttgccgtcgctcgccgtgtgctcgccgccgtcgccgctcgagctccgtagcacccacacgtcgccagccttgctcggtgtagctccgtccaatccgacgctagcatcgagttcccgaaaccgcgtagatgctctcaccgccgggaatcggtccctcgtgacctcgtcggcgtttccctcttccctccccgccggttgtcgccgccgcgattcgccgccgtcgaactccctctggcgaatccgagccgttggctcgtctcccctcatcacgaacaaccgcccggtgtgctagcttttgcccgtatcgccgtggttcgctccgccgctcgccgccgccgcccgccgtccattcgcggccgggtcgtcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgctgcatccgcgtccaccgcgaaccgcgcgcgtgcaccgcgtccctcccccgctcgcgcgcatgagccgcgtactccctccgcacggtgagccgagccgctgacaagcgggtcccacccggggccgcgcatggtgagcccggtccaccggctctctctctcctccctcccgcgcgcgcgcgtcttgggccgctctgggccaccttcttgggccggccggcccgttaagctcggccgagccgccctttctctcgggccgcgccctagccgcccgagggaagtctatattccctccctctccccttttcttttcttttcttttcaaaaaaaaaggatttaattaaatccttttcctttagaccaaaaatccaataatcttagaaattcaatatctttccaaccgtaaatccgtttgactccgttcaaattccaaaatttctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagccccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgtgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaatgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgtagcgcccgttccgtcgtggcgcctagcgggaaaattatctcttaaaaaccctaattgcgaaatttgtttccttgcttgttgtctagtgcccgtgccatctcaagatctcaatccccgatctatcgtcgagttcaaatccgaatccaaatccttccaaatcgatttccctccgcaaagtttagtttgcctcccccggggttcgatgggccgaattccgctcggcccatctctctctctctctctcccgggctctctttctctctctctctctccctccccggcgcgctccttcacccccgctcagcctcacccgcgcgctgcccgcgcgtgcgagagccgccccgagcgcctctctccctccgccccgctccgccccgcccgcgcgccgcgcgcgcgtgagcgcgtgtgccgccgcgccgagcgccccctcgctctccgtctccccgtccctcgctgccgctccccgcgtgccgttgctcgcgcgcacccgcgctgccgcccggtcccgccagcccgcgcctgtcgcccgagccgcgccgttcaaaccaccgcgcctcccgctgttttcccgcgcgcgcgtgccgagtggccgaccgctcggtcgccgccgtcgtcagcgcctgccgggcctgttggcaagtttgccggttcggttcaaaccgccgccgttatcccgttgttatggcccggccccgggccattccgaggccaagccgccaagggacgaaggccgagccctcctttccccgtggggggtcacccccgctccctcctccttttcccgatccggcaaaggggcaagccccctttctccccctcctttttcccttttcctcccgccggggtcatcctccctgtcggccaatttggccgatagccggagcgtcagctcgcgccttgaccgcgcaagtcagtcctcgaaccgacattgccgtcccctttaaacccccggcctccccttacccctcctcttccattcgtctccgcgctgttgccgcgccccgtgctctgtctcgcctccgccgtccttcgccgagcgccgggagagccggtgcattcgaggacgcggaaggggacttcggccgcgccctctccttccccttccccggcccgaggccggagagattactcccgcgccgtcggcctctcgtcacagcgcccctcctcttctcggtgatgtctctctccgttctccctcctcgctccgtctcctccccctagctttcggtagtagctcgagtagaccccccgtagctagccggcgccgccccaaccgtcgccttcgctcgccgtgtgctcgccgccgtcgccgcccgagctccgtagcacccgctcgtcgccggcctcgctcggcgtagttccgcccaatccgacgatagcgtcgagttcccgaagccgcgtagatgctctcaccgacgggaatcgacccctcgtagcctcgtcgccgtttccctcttctcccgccgccggttgccgccgccgcaatccgccgccgtcgagcaaacctccggtgaatccgagccattggctcgcctccccctgtcgcgaacaaccgcccggtgtgctcgcttctgcccgtatcaccatggttcgcttcgccgctcgccgccgccgcccgccgtccattcgcggccgggtcgtcgtctaccttccgccggcctgcatggcagccacgtaggcgccacgtcggcgccagctcagcctagaccgggtcgagccgaccccggtcggtccctccccgtgcgcgcgttccaccgcgagccgtgaggctgcgcgtgggcccgtcgcatccgcgtccaccgcaaaccgcgcgcgtgcaccgcgttcctccccgcccgcgcgcgtgcgccgcgtgctccctccgcacggcgagccgagccgttgacaagcgggtcccacccgggaccgcgcgtggtgagcccggtccaccggactctctctcccctcccccgcgcgcgcgcgcgcttgggccgttttgggccggccggcccattaagctcggccgagccgccccagatcccttgggccgcaccctagccgcccgaggaaagtctaaatttcctccctccttccttttctttctcttttccaaaaaaaaagggatttaatttaatccttttttccgttagaccaaaaatccaataatcttagaaattcaatatcttcccaaccgtaaatccgtttgactccgttcaacttccaaaattcatcaaatctcgagatctatctaatggcacgcttagaggtcgttaatagggctttattttcgctgtttgttgagttgccccgtttcgcgtgtagtttcggagcccgaagacccgcagtgcgaggattttgaggatcaagctccagatctcgagcaaggcaagccacctttgaacatcttgagcctatatttgaaattcaattatgttgcttgcaaaatattatgcattgataggatcacacttaatctgttgtcccatctgcgaagcagattggcggacttacttaatttgtcgcatttgatccttccattgttaattgctataccatgtccccttgtaaccacccagttgcgcctcgatactcgcgcactctgtgcgagtatcgacggtcgccttcaaacttaaaatctgagtaacaacttgggtaaaactggagttttacaaaagacttggaaaacccgacacttgggtcggtgcttgcgaactaaatgaatttccaaaaccgcggaccggggaacgtaccgagtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcgggtaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgacccgggttagtaatgtcgtgtgggtaaagcgtaccccctctgcagaggtcattaaactgttcgaacagccgtgcccacggtcacgggcggatgtgaggtgattcctagcgtagttttgtttgactactgcttgtgaaattgccgttgtgaaaatgggttcgatgtttgaaaaatctgtagctgatgggatcagctaggcccgggtggccgttcgaaaagttgttggcccgggtggccgtttaaaaagtggttggcccagggtggccgtttaaaaagctattggccgggtgccaaccttgtttcaaaatctaaagactgatacattgcacatactccgaccggacaagacgcactgtctcatccgtgtcgtttgagaagcactcacttagttgcttttagaaaataattcaaataaaatcaattgcaaaaacaacagcctttccttgaagcctgcattaaacacttatttcccctggcttgctgagtactcccgtactcacccttgctctatataaatattcccccccccccctcagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatactctgtctccctgtgataccagcactgtttcctgggactggtatcgattaacaggttaatttggagcgtcacgggctagttccggtcgggactagttcggggcgtgacactttgcttccgcctccctctctctctctttcaggaccatgtcgttgccagtcgcgttcatgctattcttattttattcgttgccaacctccaccatctatggacaagacacatcatgggacacattcttccatcttcctcagcaccatttggtcgcccgagcaccggcgcccatctttcctcctcttttgtttctcacctttggttatgaaagacaatgaacattgcgtattgtgcactattccttcttggtccagtccaaccatgcttctagaccactcacataatattgagatcataaaaatagaacatgaaaaattctaattatgtcaatgaaacgggcactcatccaaaattaatggattaggttttcatctatgaggtaaaataagttttttttttcaatttctagctaatttcagtttttttctatttgctgtattagttttagcactatttgatccattaaaaatttattataatttataatttttctctgtattgaattatttatagctaaataaaaaaatggggatttagttatataattttcctaatattgaaatatcattccggccaaagttatttgcagtttcatgttgttattttattgattatattttcttcatcatttatgtctaattgtgatatatggtttaggattttaatttgtgtcaatgaatgctaatccattgcaacgcacgtgcattatgctagttataaaaaaattgcttgaaaaaaatcatattaatccatttcttaatttttaaataatgcttaattaattatactctaatgagctgctctgttttccgtcctaagggtctgatgcttggattaatgagcaatcgattgcccaacaagcacctcaccttgtggaggtagtttcagctcgactgcgacgctcccgaatggtggcggaggccatcctccataggcagtggacgagggacataatccaaggtgcactgaccatgtgactgatcgttgattacctctgtctttggccagtgatcgaggctactactctgatccccgacgtcggcgaccagatggtccggcgatggtctagtgatcatcaatacttgtcgagttcggcctaccagctcttcttctccggcatgcagccgttcccctgctggaaagagctttggcgggcttgggcactgcctcgatgtaagttcttcctctggctcgcacttcagaagagatgctggatggtggatcgactcctaaagcatggcatggcctagacacacatcctgcccttgtgcagccaagatgccgaggacgtcaatcacgttcttatctgttttgtcttcttgaggcaagtctggcagaaggtgttggccatcgcgaggctcactcttgctgcgccaatggaccaagacgacctcgtcgactggtggtccagtgctcgatgatcagtggacaaatgcaccttgcctagcctcgactctctcatgctactttgtgtcctggtgcctgtggaaggagaggaatgctcgggtcttcgacaacaacctatcctcaattcaggcggtggttgatgagatcttgcaggaggttgctgctagcatagcgcgatcgtgtaaatgtatttttcacagcttctaacatattgacatgcaaaacttttgcgtgttatgaaaaaaaatattcaggtaatgttcattcagcttctgagcttcagctcgacttctgtcagccatttcattaatcagacttgttaccagactgatgcatcacaaccctttccgacattgcactgtctgaatgacgtgcgtgtagatggttacagattgcacatttcaacttgcttgatgacgccgccctgcagctttgtctgcgaataattttacaggcatgtcgatgcaactatgggagaagttcgatagagaaatggtagtaatctgcaacaataaaacatctgtccccaaaatcagtactctgtctggtttagtggcaaaaggatgccttcttttttccctgaactcctaaagcatatactcctatataagttaaaaaagaagagaaaaaagaaagccagagaacaggccattttacaaagagagatagagaagagtgatatgatatctgcagccatcatctgattttttttctttgaacatttgcggtatccccttctggccagtctgcaaaacagcccgggccaagtcagataaccatgcgcgtcatcctcccggtttacttataataatggaaagatatatcagccgctgcaccaccacaacctatatggctatattactagtgaaataacaaagtacatatgtttaaaattgtaaatttaccagacagggtgtagaaaatgtcccttgtaaccagcagcctccttgactccttcgttagggacttgcaggctacacctactgcagggaaaacagaacttaggtgtgttttacagtctttccttggcaaaagagatgaaacaattatctttagaaagccccttacatgaaaaaaagaaagttaatgcaggagcaaactatccagctaaggatgccatagtacttctgggctgcaggaa

SEQ ID NO: 60734 - DNA, 1320 bp, Oryza sativa
tatagagccacacacaacatccacatcccaacgaaataccccagtgaccacagctcacactcatcttaacccattcataataagctagacactactggccggccagctagctgtggcctctgggctctctataaagaagaaagagtatgttgtgtatgagagagagagagagagagggtatgaagaggagaggtggtgatggagggagaacattagacatgaaggatgaagagacgtcgacgatgaaggagcggggcgagatggaagatctgtgctcaaggcttgtctctctcattccacaagactacttgctgctggaaaccacctcacagcaggtactgtaaattagcaaaactttttacaaatttatatcctgctggcttatatatatatatgattagactagaaaaaatgcccgtgcattgcgacggatgaaggttatttttattttattattgttatacagtttaattaagtgaacttcattgggggaattcgcttaaaatcatgagttgtaattagagtccgatcgtctcaagttagcatgcgagtttttttaagagattttttatagatcaactcttatgtatttccaaaagcaaacaaacttaataaacgactcaaatacggatatgtatttctaaaagtgaacaaacttgaaaaccgactcatacacagatgacgtaccaaagtactggcaaaaacatctttaatttttataatagtatagatgtagatatagaagaaatagtgcattggtgatacaagtcgggttagaaagccgggttaacgaataatctgatttccaaaagaaatgaaaaagaattagctgctgctgctctctctctcgtttgcacttgtttgatcattaaagagattttacatacacaaaacaaatttttactacatgcaatctatgaacgtttttattataaggttgagatcaacagaatcagttaccaaaaaagaaaaaaagattaacataatcgggtatggattctacatggtgagatattaaaaaaagaaaaactatatatggagcatttatgtagtttaacatgcgtttttcacgtcatacaagttggagaagtggggaaacattttttattaggaagggatgtggtgctaattatgtactcaccaaacaatgtcttcttagaattttgactagtatgggtcctatctgggcatatgaaaatgatataaccaaatttatcatggaaattctttcatagtacctaacttgtccagatttgtgcaagaaaattcgatggtgaaagttatgttatgttgactatagaaaataaaatattagagcaa

SEQ ID NO: 60735 - DNA, 2937 bp, Oryza sativa
  unsure (1)..(2937): unsure at all n locations
cgtgcgttaaatacgctcgccgaccgaagcgacgttaccatatctccaggcgaagcaaatcggctcgcccagatttgtgcgctgctcaggtgatgtggcagtcttaaagagaccgcccattattgacagccaagttaccattaccgatgcgcatggtttgagaccgttgggtttctgcccaaccatggagaccggtcccacctgtcaccaggctttaggagtggcgtcacgcccggccacttcccatgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggggtcggaccactcctgctcgcccccgagggccggggcgccccgacccctcgcgtttctactccacgtgtatgagttaggtgagcacagcggggctcaccttaccgcatttattgcgcctcggctaagcgtgtcacgccacacgaagtgcagtgcagtgcactcgattatccggtctgtgaccagtcacagaccggtcaaatcgcgggttaggtggcgacaggcggtctgacgcacacttcgctccatcccgtcaagacgagagcttctaggcactcgtccccggctggagctagcgtgttacatcccagagatgacacgttaaccccgatcgatatatgccaggcttcatcccaaccattacaagcaagatgttatttgaagaagggcaaacatgcacgttgctaaaccgacgcgtggtggacaagaatgaccgatttgtgaccggtctgtcactgctcatgtcgtcagcacacagccaccttcccacgacgtgctcgcctcaggcagaagtggaggtaggtgtgtgctgtcccgtcaggaggatgttcggaggacgaccgtgcaaatcttcgtccatttatggagagaagaaaagtccagtttggaaagggaggggtgcatgtggtatccccttaaaatataaaaggaggaccttggccagaaaaaagggggggatggctgccagattcagaacctagaacaagggagaggttggctcacactttgtagctccttgatacatagatccaccaaaacacaggagtagggtgttacgcttctcagcggcccgaacctgtatacatcgttcgtgtttcgtgctctttcgatagctggcaatctttccacatacagagagagcttgggatcatcaccctgagcccccggccgaaccggcaaaggggggcccgtgcggtctcccggtgaggagccccgcgctccgtcatttggcgcgccaggtagggggctcagcgtgtgttttctgagctctcgtatttttccgtgtgcgtcaagtttttcttgatcagcctcatggctgagcaagcaaaggcgcccgacctctctcccagtgtgagtggcgacgacggggagccgaacccacgccgtcgagctcgtactccaccgccccctccacgccaaagtcctaagcagggggaggtgctcgaaagggtcgaaagatccgcggcttcaccgatcgcgggcgatggaggagaacggcgagatggggaccgtcgcctcctcgtctacggcgacggcagcacgccccagggcgcgctccaagctgcgggcgcgctcttacgccatccgcctgtcgtccctgacccggagtctccagcccaacgatggctggacgatgtggccaaattggtcatgacggcgcggcagcgcctagatgctggtgggcggtcctccgccaccaaggcctctggtgctgctaccaccggctccgcgtcgtcaagacagagggcacgacgagcggcagccgctgttcgccgttcggctgccactccttcgtcgactccttcgacccggaaagatctgcgtggggagcaggacgcccgcgccagcatcaagcgccggcgcaatgaccgaagtgctgcccacgcaacggagggcgcttcctcgtccagagtgtcacctcgacatggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttcttccctatggccctgaaggggcaagcgcggggttggctaatgaacttgccacccgcgtcggtccactcttgggaggatttgtgccagcagttcaccatgaacttccagggcacatatccgcgcaccggtgaagaagcggacttgcatgcggtacagcgaagggacgatgagtcacttcgatcgtacattcagcggttttgtcaagtccgcaataccataccatgcatccccgcacacgcggtgatctacgcattcagggggggcgtgcggcacaaccgcatgctcgaaaagatcgcctccaaagagccccagaccaccgcggagcttttccagctcgcggactgtgtggctcgcaaggaggaggcctggacctggaactcctccggttccgatgtggcagctccggtcgcccccgggtccgccgctcggtcagggcggcgggacatgaggaggaagaagaggtcgggccattccgacgacgagggtcacgtcctcgccgtcgagggcgcttcgcgggccacccgaaaggggaggcctgcgagcgacaaaaagaaggaggtcggcgctcccagcagtgagcgcccgaccggcaagtggtgttccgtgcacaacaactcctccacgacctcgcggactggcgcgcggtcaaaattntgctg

SEQ ID NO: 60736 - DNA, 877 bp, Oryza sativa
  unsure (1)..(877): unsure at all n locations
agtgatgttaacccnattgnatagacccactcgngcangcctgcaggancgactctagaggatccccgacttgtatgatcatgtatagacaaacaaccatgtaagaactggtcatgtaagagttctcgccgtgcgtattaaccaatcagaaactaagttttccaacttcacggctgggggctagggtcagagctttttcaactgaggtaggtcaagggtccaagagccttattctccgagaacgtttctccgacgacaaggctgggggcttgggagagtgtatgactcaagtgactgatcgaagtcgcgaaatgagaaaacactcacacagcacatccagagtaagaaaacttagttagatagatcccttttctatttcacgagtacttcttacaattcataattgctccaaaatatattacacgtctccttgagataatttttataggatataaagactaccaggaaggccaacgccagtccatggactggaagactttctctttaagcggtgccatcgacttcgccagattatctatctctgcgggagtcctccgagaacgtgaaaacccttcgtggaggaactcgaggtgcagctgcgggcagtgatctcggatacaggccagcacgtgccctccagcatatcggctcgatcgacgacactcctgcttcagggccctggatgatacgcttgccgatgccttcaagcttgacgcacgccccgttcaaccacgagatatacccaccnccccgactcctccgggattccaaccggggnacctcggagctgctctgcagacttccaaccatcgcttgaacacagcttctgaaggtccgagttgaaccaccacctcgcgacctctcgagagcttccccg

SEQ ID NO: 60737 - DNA, 17132 bp, Oryza sativa
agggagccggaggttaggaatgcccttgccaggtggggcccacctgtcggccggctcggggggaagaaaagagaagaagacggttgggggagaagatgacaggtggggcctcgggttgacggggaggcaaagcagacttgagggagagagagagccgagcgggccgagggagaaggccggcccgagagggagagagggggggaattgggccgaaaggggcccaaagagaggagggaggtttttatttgttttctttttattttaattggttaaatgatcttcgtgactttaaaactatttctcgagctccgaaaattcacggaaaattccggagagtacattagggcacaaagaatattacaaaatattcccggccaatgatttttaagggaaaattttaattctcccattatttcacttgattaaattgcttaactttttattcaatttctaggaaatgcatcattaaatgatttttaatcccgaacgaaaatcggggcgttacaggttagccgattcgtagcctgcccgccatgctgtggctgatcccttgttaacaaccaagggttcactagctgtcctagcatcatagctagtgtagcaggcaaaggagtcgacgctggcgccgtcggctgagttgtggatgcaacggagggaactgcttgaacagatggctgaacatcggtgatcaaagattgataatttgggaagacacctccttgcaagtaaactgggcctgcagcctgatgctcagctaccgaaccatcggctattgtcttcatcatgtttgacaacgtattgactaataccccggactgattgatcaaagcatgatgcacagcgtaatcaacccgatcttggaagttattgaaaaaatcttgtgctagttcactattctggttaagatttcctccttgtggctcctgggcgtcatcaccttgaacgccatgaactccttgagaattgtcgccttgatcgctcgaggagccgttggtagcacctttagtactcggctgagtcgagccgcctggagcttgtttcacttctccatctttagaagaaccggtcccaggactatcagcaaccacttttattttatacttctgaacaagtatccccttgcgggtctgcataaatgagttcaggaactgatcccgtgcctattgcagggttgcttcaaactccgccttctgctcaggcgtgaatttctctggatcgatcggcatgacgtggtcatcaatgatgtcagtcaatccctgcttcaacgccttgcctttaacggaacctgggctagatagtggtggtggttgtttctcggccatgaggaagaactgacgtctaacttcttacatgtcccactgggcgtgccaaaagcgtgttgacagaaaacacgaggcctgggagatctacttaacttcagtgcaggtccaaagctcgccttcgaatgtatgagcgtgccagttgatttgatcctgtaatcaacaagaaatagaagcaaagaaaccgcaattaaatctataaatgatagccgatcggctaggtgccaatgacacatcatttatctttgagctgatgtcatatgaatcgatcaacgattataaataaatagtaaggaactaaatctattcgatcggctgtagatattaacgatatatagttcttatattaatatatacttaaatcaagtgattgggataggtcggtcatcatgccgagacagtataaattacttagatcgaaatatatattaataacagcattatatatgtctatagcataaccgatcagatagatctagcgtgtatcggctaatactccgatactactctacatcaagatattaaaacatgtataatgtattaaacagaagcttaatatatttagattgcaacgatatcttgacacagagggcggatttaacatgtcagtgaaacatatagagcgaatatggttaaatcagataagatcggctgaaactccgatactaccctaatcggcaaccaaagtacaggctagagattgatattctaagcatgacttaatagatcaaactcaactgatgcagcattaagtatgaaaagaagaacaatatctagacaatcaagccgctggaagtttcatagaggtagatatcttatataatctaggtcaacgtcgctatttaaccaaatcggctgccttctgttaacagatgttagccgattgtaggttagatgacaatattgtcgaatattatgtaagatatatgataacttgacgaattacatagacaagattagagtatcataaagatggaagcactaatcccgagaacataattcatcataacaagttttacctcttgttgaagatcgaaaccgatgcagcacaacccgaaagcaagaactcgtcaaaataaaactaaagcaaaaaggtggcgatgcgccgagattgtattgaacgtgtatgttgttaattacatagggctcagggtctatttatacccgagaattacaagatatgcccataccggacacgactattatctctaacaaactctaagataccataagtctttgcagcagacttttgcccgtatttatctataaggaatttacataagatatcctaattaatagatacaattgccttcccaggactctatccgtgcgtggcaatcatcttgaggtacattaacttgaacccgatgtcgtgtacaagtcatattgtcggaaccggctgtatcggcttacttagcccgactcagacccagccgatcctaatcgtagccgatctggactccagccgattcctgctctgtttctgaactcgatctccgcctccgacttcgctttgatcaaatcttctttcctgacacagatgttaccaaatttggtcgttaacacccgtgaacccaaaaaccagacatcgcttaccctaaactttcaataccggacgaattacccctccccccctcaatccaatctagagcggttttgtcctacgtggcgtgcacgtggcaggtccaatcagcattttctgttttttaatggtggggcctacatgtcatactctctcacctcctctttctcctcttcccctctctcaggcgtgggcacaggccgcgcgacagcgggcgttcaggtgagagaaagggagagagagaggggaagaggagaaagaggaggtgagagaatatgaaaggtgggcccaccattaaaaaagagaaaatgctgattgaacttgccacgtgtacgccggcactggaaacggagacgggagcggcgaactccgggaggagccggagttgtgggcggccacggcggagaacccgaaccgcggcatctggtcggcatagacaacgagcagccgccccctcagcacgtcgatagtgagccgtagtgcgacccttccgacggcgtcggagctcggacacgccagatacaacccgctcctcctcctccttccccaccgccccgacgcgcgtaaagctcggacacactggcaccaaagaaatttgacacgagcatccgtcgacccttggcgtcccacttggtgcactctgccataggacacccaccgacggtgcactccaggacggtgaccactgtggtggccgccagcaccatgatgacgagcgcaacaaagggggaggagaggggaggagatggaggtagggcccaccactccggctccctcctagagttctccgctaccgcctccacgtcccgcgccattgcccacccccacgccgttgcccaccacccgcctccgcgtgacaacagcccgccgtctctcaacctgcacccgatgacgcccgagagcgagagagagcgggggaagaggacaaagagggctctcgcctccacatcccgtgtcgtcgcccaccgcgccgccgtgcgcgctgaccgcccgctgctgctcaacccgtgcttacgcccgacgacacccgagagagagagggggggaagagggggatgacaaagagggctccaccaagagagaggggaagaggaaaaagaggaggtgtgagagaacgacaggtgggccccaccatttaaaaaaaatgctgattggacctaccacgcgtacaccacgtaggacaaaactgctttggcttgagtcgagaggttcagggtgagcgatgtctggtttttcgggttcggggggggggggtaattcggtcaaccacgatagttcggggtggaggtaattcgtacttttttcctttttattatcatatatatactctctagagcaacacatgacttcatatggtcactataggctaatttggagattgggcaagttcttttttcttgttattagtcccccttatgcatggctacacacagcaaagaacatgttgctattttccagatacgaattcttcctgaatagtaaaagaacaagtacgatttaccccctgaactatcacggtcgatcgaattacccccccccccaaaccacaaaaccagatattttacaccctcaagtatttataccggataaataacccccctgagcattgttcttagaggtttacacttgaacttgtacacgtggcgccaacgtggcaatccagtcagcaaagaaaataaaaaatttctctaggcccacatgtcatacatatccctcctagtaccccttgcgtgcgcgctctctctctcaggtggccgacgacagaggtggacctcgctcgggcaggcggcaagacagagcgagctcgagtggccagcggtggaggtggaggcggaggcagaactcgctcgggaagccaccggcggtagtggagcaagctcaggtggtcgcggtgggggcgacgagctcgagcgatcgacggtggaggcggaggcggatcgcgtcgtccacgcggcctccgctcccacccactgccgtcctcggctcgccgccgccagtgagtgatggagttgaggtcgaggttggagcttgcaacggtgaagcaaagttcttgatccctctccccctttctctcatgctcaccagatccaccggtgtcctctgcatgttcgccgccctcgctcccaatctccaccgcacaatccccacccccaatctcccatgtgccatcctcgtccctagcctccttctcaccgttgccgccctcaaccaccatggcactgcttgactagtagctcgagtgacccacgatggaggtggatgcggagcgagctcgacaagctgacagcggagatggtatgagctcgggtggccggcggtggaggcggaggtggagtgagctcgggaggccgccgccagcggcagagcgagctcgagtggtcacgatggaggcaacgagctcgagcgaccaatagtggaggcagaggcggtgaccgacggtggaggcagaggcggagcgcgtcgtccgcgcggcgttcgcccccgcccaccgccgtccttggctcccctccgctgcacccagccggctctgtcctcggctgttgccgtcctcggcccctcttcgtcgccgccaccagtgagcgatggagctgaggggagggagaagagaggggggatttgggaaagagataggatagagagaggtagagagggtgaaatgacatgtttggcccattgatttttttttaaaaaaaaagaaatttctgactggattgccacgtaggaccaaaaccactgcggattgagccagggggttatttgtccgatttacatagttcgggggtaaaggatgtccggttttgcggttctgagggataattcgatcgaccgtgatagttttttttttggggtggggggtggggtgggttaattcgtactttttccaatagtaaaataatatcttctccagtttctacttagctgcactgaggtgccaccatcactacactccacaaaattcaggttaccctgatgaacatagccctaacaatagcaactatttcagttcatatttccgcactatttattgatccatggaactattggtatgctacaacacatagagccatcgatcacgcaaatgcaggaccactgaatttgtgatcacaaaatgtcgtcctgaagagtaattgtcagaacaagcccaaaatgtttgctgggtaggacaggcagttccaacttatgaaactccttacgaactatcttctccttgtagtacacgacacccggaatcgcctcttttccgatcatctcaatgtcgtcgatcttgaaatccgacaacttgcacacgaactggtctggcctcttctgctgcttgaagttggctgacagcatggcattggctttcgtatcataggtccaaccattgtcacctggcttcagctccacccaagcatcaatccagccgtcaggtagagggaatggaccatctactttgtcttcccagttcatgtcgccgcagaagattgcattgcgcaattgtccaagaatctccagagactgctttgcctgagctactcgcttctcgctgtacttcagatcccacagaggaggtagagggcaggggctctctaggtgacttgtgcccacagccaaatggatctctcccgttttgacgaccgctacgcatagctccctcttcattattgatttcgaaaatgggatggggttcgattcgctcaccggtaatttgctcatctgcatttgtttgcaattgaatcagattagtgaaagaagtctagaagaaaaaaactgttgcaaccgaaattagggacagtcagtaatgcttttgaacagaaaaggttgaggctctaagcagaaaaagataataaattcatggtcccagatatataaaactcctctgttcataaaagccaggttgataacttgctcgtggttctttcttagtttcttttgatgaaatgtgttagtgttagcaatgtgaaaagtacttcattgttgtgcgccttaacagtagtaagccatgtaacaccaggtctagatgatcatatggcagaataactcacgttttttctaaaatggcaggatagtggtttcggtcgcttgagatacaacttcccctgcgccgagttcctatggggtagcactggtccagtgaagtgcaagcttttcctctcgcttgcgcttcggcggtactgttagacggccgatcaaatgtgcagccgtgggatggacagtcacaccatttgccctatgtgtgcgtaggaactggaaacggctcaccgtatctcggtggagtacatcttcgcgcgacaagtttggcacaagctgctgtccaagattggcctggcctcattctcaccctgccagcaagcttcgcttcaagatttggtgggagtcctctcgcaggagggtgtagaaccacaacaggaaggggttcgattttctcgttctccttgttacctggcacctgtggttggaaaggaacgctcatgtctttgagggggtactttccatggtggacacagtggtcgatcacatcgtacaggaagggcaactttggattgcagcaaagcctagtcccctaggagctctccttggcatatagacaaaggctctctcccttattcccttgttgttttccggaccatggtttgaaatttcagtaattttggcccccaccggcaagcacaaatctccccaaaattttcggttttttgtcaaatatttataactttggtcaaattttgttcaaactcagtaaaaaaatatgttaaaaattcaaacaattttggtcaaaagaacctgaaaatcacgaaattttcaaattttaggcaaccaccaaaattgcaaaccctgttccggagcccagttgtgtttcttagttagcctagtgtgctctcccccgtctcacctctaacccccccatgaccagcttcagcgggctgtagttgtaaaaactcttttttttttccttgctaatatatcaatgcgtaaggctttttcgcgttcaggaaaaaagaaagaaagaaagataaattgaggtggcacttagataactaatgcactttatctaaaaagaagtaaactaatgcaaaacttgcaattgaactcctgacaattcaactgcgactatcatattaacgctgaccttgtgagacgtttagacctgacaatatgggaaacgatacaagtgtgaaagagcttgcatcatcatccataatttctgctgccattgcatatattatattcatgataaaaaatggatattgctggctgctgaaagtagagagagagagagagagagagagagagagagagagagagagaccaaagagttctgtaacttccagaagcttcaacacatatggtacttgaagtttaagagaagcgttacctgcatgcagaaatgtgacttccgcatagccatctcatgtgacaacaggcatttatattcttgccaccacagtccgatttttccataagctgatatatgtaaggtgtaacctcctacagttcaacattgatacaaggcccattaagaaagaggaaagggataatgcacagtttgaattctgtacctggaagcatatgaagtctgggttgtgaagttgaataagatctccaagagcgcccagccttctgtgcagttcaatatcctctctgatccagacattgtatgtcatgattttgaaggtcttcttgtttaaattattctcaaatttttctgcatgacaagatttgtattttagtgtggccatagcgaagaagaagaataaaagtacagctttgaaggaaaaataaacttctaattatctagatagataacataatcacacacatatgtaaaattaactaccagatttggtcatatgagaactgcggcaactccaagatatagatgcaaaatacccgagcaatttgcatatcaactagatcttacacaattgctcaaacaattaataggaagaagcaccgaaagaaaaatattgcatgcttatggcaatttagtagaaaacaaatgacagaatgaaccaggtgaatagtattctgtatcaagagaatattaaattcagatcacatagagcaaacaaagtatttgtctcatcatacatccatcaatactgcaccctccattaacaagtagatgtcgttttaggatgcgtacagtcaaaggaagtcttaaatcactaatatatgcaaaagtattaagatttggcatgtaaaaatgatatcaatagatttgtcacaaagaagaatttaaaaaacaaatgacttaacattcgtgttgaagactctgatgatctaaaagacaagtaaataacgactggaaggattgatataaaacagagaaaatgtactttctctaagtgtatacaccaaaaaatttgtgcagaacactccaatcggttggatagactgtaaaatggcctccaaagcattaagtagccatctctcctttatttatatatcttgtaccctataagttacagttaattcaactactaatatataccaaaaccaaaattaaatcattccatgtattcccgtcccctccactccttccatgctgcgtcctatccatctcaattgtgaggtgcattgcacgtgcaagatcacaaacttgtaattaaattagctcatcatatgtaccgcaattatgcagcgtggccatgcagaagaggtaaagaattaatagcaattttgcagtcgccattaacattactacccgtttcagatcacatttattctgctgttgcaaagaggaatcagtagattcagaaagagttagaatctctcgtactcgggtgtatcgtatcctccaattaaatctatacaaattaatcgaccccaaatcgaaagcaacagcaggggtaatcgattctggacacagcgaagagggaaaaaaaaggctgcgaatcttgtgattccggagatcgattcgtagcaacacaaagccctcaaatcaaatgtacttttcttggcggcggcggcgtcggagggacgcggcgaacccgccccatctgccccctcgccctcctcctcctcctcctcgtcggcgcacgcctcgcgcacccgcttcttcctcgccctcggaggagggggcgaggaagcgggatcgtcgccgtcgttttcggcgtcgacctccacggggcgcgcggcctcgcaggcggagcagacgccggagccgcttgggttgaggagcgtgcaccgggcgcaggcccacggcggcggcgcgccgcaggaaccgcagggggaccccgcggtggcggcgcaggcgcagggatcgcactcccacgaggcctccgccgctgccgctgccggcggcggcggcggcgccgccgccggggagagggagagcatggtggttgggggaaaggagtggggtttttttgggggtctgagttgtggagagagaaggaagacgattggctttccgaatttgaattggagctattctgggccgtccgatgagcccatcggatggctcctgattcttagcatctttgcgggtgattttgccatttttggtatagggttggtaatgggccgggccgggctgggcttgggcagagctgggccatgtctgatccaagcactagaaattccttgctcgacgcatgccgaccttcttgaacagtggagggtattttagatgtctatcatgttattaatatttatttgtgctaatttagacgatacatggtttataaaagtatatatgaaagtataaatcttaagatcatgtcatgaagaatgtctagaacctctaaaatatagggccagccgtgcaaccagattctatagaaaagaaaatggagtaagttgttcaggatgtgagcgtttcgttccttccatggattctaggcaagcaagatcgtctaagaattgaagcctctctcggcaagacaccaatcaatcaatttcgattggcaagcattgccggtaccaaagtatttataagtgatatgagaaattttatggttttcaaaataatatctcgaggtactaaaactttacgatacaaattttgttacatatcaaattttatatagaaagcgtgatgccttccgattaccttcctcaagaatgaaaaaattactcaaatggtatagtactcttgctgctaatagctgctaatagagtaatacctcatttccactgtgcattgcagaagcatccaatgagccatgtccactgaattatggggggaaataattgagatggagacaaggggcagagcatatatccttttgggtgaaagctacatttcacttatctttttccatggcactatcgatcgatcgatcgatagagaatagctagcagtgtgtttccagaactctacaacatcatcacacgctattttcttctgtgctgatgaaaacgagtgactcaagtatatatggtttcaaacaaaaagaaagaaagaaaacgagtgactcaagtcactgttacgttccctccattaatttgtccagccagttcaatttttttcccccacaagttcaggacaggaaaaatgactacaaatttagggatgtgattcattttccttattaaaaatcaatttttaagaaagaaaaaaaataaacggctccaatcatagaagaggttactgtgtccaatctaccacctcgtaagaacatggagaacccaacttttcggttcttatatatttttcttcgattctatgactacaatttttaatatatatatatatatatatatatatatatatataataaattgtttatgtggcctaaaaattttatgacttgttaccgctatcagaaaatcccccgaacataacctaaatctcactatatatgaagctaaaactcaaggctgacgaaactcacgtgttttgattattgactcagcttgcgtggctcccttaactataacaaagctgaatcttccgcgaaactggactactagtctttacgtctaaaaaataatgtaccccaaactttagtccactcgttggtcttgtcactaattaataattaatctccgaaggatgagcatgaatcatatactatatgtatatcacattaacaaattcctaacccttgggcaccaagaaagatgataaaattaaggataagactttttggcctgcattagtcgtcatttcttaactgctcatgcaacgactttgcataatttccccataaatgttgcagactaaggccctatttgattcagcttggattattataatctagattattaggagtaaactgaaacaaacaagtagattattatgatagattattataatctactgaaacaagtagatttggaggagctttttctagattattgagtggctaaagactcactacccttacatgcctctaataatctagagaaacaaataacttctagtttattttatgtcagcttattacaatctagcttaaactaatttgatttaataatttagattacaataatcttaaactgaaacaaacagagcctaacacactacaccgctaatgctaatacagtatgggcatgtataattgtatatgcttactcaccgatgagtcagattgaagtagcaagcatatatatgcacatggtgagacgtcctcaaataataataataataataataataataataataataataataataataataaaaccgtcggtgtgacctactacaggacttaaaacaacaaattaaattaaatttaaccaataactttcggaaatcttctatactcaagtcatgtcatcaacttgttaatcttaagttggaatgatcagtatgctccttcaacttagacaatgcatgtggcttgaactaatacaagtaggtgatggtagtttgcccttactttggctacgttttatgaccacccggaaaacgtggtggtttattaatatataattaattatgtattaactaaagataacttgaaaaatatgttaatatgatttttttaaagcaacttccgtatagaaaatttttgaaaaaaatacaccgtgtagtagtttaaaagcatgcgcgtgaaaaatgagatggtgagttgggaaaatgaagaaaataactcaatcttgtactttttgattatgtaaaaaaactattagatttcttgtcaaataattaacctcttagatcgatctatttccttgtgtttaaaatgtagagtaagttttagatgtttatgataaaatctactagaaatgttttctatctagtcacacaatcacaagcgtatgttagcattctaaaatgccattttgaagctcaataactcatatataaataactttgttatttttcatttatactctatatcaaaaaatataaatgttatttgtgggggaagaataaaataaattttaaaagcatgttaggttcgattttatggattttcactggttttcatccggatcctcaaacaaacaagtatatgtgtctgcaatgctccctctatttaaaaatttaagaaatatttcttttgttaccaagacaaaatttttttaactcatttatcatgtgataaaactaaggaaatagtatatgcgtgtatgcaaccaataaatattaatacgactccttaccttccgatgaacaatttaatttaacacataaaaactacaaatataaccttagattttgagaaaaaaaataaaaataaaaaattcgaaaaaggatattttttttaaagcctgatcaatgcttaaccgtcagtccacagagctccggacacgtgtcccaaacagcgcagccacgtcaccaccgacccaaatatcccaacacccagttatcgcaccagtattgagccctctcaacattacttccctcgctgacatgtgggccctctatccaatgagcccacctgtcagtgactcaaagtcagatggaagcaggtgagaggatgctcttccagcagataccactcactgttcgaacggacgatactacggcgagcatcagcagcagagcacacagcaaacaacccggaaagagaacccaattccaatccaagcgtgtcagacttatccaaaagggacccccagctcgcgatccatccatccgccaccgtatttaagcgagccatttcgatcattcgagaccccaccgaagcaagagagaattttgaagacaaggtgaaagtttgaaaggggaggagcagcaatggcggacatcgcgctgctggtggtggaggagttcgagaagatgaccaagaagttgaagcagcagaggcagcagcagggccggatcagcgaggaggtgcccgccggggatgcggcggcggcttcgcgggcgggggagtggggttcttgggcggcggcggcggtgaggacgagggtggcggcgctgaaggagcccgccgccgcgcaggggctcgccgccgtcgatggcttcttctccgcttgatctttctttgtttcttcttcttcttcttttttcctttgttgggaagtgatttggtgaagcaggccatatccaatttggaggatttgattttgttttttcttttcctctttaccagtatgtgatgtgtacatatatcgactttgtgaagaaatcgcaactttttctccagtagtttgttcactctgttcatcaccatggcgacttttttatcactcagttcatcagtcatcaacgtggttgatgagagagaggagaaaggaatcttaaaattttatcgaaatttcactgaaaaacatccaaagttttggctgtgaacgcgataaaattttcacgtttataaacactacagacccttcagtttcatcccaaatagtccccatcgtctagcaagatgatttcacacttttttttgagggaaaactaagtttccattaacccatcgatgcggtcaagtcacccgcaaccaagctttgtccaaaggatttgcatctgagcaccattgttccattcaatcaatctatgagtacatttttttattgcaagaattctaatcccagggaagaacgacgccgatgccaagaaacttttgtttcgtttcagatacgacatgctaaatcatacaggaggacgagtaggaaaaggtgctcagagacatttcatatgtaattctttatagcagaatctagaattttttggttatcggttaccctaataaaccaaatccgaaactaagattaaattttcaaacttagaagttgtttttaaaaatatttattccttttatggcttttaagtcgttaagaatataaaagtgttaactacaaactatttttttttctaataaaccgttttatcttattagtaaatataggcaataaatgagagtctttataaaaagaaaaaaaaccctgcaaaaaaagaaaaaaaacacctaaattaaacattccccactcctcaccccatccgacagtgacctcttctgcatacttggcttggacctacatgccagggacacttgatctcataccccatccaagtgaggaatttcacatgaagagttttcagaatttccacaataaatacgataagctttcagaaaaaagacccaccacattgcaagtcatggatttcccagcagttctgttcggtcgtagtgtcgaaaggctcgcagaaactcgaattcgttcatcacaatcctcactgtctcactgagcaacctcgttccatttgttcaattatacttaaatcgtctgaactttacaccattcctcgtatcaagtttcttctgtacgggatttgcataaaacgtgccaaatcgtttcaggcagttcaccctgtctactgaaatttgttcagatcatctcagacaagatatgccggtatctgccgtagtccgacgtcgtcttgaaggtcggcgtgaactcggagaagaagctcagcatggcggcgaggttctgcgcgctgtttatggccacagctttctccaagaacaggacaggctgcacagttattacctggaacagtcaccatgtctagttagttaaagaatgggatgtgacaacgtttcttatgcaatgcaagctttccatgcctttgtgtattgccattacagtagttgtgtgcctataatatcggcagagatagtcgattttgtaagtcatttccattatcctaaaaaaatgtatcaccagtgcaaccactttactagtatgaagtgagcaacggaaattcagagagtaaataacttcactttttacgagttgcaaacttgcaatgcataggaaatacgaacatgatgatatagtgattttataaatttggagcaagatgggagaaacgtgtgcgccagttggcaaaagagtaccttgtattttctagcgtaacgaagagcctccaggtggtatccgtcttgcagtaacgcagtgacgtagtcatggtgcaagccccgctctctcagcatgtccacgcccagcttccttgtcggagagtgttgttgacctaattccatgagttgcatcgcaagttccttggagggttctaggatctgaaggaattggtaaatgaacaaaaatataagcattaatagctggagtgtagcttgtaacatcggagtgtgaaatgttgttatctagaactgtcttgcatggtatatgttgtggtgacaactaattttgggaatagatgcaaaaagattttggtgggaaagcttttggtaagccaccggtggcatcaaaactcaaaaaccttagtaatcgaggttagcggaaatccggtgcccacgctgaatttaatctgtcgcagggaccaaaagggggtgtcagttagacaaccatgattagttagttcaggcttatactacaaagtcagatctaagagttcttccatcagacaaagttcaggtgtgaacagattgaacaaaagtaagtagcagaaagaaagtatataagattgcaatgcaaagagccaaagactatctcttgaagacgtacacaaatttttaaatgaaattgcgaacaataacaccacctcttttctttttgtgtatcttgcaacgcaaattgctaagaatatttccaccacattttcaactttgtgcatcagtcatttgttaagtatgttgaccctcagcttatagcattgttcacaaacaattttatgaacgttatcctgaacatttacaatgaggtgagaacaccatagtaacatactgaccttgttggatacaaacaaggctatttcaggataacggttgctgcgggccagcagtgttgtcatcatcacaaaaaggttaggaggagccttcaacccagctcttgagacactgcaaaatgcaaattaagcttgagtattctatagtgtcacctaa

SEQ ID NO: 60738 - DNA, 8524 bp, Oryza sativa
tcttttgtaaatcatcgaattggtgtatgtgcgtcccttgggtgtcaggatggttggatgtattagaccttgaaaagtagtttacttattctttacgttattaggtgttcttttataatcttatgtgcgcccttatggcaagagtttctgggcctggctatcaacctatgcttctgcatctgctggacttgaaatgctccagttgaagcagttcttgaagaacacaaaggtgaagaggatgttccgatgcttcttctagcagtgtaccagcaaccgggaacaattcataggttagctgttcccttcatttattctctttaggaactaattatgtttatggaaattaacctttgctatacacaagccgaacagaaatttcgcaaagtctcttcaagaatgtcacatgccaatcaatgattgaatacttaattagatgcattagttagattaattgcaatgaggtgaactgaagtatcccttcttcttgcacaaatcttgtcagtctgttgttactctgtcactgtttccctctatttatgccatgcaacattggattgttgagcattcagcaatcaaattccattgccatttttcatgaacttatttcctcttacttgaggttaattcagtgttctactggaaaattaactttatgaaatgtgaaagcaaaccctttatcgtagagttttgatccaaacccttatctggagctgttccatacagatttaggaaaatatttctgtgtaacactatcaggcacaagtcgcaccacaaaacaagagtttggagaagagaattgggtgttggacatcaagggatactaaggtgtctaaagtagtcttttagtgcttctaactactcttagtttgagaagagaattgggtgttggacatcaagggatactatgctgttttagtttgagtccctgaatgaagaggtcttctttctgttagttagctgcaatttattgcagtgctggaacttctagtttctttcacaaataacctactgatatttatccttgaatgtgatgttttcacagcttccctcagagtggaaattggacacttggcaaaaattattgtttcactgcattgattgttgttgttgctaatggctaacagtcgctgctatgtggaaatagtaatgtgctattcagagatgagatactcaattgagccgaggtccgtcttgagccagagcactagcttccgactattttcacggtagttgaatctctgaacggtaaaagtcgtttataacttgacacggatcagaactgaaagttcaagtgcttctatgtcccaaatgatcccccaaaacatgaaaattcatggtaattagcaggctgttttgtttatttaggaaggaaacacttttgattgtgactataatcatcatgaacaagtgggatccgtggcgcaatggtagcgcgtctgactccagatcagaaggttgcgtgttcgattcatgtcgggttcaaaaccccggtccaaaacggatctttttttttttccaacgtattttggcaatcaactttttggttcttcaattccaggcaaagaactcgactgcacacgtgagcctgcgaccgtactggaccaatttgcgacactagtgatcgcgatcgtgatttgtgaataatgatgtgcgctagtacaaaacactccctgatgcacctattaattttagatgcttgtcggattttctgacgggcgtgcaggtacatctatatacattgcatggtccaaaaggacatgaatagatgcaaggaaaatatggccagcttaattatggctaagatttcgagtgaaattttaatgttcttcacaatattaagatgtgtctcattcggtactaagttcttacattctgagacggaaggaataattcggttcgggtgatcgatggtcgaattgtggtcttgtggctgctgtgatccatggtaggtttgtcgaaaccacggtgaaaatagtcagaagctgtcagggttacggataaggcataccctccatcctacgacttatgaaatataccgataaggtataccttcacgtgtacggatcgtttccgtatacgccattagaaatttatctcaaattatggaaaatatctttatgggttaagaaattgccggagtcctactcagaggggataaaatctctggttatatcgtgctagtttacatatccctaaatcttacttaggggtcaaggcattccactgtgtaaaaaggacccccgggagaggcaaaggggatcgcatctcatcacctacacacccaccgaagtttacgaagccggagtacatggagccacctcgttggaagatctcgtcgaatccctcgactacgattttgtcggtattgtctgttttggttactctctttgtaatatgttctcatcatcatcaatccatataaactggactagggctattacctgataaggggcctaaaccagtataatccttgtcttttgtctgttttgatgttatactatgtagacctctgctccaacataccccaatattttattcatccggtccgcgagtatcactcgtcgacagaagttaatagataatggccttgttcaggatgtcaggctgtagcgctgcggtcctgtatttttctggataagatatactccctttgtaaaaaaaagtacaaataggatgtgacttatcctaggataatgaatatagagctcacatcttatcctatgttgttttttttgggacgaagggggtagtttctacctttgttagtatgtttttcgaactactaaacgatgtgtttcgtgaaaaaatatatagaagttgctctaaaatatcaaataagtcaattgtaagttagtgataattaaaactcaattaatcatcaaataagtcaattgtaagttagtgataattaaaactcaattaatcatgtattaatagttttttttattttacgtgcctttatttaatcctcatcttcatcaaactagaacgggcctttctcggacatcggctctaaacctcaaagtagtttttagcttgggccattataccgtattggaacattgaacgtccactcgcatgggtcaccacaatgccatgtctcgtgaatggagagttagatgaagtctttggatgcggccaccttaatactcgtcccgtgtctatgagaaaattcaagaaacgtcaacgacaagcgctccaattcaaaaaatacgaacataaattcttgaaaaatgccatcatacaagtgccttcgtttaagagctataaaaagaccattttacccctataaattgttaaagatgattaaaacttttactttttcaatcaacttacaataatttagtgtaaagagccaactacatcatagtgtaagctagcagaaagagcaaaatttttaataaaatttcaacaaatcatagggggtaaaatggttttttagcactttaacggagggatgctaatgaaaacctaaggatgtgtttagcaaatgggttatgagaggtctgattgggaaatggaaattaataaatagttaggattaaatgaggtgtgaagaatggatggctatgatacaatattaccctttggagggtgggatataatttttctatcccatttaccaaacaaagcctaagggtgatatcatttatgggataaatgtgcttgtaagatgtcatttctataaagtttggtttgtcgatgccatttcttgaattggggcacttgtcgataacattttctaaaatttctttctgcgtagacaaaactaattgttattttggttttgtttagttttgtagttatctagtttgagcacaatctgtttttttttccttatagatgttacataagtagtagtaaaaagaaaggcaacattagaaccttcccttttttagttgagttgcgtgactagaagaacgtgtgtgctatgctggtccaatatattaaaagtgtttataaatgtaggatgtgcgtatttgtaatttataaggataagtgtgcgcgtgtgcgcatgtgatgttatgtttgaaaataaagatatgttagaaaaatagaaattaacacccgagcaaaatttactattccaaaaataatcaaagctcgcacgccatttaacctttttcttttttatgaaaaaaaaggtctaactgatgtcatgagtttatccactgcccctgcccccgggacggtcaaacacacctgcctggtccaccgccacagacccacgtgagcagaaaccgggtgggccccacgtctcgccagtttctctcgcccgctgttcccgcttcctacacagtttcacttcccccttggtcttggtccgtctccactctctccactccgccgccgccaccgctcgtcgtcgcctccccccccaaatcaaaaatcaaaatcaaaacccccccatctcttcttctagtttcttctagaagccgggacgaacaccgcgtcgtcttcgccttcgccttcgtcgtctcccgctcgcttcctccctcctgggttaggttaggcctccccccctctctctctggttttgtgctgatctcggagatcccggctccaggtcgagtgatccattttttatttttttattttgttttttttgggtttcgctgggtttgtgccagtgtgttgttctcgtggatggtttgtttgttgggttccaccggatttttttttttttgggggggggggggggtggggcgctggagatggggggatttatggtagggtttatcgtctcgtctcgtgcgagtcggcccgtcggtgggtgggcgggatctcgcgattccgtgttgattagttcgtcttaagcggttcgggtgatttgatgctcgtacgtgctgatgaactgtttgggggcttgtagttttttttctctctctctcttttaaagtaatcccgagtttgccggggatttgaatatcggtttcgtgtgtgatttgctctagagggtatggtttaaggtagagaaatttgatactaacatatgccatccaatccgcgtgccttgtgtgttttgccactttgatccggatgtcttggttagccatggcgttcctgcttgagctcacatggctagaggttgcgcaagtagtacttgctccgtgcgaacgattcaccatctaatggaaatctggcggaagattggatgcatttgttaagtactgtgtgcaattagaatacgtttgcaatcgtgctgtaccagtgtctgccccccattatttatctgacagtctgacagagcgtcttcagatttgtgttaattgctcctgtggttgatgagtctttatagggtgcagcatctcaactttatttctttttaattgtgggaagggtgtactccgtatggctgacagatcgctggggagtaccttaatgaatactcacgaatttattattactagcacagtatgaagcctctgagttacttgagctgtgcataatctgggttgtgtatcgatcacaaggatcaaattggctaatatgtgtagttgtatattcataaaaatgatctagcatgtattatctgttcgtcactaaataaccaaaattgttgagatttcattttcatacccatctaagttatttgtctaaactgtgtgcgccttgtgattttgtgaaaattcttgtgtgctaaaaggaaaatgaagaccataattgcaaatttattatgcatataatttctttcgattgtttaaggcacatgggaataactgccaacatgccttaatcacactattttttttttaaaaaaatggataaggtagatgatcttgagtctgttagtctttgttctacttaccatttatattctgtgtatttgtcttgctaaaataaacttcactttccactatcctggatgttttctttcagttatttctaatatgtcttgttggccatgcaggctgtgcactgaagtactgaacgttcttttgtagactgttaagcttatcctgcatcatggagaatggagacaaggatgagaaaaatgttgctgtcacggaaggatctaccaattctgaagaaaaggatcaagatgaggatttgttgaggagaacagaaatgctgaatgcaaaagaagcaataaattcttcaaatgagaattcaggcaatgattcagaagcacagatccatgtgagagatgattcacaaaaagaattcaatgagaagatgaataaagaaggaagctcagatccaatggaacctacagattcaagccagacagaggaagatatccttgctgaagacaaatctgaagaacctgtttttgatggaactgaggttgctgaaatggaagatttgaggcgttcgtccaatcaatctgtggaacttgattcagatgcccatgggtctgtactcaatgaaagagctactgcaatcaagaattttgttaaggaaaagggtgccattgcagtttcaacatttataaggcgcctttctggcaaaaaggacgaaaatgaattttctgttgaagatgaaaagaatgaaggatcagaaagcatcagtagtggcaatattggctcagatgctgaacctaaatcaaaagaggtgcagcccaaatctgaggagagaactacatggaatccactcaacttgattaaaatcggacgagattttgataccttcatgactggggaagctgggcatgaaaatgtgccagatttgatagagcaaccaacagggaagggaagaattattatatacacaaaactgggttgtgaagattgcaaaatggttcgctcattcatgcgtcagaaaatgctcaagtatgttgagatcaacatcgacatattccccagtagaaagatggaactagaaaataatactgggtcatccacagtaccaaaagtgtatttcaatgacttgctgattggagggttaactgaattgaagaaaatggaggagtctggcattcttgatgacagaactgatgctcttttcaaagatgaaccctcatctgctgctccgttgcctcccttacctggagaagatgatgaatctggtagtgggaagatagatgagttggcaaccattgtcagaaaaatgagagagtcaatcactctgaaggatagattttacaaaatgagaagatttagcagctgctttcttggtagtgaagctgtagatttcttatcagaagatcaatatttagagagagatgaggtacgatatcaactgctgcttattaataaaacaacttctagcaatgctgtatgcagaactcagccccatatagctctgaaacaacattaatcttatgtccctttttcagttggctattggtggaaaaaaagtactcataactgtatctttgaaatgatttcattctttggaaagaaaaatatccattttattttgttcctataagaatatagtttatctttgaagggatacagaggaaattaaatttagttatcactttccaaaaactcaccgatatatattttccatgtaggcggtggaatttggaagaaagcttgcaagcaaatatttctatcgccatgttttagagtaagttttggaaattatcttatataatattcttttcgttttatttttttttccatacatatcaatttgcaatatttacatctggcattctgactttgcagcgaagatgtatttgaagatggaaatcacttgtatcgcttcctggataatgatcccataattatgagccagtgctacaacatccctaagggtatcattgatgttgaaccgaaaccaattgttgaagtggcatcaaggttaagaaagttgtctgaaaccatgtttgaagcttatgtatctgaagatggtaaacatgttgactacagaagcatccagggttgtgaagaatttaaaaggttagcacttagaactatatgctcattgtcaaagtatactgcataatcaatgtatttcttgccagcagatattactgtgaacaatgttgtattgctctagttggctaattttaattgatacagatgtttaggttcataatgtgagctggccttgaatatgtatatcagtttatttttataatgttatgtgatatacaaatataatatatttcagttgttgcggttatcctattgtgatggttgacgggtatgctgtactaacatatttcttgcataggtatgttagaacaactgaggagctccagagggtggaaacccatgagttatcacgggaagaaaagctcgctttcttcataaatctctacaatatgatggctatccatgcattagtgacatgtggtcatcctgctggaccattggacaggagaaagttctttggagattttaagtatgtcattggtggatgtgcttattcaatgtcagctattcaaaatggcatactgcgtggtaaccaaaggccaccatacaaccttgccaagccttttggacagaaagaccaaagatccaaggtgaacagagcagatctcagccaaaaaaaggggaaacaaagttctctgatatgattgctttgtttccccccatatgtcatgataatacctgtagccctctta

SEQ ID NO: 60739 - DNA, 1754 bp, Oryza sativa
aggcccgttgtatatttgatttattatctgtatgtgtttttgggagccatagcctagcggtcatggtgctcaagtagcacctctaggtcctaggttcgactccccatgggatcgaattttaggtttggttaaaaaaggtcactcgttgtcactggcccctttaaaacacatgtttagaattgacctatggagggcgggccctcgtgtacgggttaaggaccgacccatacggggcaagtccgtgtgtgaggggccagggttcgtagtctttctcggccgatttggttgaggcttcctattcttaatgaaaagccataggggtggtcattcccccgccaccgccagtcgaggtgttttttttctttttctttctggaagtcagatttaggatattttttaaaaggtaaaagtctgtttatagaagtcgactactatgctgtaatggttgttttcagtacctatttgccaaaaatagccatacgaagtggcaacagcctttaccatatctgcaatataatacgggttacatcccattgatcaatccccattcactggttacatgcatgagtactggctttagcagcatttctttgaatcatttttttattactcccaattaattaattcatcaaacttacatgtcagacgtgagtttgcaccaatgctgattttccaatgatgataaattctccttttttccttgtctgtaatttgcaggtggcccttccatatgctgaacctcttgttcactttgctttggtatgtgggaccaaatctggacctgcacttaggtgttactcgccaggaaacatcgataaagaactggtggaagctgcacgtgatttcctaagaaatgtaggaattgttgttgatcctgaagccaaggttgcatctgtaagcaagattttgcgatggtaagaacactattattcttgcttcgcaaatagggccttgagagtttaataagtgctttcttattagtgtaccccatctaaacttgtcatcagaatgtacaactgcaggaacatatacaagaatgaattttatgttaggtagtttagttcatgatgcagggacataaacaacaacgaattttatgctaggtaatttaaattgtttttgagccttctggttggagagaaaaagtagataacacgtaccactagtgcctgctagttttgggctacttgaatatactctatggttaacctagcagcaaaaccagaaaaatctgttaattacctggcttagcagtaacccctatcatagatcagaaccacctgaaaagttctgtacaatttatagttaccgcatcttactacaagagtacaaggttaggtgtggctttgtgggaggcatgaagaccattgaaggctaggttctgatgtcgagcacctataggtcactgattttattttctcatttccataagaagtccaaattggagtgtgaaagttttgaacaaaatactttagataatgtcgataaggcctggatttcaagaaaaaaacatttttctctaatctgctctcggtataaattgtatgtgaaaaatggtgaggaattcccccaaaatggttacccaatttttagctcttgcatggttacatgagcaagactaatggaagaatgtgaattcactggttaatcaatttaagaaaataataatatgcaaattttatccattttactacattatacatgatactccctccgtcccctaatataagggattttgacattttgcttacact

SEQ ID NO: 60740 - DNA, 21221 bp, Oryza sativa
cggcgcacccggcaggggagggggcggggctagggggaccacgatcgaacacctatgccgcaatgaacagtaacttttcctatttatcccgatttttgcccattttctatttaaatatagccctataaattctaatttttgcataaatgaagtttgctccatatttgtgttatcctaattaaaaattcaccctactttaatatcactcatattttgtttatataatttatttgaatttttaattagggttaattctcattccatcgtactaaaatttaattattgctaatatggtcgcgataaaattttatttatttccaatcccacctaatctttattttaatttatattttaattatttatttagccaacttgatttttagggtttattcctagttagttattcattattcgcgattaataaattccgagattaaaatctaatgaaataggcgaataaaatcggcatgatgcaatatttttggtgttttgatttcgttggtcgaattttcagggtgttacactggtgattcattgaatgcatcaacatatcaattgatcctacggtctattttggaagaatcattcaggtgagcatcaactaatctttggtaagctaattaatttcgaattttgttttctaagactaagtttagatacatctacatgttttataaaagtaattgtgaaaagagaattgggcaacgaaatgacgaagacgcgattaaaattaattctaaaagttaaggacagttaaggacgcgattaaaataaagccgtgcctagcaggcaagaatcctcgtgcagtgtaccgagataaatcattatcgaataaaagagtactaaatctcaaaaaaagaataaaagagtactccatttgagaatttatatcttgtcatttctaccatgaatagagaacaatgcatcaatttgctccaatggaatatatattctgaagaacagaatcttgttacttacattatttgactttatgtcactgacatatagatacatactgagatgcagtcacatgacttaacaccagagaatccgcatccatatttcgatgggtactctctacaactccccggtactataaaagaaagaatctctgtttttttatcgcaaaacattaaaaaaaaaggaaccgttgaaacgtgatcttgagtgatctattttcaattgcaccaacgaattaaactgaataaattgaccaagggttagtgaacatctccagtcattttttaagagctcactgtcgaagcacttgcatcaatcttcacaaccaaaaatagctactagcaccaaagaaataagataggtagaatctgataaaacctgctcccgaataaacatttttttcattaacctacgaattaaactcactaaaattgacgaaattaagcaagccaataggtcctcgacttttaaagctcattgttgaaggcagaagcacttgcataaatctgcacaactaaaagtatgttcaaatcccagacttttatgtgtgcttgtatttacggacgattattttttctgacagacgatgtacccgttgataccggggtgtttgtggattgtgataattttatcaatttcaatatattggcctggactttggagatgcttataagtgtacaatatgcatatgtgtacttatgatgagagtgcttgcgtatatatgagagcctatgtttgcagtgtttctataaaaaaaagggttacagagagaactggtactgcatttagcacctactctgtatcaactgctatcttgattataaaagcatggccataatgatccatgctcttaaagttatatcaactggctggcaacttagtactactaattttcagtaaagtgttgttcctttcaagaacggcaagggcgatcagagcgtcgtcttgccgatctgcttgccctcatgggcaggttccagctcgatgtccaaaccctcatcgcagagctcatcttctgtctaaatgcaattgcaacgcatgtgttctactgttcttgtttcttcttggttcagattgtacttaaatttgttggtgtcagataacatgctggccctctagttcatcccacgacgcagagtagggactattcctattgtgttccaaaaaaaaaaaaattacatacgtgctattcgttctctacattttttcagttctgtgacagagtgaaacttcctgtgagcgagtaaagcttattgtacaatggtagagtactaaattacttctctttctacctagagacaaacatcaactttctttttataaacacattagaaatggagacgctcacacacacacacacgtgcacagtcatctctacgaacagaccttatccctatgagcacatcagaaagattaaaccaacatatctttatattaataaagttattacaaacgcataattgttgataggtacgtcgactaccactgagacattaactgatcttggtaagaccttgttatggtccaaatagtataattttgatttttaagaataactttaaatttttacttactgtcttagcaatcataaaaaagaactgaacaacaaatatgacaaaatgagacctttaaaattaattccaaataaaagttaaagttcaaaaccacctctgaagtatataatataaagccgcatgctaagccggcaagatcctcgttctgtgtaccgaggatgcaacaagatggatttaaaggacaggccccatgggactttcccatatgtgtctcttgggaaactatcttctcatttctccttcatggaacatgaacgtggaacaggtgcgtcaaccagccagcttttgaatgtaacatattcagacatgaacattaaaacagagaagaatctgcgaaaaattcatccaattcatccatgaaaattaaaacagagaagaatctgcgaaaaatatggtattggtcctattggataagctgtttgtatttgaaaccatgaaccatactgaataaaactgatcagaacaggtcaacagatcctatacttttttaaaagctccttgttgaagcattttgcataaatatgcacaaccatgagatgttactgaagaaataagacaagtagtactgttcttcacaatactctgaaaacaaccttcttggttactttttttagacaatgaccgtaatgatctttggtctaatatttatatcacaattggccagcaactgttagagaaaatgacctcaatgatctttggtctaaaaattatattgtgtcactggtgtcttgtagcctcatcaccttcccatacctaacactatcccttttaaaatggtctcaactcttctaaaactagcaatgtggtactcctaacactaggcatggagtattaccgaattaatattcacaagcatgtcttttatgagatggggctttgtgattctccatatgggctcccatatataattccaacatcctctccattccttgacttcgtcatgtttgaatctcctccttgaagtttctatttcaggcccaaacaatggaaaagcaacaggaatgcagaccaagcacgcgattctgaacaccacagcagtagtagtgaaaccgagagatccctgtcgctggtatagtttgctgtgctgccttcaactaagcaaggccacagaggcctagtttacttccaaacttttttttcaaaaaacttttctatcacatcaacactttcctatacacataaatttctaactttttcgtcacattattttaatttcaacaaaattttcaattttgacgtgaactaaacatacccagagtgatcagctgctgggcaaaaccgtaaatcgaaacgattctgaatttctggttcacgggtcggctggaatcatcgtggtgtcgtattaatatagtagtatttaactgcactgcactgtatcagtttagtgtgaactttacagagagctatactagactacgatacagagagaatgacagattggcccgatcgatttgttctccggcatgggcgaccctacacaaaatgcttcgttacagatagccaggtcgatgtgccgtctcctttgttgcttttcaccttttctttttactcaggctcacccagacacagacagtctcacatcacaagtcagtatgcatatgcctccaatctctgcagttcccagttggataggaggattcctagataatctcgcagagttcagtcgcacggctacagaatcggacattcagatcacagttgcaagcaacagatcacatgaacaagctccaactaatacagtttcagttcaaccagtccaatgcatacaggaacaaatcaagaaagttccagctcaccagccagtctttagtgtcttgctaccttcttcaagttccaacacgtacaaacagaaagggcaatccagatctccctgaagatgtgtgctttgtgatgaattttttataatcttttttgaagaataagctttgtgatgatttattaatacctgaaactcaattaggttctaaagcaagcattgcaagtagaggctctagagtagcatgacatgaagaggtagttacaccgtgtttagttccaaactttttttttcaaactttcaacttttctatcacttcaaaattttcctacacacataaactttcaacttttctgtcacatcgttctaatttcaatcaaactttcaattttgacgtgaactaaacacaaccttagtaccttgagcattcaaactccaaaaaggaagctgcttgagagagcaaagaagataccaaaccctcttctttccctatccccttccctcctatgatcctatcctatcctagcttccattccccctcaaccttgcacatcaccatcctccccttaatgccactcctcgcctcgctgctgccgccgcctcatcgcattctagagcattgctcatggcggaccaccaccaccagccgccgaccccaccacggcgccatcggcgtccccatgagctgtccatggcggcggaggaacgacaccatgggacgcagacggcgatggcgtcggatgacgatcgccaccatgatcgtggcggctggatcaggccggaggagaagcaccggagctccggcgtggcgtgggcgctggtgatcctgtgcacgctgctggcggtcggcgtgatcgtcgccggcgcgacggtgttcgccgtgtacctcatctacaagccccggatgccgtacctggtggtgtccgacgcgcagctggtgcggctggactacgaccagggcggcaccatcgactacctggaggcgctcgtcaccgtcatggcgaggaacaccaactccagggcggacgcctccttcgcccgcgtcgacctcgcgctccgcttccacggcgccgacgtcgcgcgcctccgcgccgcgccgttcgtggtggcgagcgcctccgcggcgccgctccggtacgacgtcgtgtcgaaggggcgcgcgctggacgccggcgggatgcgcgccatggacgcgtcgctcaagtccggcgtcgtgccgctcgacctcctcggccgcgcgcgcacgcggtggaaggtcgggatcttcgcgtcgctcaagttctggacgcgcatctcctgccgcctccacttcttctaccccggcaatggcaccgtcatggcctccgatcgcaacacctgcacctccaggtcgccatagccgatcgccattgattccaattcctccatttgattcgttcgttgcatctcgacgccatccgagacacgtacattactattacatcgcaccattacagatcatgtttcacttgtcatacttgtacagccaaataatgctggtacagtagaatctctgaatctacaagaagagtttattcaaatttagcgcgaaaacaaacacatttatatttgtaattctttattttttctcgatcagtcccctgtttgtactctgtaccaccaaattacgaagtcgatcctaattcctaaacagtgtgtatgaactacttcaagtgtcttttcgcttcgtgtcattgtcaggaatcagaatcgataacatcatcaactaatctcttcagtgttactactgcaaatccgatgaacattctctgacaaaatcagacgctgtctgtctactgaaaactgataatacttcaccattgggctgggcctgaattaccagattggactttctggcccaatatgtaaatccgatgaacattctctgacaaaaggaaaaagtacatcgaaggtccctccctgccgccgcgccaccgtgcggcccacgatgggccggcccgcacaaggagaaaagtgagaaagagagaggaagaagggacagaagaggggagagagatggtgatggcgtagtcaccctgccgtatgggttccacgctaactcagctaccacgtcggataaaatcagggtcaaaatcgtccaagtatccaaagtgacctggttttgtaagttgagggatggtatacaattttataatccgatgacaagatgagattggaccttatggcccaatatagaaggcccacctattcttgggccgaagtctaagcccaacaaccggtcagcgagtcgcgacggggagggagtggctgggaatcgccggagaagaggaggatgacgccgtgacacgggagcacagcaaggtcatcgtcgtcggcttccgtacgagactaggaggagaagtggggattggattgccgcggaattatctccgtcgctgtcgccaccggccgtggggaagcagcgcgcggcgcggcgcgggggggagagtctcctccgccaccgccagcgtgggcagtgggactacctccttgccccgctacgcgacgcggcgacgtcgccgtcggcgtcgtcacccctccgcacggtgcactgaacgtggcgcctccacttggcgcgcgacgcgacgcgacgcggcccgccttcttcttctctactgctacttaaccaccagccgcgcgcgaagtgcggcgagcgcgcaatcgaggtcgaacacttggccggcatgaagcccaggcctaccggattcggggccgcggcggcggcggcggcggaagttttggtggggggcggatgcggtggatgggcgtggaggccgaggccgaggccggcgacggtggcctccaccgcggcgatgtcggtgagggggcctggtactacccaggcggccgcggcggcaagcgccgtgcactcggagcgccaccgcggcggggtgcacgggctgcagctccctccgctgcggctgcagttcaccgccgacctggaggcgcggatcgagaaggtgatctacgcctgccgcttcatgaccttcctcgccatcgccggctcgctcatcggctccgtcccctgcttcctcaaggtcgatttttatctcctctcttcaggttcgatctactcctagcaatttgttgactgtccaactctgcagggctgcgtctatgtgatggatgccttcatcgagtactacctgcacggtggcggcaaggtcaccctgatgctagttgaagccattggtaactaactaactaatctccctaaacttgatgctgttctacacacttcagccatgagcaattaaccactttgtatcttcagcaacacagattagcagttgataacacgggagcacaagcaccaaaccacaaattgcatcgttgctacatgcatcctagtggagttatatgtagtaatttctgataactgaccagtgtgcatttcttgatttacctcagatatgtttctggttggaacggtcatgtttgtcttcgggacagggctatacgagctgttcatcagtaacatggacattgcaaagtcatcatcctatggctctaacctctttggcttgttcaggctcccggttggttcacgcacttagcatccctctaaatggtgcggtaactggggaatttccagtatcctgatacctctgtttctatctgcaggaacggcctgagtggctcgaaatccagtcagtgaatgatctcaagactaagctggggcatgtcatcgtcatggttctactggttggcatctttgagaagagcaagagggtgaccatcacatcatgtactgacctcttctgctttgcagcatcgattttcctctcttcagcttgcctctacctgctctccaggctcagtagcaagtagaaaaataggaggtagcgacacctgaatggctggagcacaaacaggtcttgtacatatgacataggcctgttgtgtttcctatgccgtgcaacacctcatgttatgtttacataatgtaaaattagaggggagtttgcacatctcacgtactctttgtatggaatggaaactactttgtatagtggagccataagacattattgtcaccatcactgtgtaccacctggtactgcaactcactgcttcgatgataaatataaatagttactgctatggcatgttatgaattgattagcaatgctgccttttctgtctgtgattcttttgaagtttttagagcaggattactttgttgatttcttttatacccccaaaagtataaccaagtgctagttaattagtttagaccaggaggagttgcacctatttcttattcttatgatgtcttttatgaacacttctgaatgatatgtatgttatgctattatatgccaaacatactacttgccttcaaaatcattggtgtgatacaggaatgctctgacctccctctttgatattagtagttcctatttgatcacaaggccctggtgaagcttgccaacatagtgtttccatattatcgcttattttcttacacacagagtatatttgatgaatggagtgttgtttggtgtgactactggcttgtgaatgaattgaaacctgcagaatctaattacgtgttatgtatccatgtccttctttctaaaaaaaaatataagtgaagctcatgatgtactctttgccgtatgttgaagcttatctgcgtagctatcgcccttatgagtaagaatactgaacacgatcattaatttgtgaggttataattctgagcaaaaacttgcttgatgttgcagttttatgtataactactaaagctgatgtttcagttctgtgacctacgtccggccaactgtccttcccacacataagatttggatgccagattatctttgaggtatgtttctgaccttcagtatttgcaactgttagcatcatgccatgatctgttgatttctgaattggatgcgccaatgtatggttgttgccttgagatttgtttctgagttctcacctagtatttgtaattcttaagaccattcaatgatttccgagttgaatgcatgggtgctttcctttgaggtatgtttctgctatcaagtattttttaaactgttgcaacattcagtgattcccaattgggtgcaccaatgcatgtttgatgcctatactaacagcaattgacctattcctaaaagtatttcgtagagaggcaaaactgctctggcaagaacgatgaaaattcctatgctttatgaactttggttaagtatgacaccttttctcttaggtgatcaaattaaaggagaggaataataagaagagcagcttgtattgtgccacaaacgatgacagaacctgaaataaattattcaggagttccaagccaaccaacgggaagcaaaggttcccaatcgaaaaaagacttcaaagtggcctttccaaacataaataaaagttccaggaatttgagaaaataaggatcccacaggggaggaataatttttggtggcgcagcaccttgaacgtatatacaatataattactttgaacatttgctgccgtatgatctcttttctatatgcagccgtgagcaacaaaattagaagctccaacttgctgttgtttcatatacataatagattggcagtctctgataggtcagtcatggttgcttgaacttgatgggaacacacaaagtgttgcacttgatgttttaagtatgcaacttgcatgcttaattaagacttgaaagatatatttagcccattataactttgttgctgccaaagtgtgggttgtcgagtattatctgttagatttattacaagtggatcaacttgtctattaaacttacattatttagcacacattttgctgggataactgatcatggtaatgagcagatgttttcatgactggatcctcagtccttggtaacatttggtaaaaaaagaaatgatagttcgctttcctggcaaaataagttgaggatgatcatggtggtaagaaggatgattttacataaaagcattatcctgatacatgtcaggttggcacagatttctcttagacctacatattcccatggtatcaattttttattactaatctcactctatacagtgtctattaggcagaagaagcttagatgtttctaagaatcaaactgaactgggaaaaggtgttccctttggctaggattaataaagtactaagattttgagacatccaaatcctaaacaattggctggggattgctgttatcaccacccgggtcctcccatcacttaactcctccaaaagtacctttcttgaactaaattaatgaaacaatctgcatatataaagaagggagctgctcaggtggtgaaccatcttacctgtgacttagtgagtaacctctgagttcttctcttccaatctccagctctattttgcttgttagcttcatggccatttcgtcgaaaaatgttgctgtgttcaagttgcttctgagtgtcatctttttcatgcagcactctgtgccagttcatgcaaggaagctggtagtgagggcacctatgatctgcatgcatcctccatgcacacggaggaatgccctggaggtgccagctgaacaagttgattcaaccactccaggccatagccctagcattggccataacactcctcccaactgagatgatctgatgctgctactgtgtcccagcctgaaatttgtaactcgggtctgtgaaaactcgggtctatgaaactcatatggtgtttcctggagcttctatgcatttgttcagaaaaggcgtaaagcatgcgactgaagaagctcgcgaagattttgttttccttttttcttttgttccccaagacttgtgcatgcctgcctgcatgctttcttttgttacctgtgtgaaaaacttttcctcaccttgtcttagaggagatctacagatctgtagcctgtaacagtgtgtctgttgaaaattttaactctccatatgttatgaacttgagaatggatgttgtaaggcgaggttaatcggctattttcttcaaaattttactagtacaatattgtaaactttaaagaggtacaccatgagtggtcctttggttttctacatatcctttgttgagcatgtaatttcgtccatatatacatcaagtttgtgtaaattgatcaggatttttaaagtcaaaattaatttaattaccttcaaatgagactgaacaggaccatgtttttcttcagaatggtgtaggacagcggtaacattttttcttaccctttgttgaaagataaattaacgcttggggtgtacaattgtataatgctgatactattacttgacaagtttatggcacccctggagctctaatctaacatgtcatctcattgttgtgtctgttttcttctggcaaagtgtggtatttttcttacaaagtttgatatgtgtagaacagttttgttatactgggtactaaaaagaaaataattttcctttgttcttcacttgtttgctacataatactactaagcaacactggccccttaatttttttgatcatttagtatgaggcaaaagaatgcagtggcagtagaactagcactgtgatgttagtaaaatattaagccaacaaatggtgcacaaatcactttctggtccagttcataaacaaatcacagtgtcctaggtagtactccatgctaatgcatctccttttgaaaaaaaaaagaagcatcattgttgcaaagaatgaccaacaacaggtagtgactgagaaagatatttccgaattaaggcatgtgtgggaactgagaactgataggttatttttaacacatcttctttattttattttttttttttcttgattgatagagaatctgcatcagccatcttcagcaaacataatgcagtttgttggtatggaaatagtgtgagatatcctatgcaagttataaaccagtttctttctcttgccattggagagaaatttcatcttgagctgtcacttcaatttatggctcccctcagacactgattctcaatctattacattatcaaaacagagggaaaacaagcgtttaccttttgctttcatgccctataaatttccatgtgaataaaagaaaagaaataattccgaattattgattgtagtgcgggtccatattataactgtctagattagaaaaagaatccacatcaaatacagttcaaatgataattgaaatttggaatagaatgaaggaacttcagaatataaaatgaaataaaaaacaaccgatataaaagaaacttcacaataaatactaaatagtacttcttccatttttaaatatataacgttgttgaaatctggacatttgatcattagtctcaaaaaaataagtatatttattttattttactatgacctttatcatttaatgcactttaagcatgtcctatattttttatatttgcatatatttttttaaatagtacgaacaatcaaacgtatgtccaaaactcaacagcgtcacgtattaaaaacggagctagtaataaaataatctatctactttagaaattcccaaaaactgatggttcgtgcaattgccaagtgtcagactccagtgacgccgttcagaagaacaaagagtaatctttcagtaacccatagttaattgaaacactttatccggccgaggtatgagcattttcacagcgttgtcgatgtctctctggctgctggtgaatcaatgatgaatcatggtcaaaccgacgacaatacaagagctgggcatctgcaggtacagattagtgcatctcctttacaacaaagaaaacctcagtgtttttccttaacttgaccagcagcagctagtgcctgacaaagctgtttcctaacttgggtatgtgactaagcagtgataagatatctgaaaaaaataataagtagggtgattatattaattattcttaacaccttcactactaaccttttgttttttggtggtgatcaggtcactgcaattaagcaagtgatcaattgatcaaatcatcactagctaccctgcattctccaagataatcaatacagcttcagtgtggcaacaaattaaagctgctttgttctcttttgcagatcaatatctgtgcgcatgcttagttcatcacgaataaatataaaaaccatcacgcataaatataaaatcattcatctgttggtattgggctacgtggttgaatcgagtgcttattattttctgctaagttgtatttctgtgattgtggatacttagtgcaattgtgcagctatctgatcaaacttttctctctttttttaaacttggagtctttgagaattcagatatttgcctcccatctcaattgataagtacgaggtgtatacagcttgattgcctcaccggctgtcaggtggtttaattatctgtgggctttccactttgtgttggaaaagtggtgatatattatccatcatttgtatatatagatggatgaatacttgcaggttagcatgactagtttaatgacaccatcagtgttggacagtggatctcatgttcttgctatcctctatgtgcatcatgccatcatgcttcagaattttatctcatttgttgtgagaaaagataattaagtttcaggtcaggcatctcgctcaacgaaatttaatgcaaattcagatggaactgtcttaaatcttaactaatgtatcccaaaaccatttatgaaaatgaaataaacctcctatttggctgagccgctaatcagtttggaatttcagaatgcttactaagtagctcatcagttccatgcctgttttgccttctcttcaacgaattgcagagccgggacagtaaatagcttgcaaattgcaccaaacatgcaaattttgaagcatattaaacatattaatttacataaattgtacccttcttcatgaaatacagcgatgattccttgttgattgagctctgaatgatagataattcactcaattccctcatggctacgcaacagaaggcatcaaaagtaacgctgattgcatcatctatcaccaagtagcagtagtactctgctttgctgacaccatgtacagatgtactcgctccctcacctacatcatcttcagagtttaatgtagttgacagaaaaaaaaaggcttaagtcatccaggcatcacagaaacgccattcacattttttttttgaaaggaaattaagcaccagggtgataaatttccaacctgaacgtcattttttgttgttctttcagatatttcaaccgtttacatatcatcttagttatttgctgtatctgttctgtcaaacttatctctagtttggaattcaggatgctaattatcccagttcatgatttcaagtagatggtgataccatgggtgttctaagaaaaaatgagtttgttctgggacatttgacgtttgaaagttgcagtggttactgccaaaatgagttacttccaatcttgaatgctgacgctactccctccagccaaaacagaagtgccgtcatatagcttgaatatatcaacagtatcatatgaataatcatattagccatagaaaaccatacaaatatgattaatttacagttcgagattgtgtcttgaagaccatatgtagatgtgaagaacagcactcccattatctaaaaaaaaaatgtgaagaacagcactcgttttgctagtatttgcaatttcagggttcaacaagtaagcaatatataccaacattttacagagaactttctacctcttcttggatgaaaaacgcaaaatatcaaatgatcattgaagaaaaactagtaacgtggagcatttggtcaagtagcaagatgatcattgacaaatctctgttccgaaacactagcctccgatcaagaacacatgacgagtgtgcatatatctatcttaatttctcaacccgtggctgctacctactccattgatacatttgatcactcgcataagatgaattgaattctttgcatgacatcaaatcatcaattcgatggctccagtgggcagatcagctttttgagctttgaccatggtgctcattgccggcgaggtcgtaagcctccttcgccgagcgaatgcaagaatccaagaacgaatttattgcagctagaggctcgcggcaatctccctttttaaggggctcatcagctgcggattcttgcacaacacatcgaatttgcattcgcattagcattcgcatcatcgcttgttgcctcagagagaagagagaaagaaagctcgagctctcggctcccatggcggcggcggcgtcatacgcgcacctcgtcctcgctgccaccctcgcgttcctggtgctgagctcgccgccgcagtcagcggcgagccgcgtcgacgtcttgaaggaagtagtagcaggcgagccaccagctgcggccatcgaaccagttgtcaacgatccgtcgtcgtcgccgccgccggcggtggcggcggtggtccacacgtcggagccatggccgccggtgcctccgtcggccccgtcaaacaagttcaactagctcaccagccgctaccaccaggatgtccggtcgctgtgattcggcggacgtcgccggagacgatggccggacagtcaccgtcatttcttgattcagataaaatcataaaaagcttgcatttgagcaagccgtataggtgtttgtgcgaggagtgcttctatgctctactggagagaaaaatcttcagattttagggggcgtctaggcttctagctggttgtgattaaactctgagttcgtcgagaaatctgtaaatcagtttcattttcagttgataatggaagcattttcttgctctctgattctgccttttcttcagttcttaccaaaatttgatactttgattcatctctgtgaagtacttgcattgttgataattgatgtggaagatttttgaaacctcatgtgctcttggagaggagatgaacaagtacatccataattttcagatacagccatctagtttaggtgcaaacattaattacagatacattcatggcgcacgtcaaacgtagcaaaggaaataagaacaaaaaaaataaaaatacagatcttgataaaattaaccggacagattgatggacaacggcatggtataattgggtatcaagagaaaatatcacggttgatgaagtatatatggctatggcgtgcaagtggaggaaggggcatccaatcctgcttccagacacccataaaaatacaatcaacaatatgtagggtgccatcctttggcatattggtgaaataagccaaacggcatatttgcaaacgaaaaataattcgtgaataaaacttttatatgtgtgttcttagcaatctaaaagcaaatgctggaaaataaacttcgatgaaaaaaccccaaaattagctttaaatttaacgttgaaaattcaaattttggctgataagcatatgaataatcgtgacatgtacccacaacccctttgtcccctagcagtccacccctcctccctctcgtttttctttttattttcttttgtaatctcctagccttgggttattgtacagttttttcccctactttaatacaaatacatcccacggggttaaaaaaaatgaaaatatcacggtaagtgatgctttggtaagacaacagcattcagatatgcatatactatgaactcttaatgaaaatataggttagtttaacattcaagaatgtttaccctgacccagccaacggttgggaaacaactacaaacaaaagactgcctaaaatgtcaaaacctaaaaggtacaaaactatatagcataaatatattataaaccgttagggttcgaccagctagaacaccatagccataaataagaagctacgccatgtcatgtgtcaatgtttgatgtctcgactacggtatttggacagtatggggatcgtcggtgctaggatatacgcgagactgaggaaaaagagatggagacagggatttttatacaggttcgggcccctgagctatcaggtaatagccctacatcctgttggctggagccgatgttgctttttattcaccataatcacaccagtacaatatgtggggtagcctatctaactgttgtcgacatggcggtctgaaggtctgactcatagtcgacaacagggtagccttcctcctcgagctcacgcccgacggaatcagagacagtgctagatccctacggccagcctctaaaggtaccggatagggtcgatccaggcgtatctctgatgtcgatattcggcggcttgtcttggcgtatgtaggcttgtatgttgtggcttctggtgggtgttgattgtctcttcatggtgagtgtcgatcgtgttgatcgtcttatatcatgggtgtcttccatggtggttctccctggtgggtgtcgatcccccatggtgggtgtgtccccctgtcctcctaggggggcttgtatttatacccataggtgtccccttgtccaagtagaactagggaaaccaatatggatacaatccgagtagtccttgtcgtttccatgtagaactctggttgtctttccttatccggaactccctccatatccgaaggttgtttccgtataggacatggtatgtggtgggtcctgccgagatttagtcaactactattaggtatgtggtatccataaccatgacagtagcccctgacttcgatgcaaatgaacgaattcatattctcaaccacgcgcagacattggagtaactgttatcgagctcatgtgatcgttctcggtaagtttagagataatgttggacttcctttgtcagcctcgtgcgggcaccgaaagggtttgtctaagtcaatctctaatgtcgaccgagaaagtacagagcgtacgactaagtctcccgtcttgctgtaatcgagaatttggattgaagtcaagaaactttatctcggcgggtacaccatctcttcattccgtattccttgtcaagatccagcaaccgttctcgagcgatcgagaaggcgtagagtctgcgaaggagctttgtcaacatttgtcgtactcgccttagtcgatcttggtgtagaaccatagagacatggagtcttcgtcaatgtcgaatagaattttcctgaaatcaatactcagaaaagaatatcaaatagaaatagcccccgagcgaatgcccaaagggtgacatgttataatatgtatggtaaattgaaaatgaattaaatttatcgaccaatgttttgtgtatgagcgtcttctctcttaccgacttcgatcagttagtttgtagagtcatacactctccctagcccccagccttatcgtcggagaatcgttctcagaggataatgctcttggacccttgacctgccttggttgaataagcactgatcctagcccccagccgtgaagttggaaagctcagtttctgattacacggcttggttaatacgcacggcgagaactcttacacgaccagatcttacatggtcttttgtctctacaggatccgacaaggccttatcggctctgggcgtccccagccaaagttcccttaggttcctcggaggtcttgtcaagacggcgtaaagggacagtaggataggtttcaacgctaggtgtcgtcgtggtaagggatctctgggtaaaacacttggcgatattgtgtacctgctatcaactttgttgaaatagaggtagtaggagagtcgctacaccgctggtcgaggaccaggtagtagtcgtaactcgaccacttaaagtggaaatagtgggagaaacactacatcgctggtcgaggaccaggcagtagtcgtaactcgaccacttaaagtggaagtagtgggagagacgctacatcgctggtcgaggaccaggcagtagtcgtaactcgaccacttaaagtggaagtaatgggagagatgctacatcgctggtcgaggaccagacagtagttgtaactcgaccacttgaagtggaaatagtgggagaaatgctacatcgctggtcgaggaccaggcagtagtcgtgactcgaccactcaaagtagaagtagtgagagaaatgctacatcgctggtcgaggaccagacagtagtcgtaactcgaccacttaaagcaaatgtacgagagatcactacgatcaactggttgagaaccggtgagtaggtgtccctcgatcatttggagtcgtggtacgaggaccgctacgctgccggtcgaagaccagttgtagctgttcctcaaccatctgaagtcatggtgcgaggaccgctacgctgccgtagtcgtacctcgaccatctgaagttaaggtgcgagagattgctacgtattggtgcgagaaccagtgagcgagcagaattatctctcgaacactaatggaagttgcggtgcgagagattgctacgtactggtgcaagaaccagtgagcgagcagaattatctctcgaacaccaatggaagttgcggtgctagagttggtttattgcaatttgtatctcatgtggccagtatgactcacgtacccaacttatagcatatccggatgtccgttcgcaatcatgtcgagtgatcaagccaacgacgttcacgagagattatccgttaacaaccttttctcgagtagtccagccatggccggtgctatgagataggtcgtcggtctttattggtaggttgggtgcgataattccgcatttgtcgagaatgttctcgataatggagtgtactcgaccataacctactcgagtgctcaattgttcctgaaaaatattttctagaaggcaagacatatagcagagaatatcgagtatgtactcaaaaactgcgtggatcttctagtattatcaggatataacgagcagatgtaaatagcaagcattatgtaaaccgtaaacaagcatgatttatacagaagaaaatagagcgagcccccagcgttagaccgtagttggcctaacatcggaagcactcgcacaacagatattgtataaaaaatatgctctaggtaaacataataaattatagatctgacaatgatgtatgatctgaataggtatgataaattgcagataaaatattgcgtacctttgtagatacatgccggatgtatctatgaaattagtagaacaatttgaaaaaccaatctaccaattaccttattgcgtactcattcgacatcatatgatctgacatcttttggtacgccgcgtatcttgaggcttggatgatctcgatagaccgagttgtcgatgacgatgatggttccgatctggtcggaagatgtacttcagtcgggttagatcttctcacagccgaagtcgtcgagtagcttgttgttggagaatccatctcttgaacccatctcgtcgaaatactgaagcaccaaaatccccctacctggcgtgccactgtcgacgtttgatgtctcgactacggtatttggacagtatgaggatcgtcggtgctaggatatacgcgagactgaggaaaaagagatggagacagggatttttatacaggttcgggcccctgagctatcaggtaatagccctacatcctgttggccggagccgatgttgctttttattcaccataatcacaccagtacaatatgtggggtagcctatctaactgttgtcgacatggcggtctgaaggtctgactcatagtcgacaacagggtagccttcctcctcgagctcgcgcccgacggaatcagagacagtgctagatccctacggccggcctctaaaggtaccggatagggtcgatccaggcgtatctctgatgtcgatatccggcggcttgtcttggcgtatgtaggcttgtatgttgtggcttctggtgggtgttgattgtctcttcatggtgagtgtcgatcgtgttgatcgtcttatatcatgggtgtctcccatggtggttctccctagtg

SEQ ID NO: 60741 - DNA, 641 bp, Oryza sativa
  unsure (1)..(641): unsure at all n locations
aagaaacatattttctaatagaaataggcttaaaggtactggaattatggtatnttcaatgtttaatgcatttttaaatanctgatctttccttcttcatgaaagttttacattcggataaatttaaatgtaaaaaatttagtgtgtatccctctcatagatccgtatgtataagtcaagtgaggtaccaagtggcatataattaaggaattatcgagtactcactttgtccctaaataagtgttaatttagtcaaaaatttatccctaaaagaatttagctttagagtggtgtagtagaccactttacatcattttctttttatttgtagtcattaactaaaccaatagtgttccttcatcctccttgttttcttcccctcctcattttctcttcatattagtaataaatgtgtcagagttacggataagatataccctttacccttggatgtatgttgtataccgatacggtatacctgcgcgtatacagatgtttcctgtaatccgtcacgtaacagaaacggagtccacggatgaaaggagtcctactcggacagaactgggtcgttactatatcgtgtggggtccgatatctccgagttctacttggagatcaactgacccgcggtataaaaggga
